United States Patent 10,233,495 (METHODS AND COMPOSITIONS FOR SCREENING AND TREATING DEVELOPMENTAL DISORDERS) - sequence listing, part 179

SEQ ID NO: 1107 - DNA, 1113014 bp, Homo sapiens
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggtccagcgggggtcacctggtggcttcccggcgcgccctctgctgttcaggatgcagcactgcgcggcgcggcgagggcaaagcggcctcatccccgccaaaaaataaagatgttttaaaaagcgcacatgctcagctccctcctgcaggctctgggttgcagggataggagttttgttgtgttttgttttgttttgtccagaccggtattgctcagtcatccaggctggagtgcaggggtgccatcatagcccactgtagcctctacctactgggttcagacaatcctctcatctcagcctcttgagtggctgggactacaagcgtgcactactatgcccgactaattttttaagtatttgtagagactagggtcgcaccatgttgcccaggctggtctcgaactactgggctcaagcaggccacctgcctcagcctccagaattgagattacaggcgtgagccactgcgcctagccaggagtattttttagtagcagtcctagatagcttcactatcatttcctgggaaagttttggaaaccccagcagagccttcatctttaactgtgtgaccttgggccattgaaataacgtttaatcttggttttttcacctgtaaaatgggttgatacgagggtcagttcaggcactgtgcgtaaagcacatagcaccgtgtctagtaggtactctctgttccttaactgtcgttccttgattgctcttaagatacgacagtgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttcttttttttttttcttttgagacggagtcttgctctgtcgcccaggctggagtgcagcggcgcgatctcggctcactgcagcctccgcctcccgggttcacgccattctcctgcctcagcctcccgagtagctgggactacaggcgcccgccaccacgcccggctaagtttttgtgtttttagtagagacggggtttcaccgtgttagccaggatggtctcgatctcctgacctcgtgatcctcccgcctcggcctctcaaagtgctgggattacaggcgtgagctaccgctcccggcctttttttttttttttttaaagacagggtctcgctccgtcgcccaaactggagtgccgtggtgcgatctcggttcactgcaacctctgcatgccgagttcaagcgattctcgtgtctcagcctcccgaatagctgggattacaggcgcccgccaccaggcctggctaatttcgcgctgttggcccggctggtctccaactcctggcctcaagtgatccgcccacctcggccccccaaagtgttggcattacagacaggagccactgcgtcagcccagaatttctgatttaattggtttggcccctcccctctcccttggtaggttgtaaaatcttccctcccaggtgattctaatctatgcaaggatgtgaaccactgctgcctttggtggcaaggtagaggaaaaacaaccaagttctgatgagttcattcaagacacacacaggtattatgtgacaggcctttggctggcactggttataccgaggcaaataagagccagttgtcatccttaggacccaatcttattagggcacagtgacatgtgtaggagcgtccccacgcagtgtgtataccaggaagtagtgtgtctggcatgaggtgtgtgtaggtagttgggggggtcgtgagggaatatggtggcaccctcacagtaaccttcacttcctgggctcaagcgatcctcccgcatcagcctgttgagtacccgggaccacaggtgtgtgcctccacacccagctaattattacatgttttgtagaaatggggtctcaccatgttgcccaggctggtttgaactcctgaactcaagccagcctccctcccgaagcactggaatcacaggcctgaggcactgtgccaagcccagagcggtgttttgagctcaagtagaggtgggtggggcaggagggcagtctaggtagagggaacagtgagaggagagaccccctgcatggcctgtccaggggcctgtgatctttgtgagggtccaggaatgtgaaggttaaggcagggaagggaggacccatttcaaggatttctgtgccttgccgagaagcttgggctctgttggcagagccagagagtggcattcattcagcttgtgaattctggaagaatttctggctctggagaattaaagggacatttccagcagcagagctccagtagcctttgcagggacggaggcaagctcctgagcgggcacttgctgttcctctcacctgtacatctgttggggaaaggctccttctcatccttcagagctgagcttacatgtcactgcccaagagaccttcttaactgtgggtgtcccctcgaccttgtactagtcaccttgtttctctgcttcttcgtgcttagccttggctgtgtactcctccttgttggccctgtctcccttgcccaggttgcagatgtcatggggcagcttgttcatctgagtgtccccagtgcttggcacccagaagccataagatgagcccctgtgggatgagtaaatgaatcaccttgggagggtcagccgcaggcttctgtgggtgggtgggtggtgcactgggccccagagtacaaagatgcacatgacccgcttccggcttcctaagcccacctctgcctctggctctgtggggcgtctcctcctttgccactcagccccagaggtgcttctgcttccctgcaggcttgccctggagcctggcgctagggccctggggctcccttgctcctgcgtgccccctgcgcctgccttcctgctgcctggcctttctcccatctgctttcttcctgagtggcccctggccaggggactcgggtgcatacatggtttccaaacgcctttcctccagccctcccgactagtgtcttaaatctcaagctggcctctctggctccgctgttttttttttttttttttttttaatttaatttaactttaaattccgggatacatgtgcaggatgtgcaggtttgttacataagtaaacctgtgccatggtgacttgctgcacttgtcaacccatcacctagttgttcagccccccgtgcattagctatttattgtatacaccagctgagatgccagggcttggctggctctcagctggagggctcactctctggaccttgtgtccgtccctgctggccctcagttctctggatcagggttgaaaggctgaaattctttgggtgttagcttaggatgcctctgatccatcctaacccgacattcccttgatctctcctgatctgtgagcatcctggcccttcttttcttttcagttttaatttttgcgctggctccaaccccttttcattcctgactctggaagtgacacttgtttttctcttggggtttgggaaactttgtggttgttctttctaggaggctgctctttgagtcatttcttttccatattgtttctcctactgtagcagggccatggccagggatagaggctgtagctcccactgagacctcggggtctggtggaacccggtcttgtgtgggtgctgtcggcctctcctgctttcccacctgcctcacggttcacttgtgtgcctcaaaggcacacatgtcctagcactccaaagcccaccagggtgggctcccaggggtgaggtcgaggtagaccgggaacccaagagagctggtgggcctttcttctacccctctcccctcacagtctcagagcagccccttcatgggagatgggaagtgagggacaaggtctcagtgtcagagccgtccttgtttgcccttccccgtgcctcttatgaagctcaggccttttggcagtcagaggcctcaatggtgcctgtgtccacagggctggctgtcctcaccgtgaagtctagatctccctgctaacttacactgtgctcaaaacacacacacacacacacacacacacacacacacacacactggctgtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcctgggccacagaatgagaccttgtctaaaaaaaaattaacagaaaacaccccatacgtggaagtgtggtattcacataatatgatgttcacttaaatttgaatcctttggtttaagtttagattactcttaattatctttttaaatgacaagctcgttgaaagaataaaaaatcaaagacggcttctatttaaaggagaataggagaatgcttaggggacatgtgttctaattttctcttcattaaaaagtcatttaaggttataattaaaaagaacatcttttaattaatttttatatttattaaaaaaaagtcttctattgaaaggtacagttcttagttcttcccgtgttaactcactcggttctctataaccccaagaagtaagtgctgttattgtccccatctaaactgttgaggaaactgaggcatgggattaaatgacttcttcaagggcagagtggctggcaaatgggagacccagaaaaccttggcagttgggcttcagaatcttcacgaccaaattactctctctgcttcagctggttccggattcttccccagggatggttgtgtcctgcaggggacggctggcaatgtctggagatgctttctgttgccacagctatgggactggggtattggcatctgatgggcagaggccagtggtgcccaaggcagccccgcaacaaagaatgatgcaggccgggtgcagtggttcacgcctgtaatcccagcactttgggaggccgaggcaggtggatcagttgaggtcaggagttcgagacctgcctggccaacatggtgaaaccccatctctactaaaaatacaaaaattatcccggcatggtggcaggtgcctgtaatcctagctactcaggctgaggcgggagaattgcttgaacctgggaggcagaggttgcagtgagctgagattgcaccactgtactgcagcctgggtgacagagtgagactctgtctcaaaaaaaaaaaaaagaatgatccagccccaagtgccaccagcagtgagaataagaaaccctgattcaggcatgttctgtgaaagtcaagaacgtaggttgacagagtttgttttgttttttaaatgtctttctgaataaataaaaactgttctgagtgagttttgtagttcctttggaaagtattcattctgtttgtttacatttgtgcgcctgctgtgggccaggcatgaggctacatgtctgagggcccagcttcaccttctaagggctgggaggctctttctatgccagcctgcctgccaacaaggctcagcttccactgttaagggtcattttgtggatttttttattttttatttttaggttgagtcttgctttttcgcccaggctggactgcagtggcgtgattttggctcactgcaacctccacctcccaggttcaggaaattctcatgcctcagccactcaagtagctgggattacaggcatgtgccaccatgtctgtctaatttttgtatttttagtagagatggggttttgccatgttgcctaggctggtctcgatctcctgggctctagcgatcctcccgcctcggcctcccaaagtgctgggattacaggcgtgagccaccgtaccccgccactccatggattcttgagggcagagttttttggagccaggcttcaagcacatttgatgtgtgcctatgagataaagactgcttttaatggcaggcaaggaaaatgcaagtccatctcttaactttcttgaagaagcttgagacacagctctgcaaggggctggaaggtttcatgttattgccaatgcttggtttatctgattgctgttgccattcattttgaaggagaagcaggagttggtataccaatattcccactgtgccagcagagagcgggttatccttactagagagccagagagtcagaacggtttttttttgttttttttttttttttttgagatggagtttcacaattgttgcccaggctggagtgcacgatctcagctcaccgcagcctctgcctgccgggttgaagcaattctcctgcctcagcttcccgagtagctgggattacaggcatgtgccaccacgccaggctaattttgtatttttagtagagacagggtttctccatgttgttcaggctggtcgcgaactcctgacctcaggtaatccgcctgccttgccctcctgaagtactgggattacagacatgagccaccgcgcccggccacagagctgcttttttttgcaagtgatattggatggtggttgatgtacaaagtaggagtttgtccttgctactgataccgtagctggtacaaggttttaatcgttctccaagcactgtcacaggtgtcatgtgtctcgccttttcagcagctctgtgaggtggcagtagccctgaggagactggctggactcagctagcatgggctgctcaggtcttcagcgtgctgagtgaggcattcctgcactatgacagagacccagctgccaagactttgtcaaacagaccagaagccagcagttcatgaaaagaccttgcttgcaagttgtagaattttttagaaaattcgtgctctctgtatttattttctgtaaaataattgatagggaaagaatgttcacatcttatcatctagatgttgctgattaaataatataactttctgggttggcatgagtaggtgaacttttaggaaacgcagcctacccttcgaatacctcttgtagcacctggctgtttcccttttgaaataattgtatgttttcctggataccttattacctggtgacacgtgtttctagttattgacctatgtttttaattataactttgggtggtggtctgaaatgaaatgttaagtttgacgcaaaaataggactagtttgtgtaactgatttgttcagaataacagcttacatttctcagagctttttgtatgccaagtgctatgcgaaaccctggatgtacaatattcttatagtagcccctgagaccagtgctaggattatttccattttgcagatgaggggatggagattaaggagtggggtcacttgaccaaaggtgcacagcgcacagctagatgccctatgggaaggtcttactgcatctcttaactacctcttgggaccagttaggaaccagtgcttaatgaaacactttgaagttacatctgtggaaagaataaacattttagctgggcaaggtggcacgggcttctagtcccagccactcaagaggctgaaataggagggttacttgagtccaggagttccagtccagcctgggcaacatagtgagaccctgattctttaaaaagaaacacaaataaataaacattttaagagattatataaattagatattatgaattttgtccctacatcgtggaataaaaccaaaacaaatacacagcaaaatgcctctagatttatttatttatttatttatttttgagacagagtcttgctctgtcgccaggctggagtgcagcggcgtgatctcggctcactgcaacttctgcttccctggctcaagcgattctcctgcctcagcctcccgagtagctgggactacaggcacgtgccactgtccccagctaattttgtatttttggtagagacagggtttcaccatgttggccaggatggtctccatctcctgaccttgtgatctgctcccctagggctcccaaagtgctgggattacaggtgtgagccaccgctcccgacggcctctagatattttgagtgattcagcaaacctcctaaagttgaccccgtagctggggtcacagtcctctttctccttcttccccctacttccttcttatatctggctatctgggagagaaaaaatttaatacaattgattactttttagaagagttaatttttacttattactgtggattttttgttttttaacagtcacaccgaggagaagactcagtgggaacatccaaaaactggaaaaagaaaacgagtggcaggaggtttgtatgttgttgtctaaggatcttggatggaagcattaagtagatgaggaaatgtcactggcagagaggtgacaggttattgtgtgtttagggagggctctctggtagagaaccagactcccactctgaggagcttatgggatttggcagaagaagatgatgagatcatagggtggagtgaggatgatttcttactggtcttaaagtaccaaaatggccagatgtggtggctcatgcctgtaatcccagcacttcgggaggccgaggcggatggatcacctgaggtcaggagtttgagactagcctggccaacatgttgaaagcgcatctcttctaaaaatacaaaaattagctgggcatggttgcatgcgcctgtaattccagctactttggaggctgaggcacgagaagtgctcaaacccaggagctggaggttgcagtgagccaagatcacaccactgcgctccagcctcggtgacagagtgagatgctgtctgaaaaatagcgacaacaacaacaacaaaaaccagaaaataattgaggcctttgattcacagtttatgatgttttcctatcgttgcagtgtttataaaattgttcttggctatactatggaattaaatatataagtatttggaaatttcgtaaagattaccatgacttctaggtgattctgagataatgtatgatccacggaatagaagtataagaaagggacaggcacggtggcttgtgcttgtgatcccagccctttgggaggcagaggtgggaggatcacttgtgcctgggaattcgaggtgagcctaggcaacatagtgagaccccatctcaaaaaaaaatatgagaaggttcctgcccttaagaggtttaggatccagctgaagaatcaacatgtgcacatgaaaaaaaatggccgtgccctctaatgtcatatgaggtcagcgtatgaatgacgttgggtgcctgccctgcatatacatatgttctttgagctcattcaagggagaattcccatggattggcacaaccagtatggtttatagagcgatcaggaataaaataggttttcttcaaaacaagaggcaaaaatgtggagcccagggtgggatcaggggccttctgcagctgtcgcagttggaacatgtgacgaaagccagttgatgtgacaactgctgggtgggagggacaggcttgggggcggggctgggagggctccttcccttcctgacccagggatggtctttacttctccctggcacctgtagacctgtctttcttgtgtttcagatttgccatacggatgggaacaagaaactgatgagaacggacaagtgttttttgttgagtaagtgtctgcaaagaaaccactctcagctgttttgctttttaataggaatttttaattataaaagtaatacatagtaactgtagaaaaatacaaagtataacagtgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagaccattctggccaacatggtgaaactccgtctctactaaaaatataaaaatgagctgggtgtggtggcacgtgcctgtggtccctgctactcgggagggtaaggcgggagaatcacttgaacccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgctatttagcagctctagagttattattttgtacagatatactataatttatcaaattgcctattggacattaatgctaaattcctgttatagagaacctataattataaataatgtattgagcatccttatctgtaagactttttcacctctctgattctgtctttaggataaattccggtatcacgcagcaatagtaaccacctgtccaacatatagcatgagccaggcctgattctaatcatcttgtatctgtagcattaggtcattggatccccacagtgccctgagaggtagtattgttattatccctagcttactgccagtgacacagacttgagggggtaagtgacttgttaaggatcccacagcaaagaagtagcacagccaggctttgagcccagcacctgctccagggactgtactcttgaccaccgtagttaagaggagaattaatgtttcacaactgtcaacatttaaattagaagcttgaatagtctttgacaggattaggattggttggttaatagaagttgatttgagcaggaattttttttttttttaaagttatgaatgtaacataaacgtttcagtatttgattcaagtacaccaacatttaggggtcgggccagccctcctctgagtgtgagtccacttgcatggatccagtgtggtcttccttcccctaagcatgcctgtaacataacatctacaatttctactttcattttatgtgggcgaaagagtacctaggtgccgaggcaagagactgaaggcacaaactgtttcagtataataaagaaagtagttagaataagaatagtcataatacaggttagatatggagatgatcatggacaattatcaatcattactataaacactattaatcattagcttttaatattactctttgtggcattactaacataacctaggaataactggcatgtataggctcaggtgctaaagggacattgtgagaagtgacctagaaggcaagaggtgagccttctgtcacacccgcataagggctgcttgagggctccttggtcaagcggtaacgccagtgtctgggaagacacccgttacttagcagaccgcgaaagggagtctcctttccttggaggagtcagggaacactctgctccaccagcttcttgtggaaggctgggtattatccaggcctgcccacagtcatccggaggcctaaacccctccctgtggtgctgtgtttcaatggtcacgtacgttgtccgctttcatgctcctcccgtactcctggttcctctttgaagtacgtagtagatagtggtagaagaaatggtgaaagttttaaagtctttgatctttcttttaagggcagaaaagaaaatgctgacgtatgctgccttctctctctgcttcggctacctaaaagggaagggccctctatcctgtaatcacgtgacttgcttcaccttgtcaatcacttagaagattcaccctccttaccctgcccccttgtcttgtatgcgataaatatcagcgtgcccagccgttcggggccactaccggtctccacatcttggtggtagtggcccccaccctgggcccagctgttttctccttatctctttgtcttgtgtctttatttattacaatccctcgtctctgcacacggggagaacacccgctaagcccagtagggctggaccctacaactttaaggttgagcaaacacagtattttcaaagaatctgattgctacatcatttgggagttttatggtatttttctagcattttcactgtagttgattgaaccaaaactttttttttagctgcttgtctttgaggctctccaaagcattcgaccacattttcatagataccactgacactatttttcacctcccatgttatcagtttgtgtaatagtagcttgctggtaatgtagttacagtaacaagttcaaatgacatgtgtgttttttgagcaaacctggtgaacttttggtgcaaaactgatattgagagcaaataggccaaagcttgcttgagagaagtctcccaggccaccataggcagccccaggaagacggggctgtctagcagttggataggtgggagtgcctattatttgttaaaaggctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgctgcagcctcaacctcctggactcaagtgatcctcctgcctcagccttctgaggagctgggactacaggctcatgctgccatgcccagctaatttttaaagactttttttttgtagagactgaggctcagtatgttgcccaggctggtcttgaacttctggccttcagcgatcctcctgccttgacttcccaaagcattcatattacaggcatgagcgaccacacctgactgaatttcttaaattttttatgtagtcaaatcaattttctcctgtgcagtctttgcctttgcattcacgcttggaaagttactccctgaaatgggtattaatcaaccaagagcagcagttctcaggcatggttcctggaccagcagcattaatatcacctgggaattcaataaaaatgtacattcccaggcccccaccccagacctactgaatcagcactggggtggggcttgcaatctgcgctctaatagtcatccaggggatcctgatgttccctagcttgagagcctcccgtctagagcaggggctgtctcctttgcctgtaaagggctagataatatgttttaggatttgcagggcatatggtttctgttgcaatgattcaactctgcctttgtagtgctaaagcagctatacacaatatacaagtgatgggcgttgttgtgttccaataaaactttatttacagaaacaggcagtgggccagatttggccagctcctggtctaatctagaggagtaagcaagggctttggggggaacctggaaattggctcccctggctagttctcacttttctgagcctgttgcagtggggtgctggtaaatgtttagcaccaggtcttcagggggaaaaaagccactgtttgtttccacagtataaatactttggccatagctgatttcatgctgccaaggtgaagtgaggaattgggaagagatagtcacgtttggctcttgtaagccagtttgagccagtctagcatagaactgctctgttgtgtgtgtataatattggggtcacaaattaaggttgttataaatagaatgaggatgaggatggtaataattagaataaaggttggattattactcttgagtcttggtacttatagggagatgagtatatattttaaactaattttacacacacatacttttaaaatatgaaatttcatctatatttagaggcttcttaatagtttttaagatattctgaggtctttatctcatatcccaagaatacatttaagatataaaaagtaaattctattataaggagtactcttttcatccatatgtgccttttttttttttttttttttaatggttacccagggtcttggtctgtcacccaggctagagtgcagtggcacaatcatggctcactgcagctttgatctcttaggctcacgtgatcatcctcctacctcagcctcccaagtagctgcgactacaggcgtgtgctatcacacttgaaattttgtttagtgtttgtagagatgaggtctaactatgttgcccaggctggtcttgaactcctgggctcaagtggtcctcttgccttggcctcccaaattgccgagattacaggcgtgagccactgtgcccagcctccagtatattttaataccatttctacaagatttagatcaattccaaatcaaaatgagtgctcgtaggaggtatgagtgcagagtcttaaaatgaaaatcgttagaattttggtagttggcaggtttcttatttacaactaagactttatcattttgagttttctacttctctacgtctttaggcccttgcacagggctaagagatttaattgaaatctactgaaaagagtggctgacagatcttatagctacatttacatgaattacataaaagcccaaaaccttctcaagaagccttttttgagatctaaggatacatggcaatagttattgtatgttacagcgtatgttataggcagttctgaaggaaaggattcgatgactatctttttttggcacaaatgtgatccttctggaggccagaagatagattcagtgggccccagttctttcaggtttaaggaataagcattttggtctatgaaaaatggggttttcctaaagtataagattgtcttatatttataaatgcctgtgttcattgctgtgggttcactgctttctcttttgggcagccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaataggtaggctcttcacttagttatttatctttgggactgctataatgagatccacttagatctagctataatggaattttgtttagtggttctctgatttaaacatgacttttatccttttcagatatcgtttcattaacatcactacctctttttaaatcctaatgttgtcatggaagcctgtgtaggggctgaccttgaagtctctgaaagctgaacactcagcaaaagactgtggctattttggtattcagggatgagagacaacaggctccgtctaagagtttttgacctggtctgcatggtgtatgggcatattccaattacctgggttattcaaaccaaaattgattggtaatagaatacggggaacaacaaggtattatgtctttggaacaaaggatactacaggtttcgactggtcactgagcatatcattttcttttgggcacaggatcttatttctctataaaattggagaatgagttcctgtcttcacctcttaattgccaatgtttacccacagggactatcatgggtagatggctcaagagggtatccttgcttcaatatgatgggccattaaggagacaggagcaaggcgggagcaaaccataactcttcataggattttattctgattttgctttgatctatttacataagtatctgaatcagtgagaaccacctgctttgagtttagatatgcatcttcagatttgtcgacatatgaaacgttgcatttggctgtcttctgtcaagttctctctgtccttttggtcccccgcagccctcacacggcccccttgatgccctcctctactcatttgtttctctttcctaattttgtttttatttttattttttgtgggtatataaaggtgtctatatttatggggttcatgagatgttttgatacagggatgcaatgtgaaatagtcacatcatggagaatggggtatccatcccctcaagaatttatcctttgagtgataaacaattcagttatacccttttagatattttacaatgtgcaattaagttattattaactataatcaacttgttgtgctatcaaatagtaggtcttattctttctttctatcttttttgtacccattaaccatctgcacttctttcttaattttgaacaattccttgaagctgcagaaatattttctagcatgattagggaggcacaggaggtaaaaatacattgttcaagggtcaattattgtgttgtacaaggtgtgaaatctaccaggttgccatccgagtggagaatttttttactgtacttgcctatgaaggtaaagaagcaaatggaaatttttttttaagaattgaaaggattttatttcaaatcaactctcatacctcatcctgggctccaaatatgttcaatccacttgtctgaacttctgcattggagtaaattttatataattgtcattgaagtcaaaactgatggcgtaatatttaaaacaatggctggatccccaatctaagaagaatacattttgttgatcatattaagtactgttacagtgaatgcatggacccatacaattgtggaataattaagaaaaaaggacttaagggcttaaaaatgtctttttaacaatttaacaagttagccagaaactttaaagatcttattctcttaatcttctagctagactctttttctgtaatgagtaagatatgtgactactgattgttttttgtgttaagtgttcgaactgctccatgtgacattagatagcagactcttgaatagagctaatgctctttcaaagatttgcaacagcagacctgcgacattgtaatccaggactgatagagttggttcagaatattaaaagggtgatatctagttagatacataagtcttgatggagaggaggagattctgaagcattgagaataaatttgtggttgctgagaatggccctcacatgttggagtaaagccagaaactctttgtgcctcttcacagctcccacttccccctaagactcttccttcctgatacctataattcattttgtggacactgcaggaggtgtctgcggtccagttggaggttgtggcaaattgtaacgctcaggatggcacagatgtcgcacaaggtcttagggagaccagcctttcctattcaagtgcccacagctctttccccagctgtcaccttccgcaggaatggcctttaacactgtcacctcaccccattcccctccactcttgggaagcatacgtctaggtgagtggtgaagatttttattctgaatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgcccaagtaggctgtggcttctagataaagtccttctactaagctatgaaacatgccaatttataaattgctatcactactttagttccgctcatttaaaatgaaatagctgaatgccgagtgagtgaattgggcatctttacttccaagacttctggggcattcaggagtcatattctatctaagctttaatggtgttggtgttccctttcctttggccactcaagggagcctgttttctttggataaaccgtgaaatctttaaccctgtgaatgtccgttttctctaaggcggggtgggctgaaacataacataacaggatttattttgaaagtggtgactccacaataaaaacatagatatctaatttgccttacaaaggccgatttgcaaatctagtatttccagtggttctttctttctttctttctttcttttttttttttaatgccccatatgacgctgctttgttggaattgccattggtgaggatctcactgataaagaaggggacatccctcccttgatagactttagggttgcactagagccatgccccctttgaagtggcctctaagcaaactctgtcttgtcatcattttcctctctgcagctgtaagtgatacggagctgtattttgagtttttgatactgatattactaaggcaattggagggattcttaattcatctaaaaaaaatcagggattctgacagataaaaggatttggaggaaatgtcagaataaagcattgtgggttcatgaagtcctaggttttataattaaggtttataggcaggtattaccgctgctgactggattcaactgtctggattggagatgaacaaactgccatctctgggctaactctgacccactgcctgattttgtaagtagaattttttttggaacacagccatgcccatttattcccattcctataatgttgaactactgtttgtgtatattcagttatcccaaaataatatggccctttgcttgttaccagaagagtcgcccagttgtggcagagatcatctagctcgcaaaactgtaaatatttactctttggcctttcccagaaaaaagtgccgactgctatgttagatactccagttcattgaaagtgatatcaccctaacattctctaaattagccacagcttagatgaaatttaggcaaatggaatgccccaggccccaggaagactgtggcagcacattgtatgtaactgttggggatgttgcctgaaacccccgccttttttttaggcagctgcaaggattagaatgttgcctcctcagaaactaacactcttctctccttgacctttgtttaaccagctttctgaacctgaagaactttgtagattgaaagctgtagcttgtggacctctctctgtggagatcagcatctcagtatccagggggaagccatctcttcacccaaagcttccgctaggagatcaagaggcccggaaccccgcagtcctgaatgctaaccagtagagacaagggaggaattcatttctgtttgtgttcaacatagactgagcaggaagggccaggtgttttacgactctttggagttagcagcttgttggctctgatttggtaaaagcaacggaaatgccttcagcacggtgaacattacatgcaaatgttgggaagtgttaggaaagggaatttttttaggcgagggaatttcgcattgaggaaggtccctgcttcgtttttagacacagcctatcagtcagctaatttggctatgcatataaatactttagtataaaatgctgccccctgctacctgcaggctgacatgttgctcatcaaaggcaggatccttctaatgagggattagttggatgcctaaatgtgggaccacctactctgttcattgtcttaattagctagatgtttgttggagcgcatgcaaattattttctgtaagcagacagatttattatcatatttacggagtgacatccagggtttgtgagacatccattaaatttttttttttttttaatgtttgagatggggtctcactgtgttgctcaggtgttggtctcaaactcctgggttcaagtgatcctcccaccttagcctcccaaagtactgagattactggtgtgagccactgtgcccagatgctattagcaagtatgaacaaattagatattttcagtctactcttctgtggtaatgatgataaaacttcttaactttcagtcctaaaccagcagtggctaaaacttgatttttaaaatttttttcagagtttggtccagatgaagtttctttcaccttgcgaacctttagaacgctgggctgcatcatgtgtgttgtaactttaaagttagaatagcctagcttcgttacagtttttgagccaaaggacccattaacagaaacaaaactttttttcctgcaaacaaatacaagctggccacactggtaaataccagtgaaatatattttgggactgacacttgcattttctattggtacttatgtcacaaaatcacctctctaacgtgtattacatggacctatatatatgcatacttacatatcaaaatgtatatattttgaggtataaaaagtacgtgctcaaggtattggtcactcctcaatttgttttccttgaaacaaaatgaaggtataaatatttcagccgggcgcggtggctcacgcctgtaatcccagcactttgagaggccgaggcgggtggatcatgaggtcaggagatcgagaccatcctggctaacaaggtgaaaccccgtctctactaaaaatacaaaaaattagccaggcgcagtggcgggcgcctgtagtcccagctactcgggaggctgaggcaggagaatggcgtgaacccgggaagtggagcttgcagtgagctgagattgcgccactgcagtccgcagtccggcctgggcgacagagcgagactccgtctcaaaaaaaaaaaaaaaaaatttcatgcagggaatcccaaaatgtaattatagtgtgatgttgaaattgattgtcttagcttagagagcctactttttaaaacttagggtcttgtttctaaatcatgtgttgaaattacagtgtgaactgtagttgccatactctttgatcctacaaattgtcaccacgatgaattcatatcttgtgcaaattttaccagttctacgtgaatagaagaaaattactttttcttcatgtagagaagggtattcattcctaagattttaaatccacacttcccaattatggactacgccagcttcctttacacctttgcttctttgttttcttttccatacctaaatgttactaaattttgcctttgagcctaaagcatgtcattgatggtttttttttttctagttattccaaaaggtcccataaatctggggccatagctaacttacatttagtcattttcatgggtaaaacacactcatatgagatcattgcacttgggatcttgaaatgcctgattagtttcctttctgattgttgaccagacttaaactagtgggatcttggcatttatctttttaaaaacctggtgctcattaaggaaaggaaaatattctgaaataatcgaaataaccttttgggcattggaactccattttaaattaaaaacatttgtgcctactattatcttatgctaaattatacccaggtattgtaagtaaaattattttgaagttactttgttctaagaaactatggagattcttgacagtgttagacaaagtccttaaatgacattatataaaaattgagaattagtaccttatgacttaaccattttacactgagatattattggacattgagtgtacatggaaatcacgtgatcaaagtatttgagaagtaaatatctaaaggaagagaccaatttaaaacattctaatgagcatcatctcataatttggtaatctcatgtaaaatgcttataataggggtgtgtgtatgttatatatatttttaaaataaatttgtaatcatgtatacagtagtccccccttatccgtggtgtttcagtttttttttttttgagtcagagtattactctgttgcgcaggctggagtacagtggcgtgatctcagctcactgcaacctttgtctcccagggcctggtgattctcatgtctcagcctcctgagtagctgggattacaggtgcacaccaccactccctactaattttatgtttttagtagagacaaggttttgccatgttgtccatacaggtcttgaactcctgacattaggcaatctgcttgcctcaacctccccaaatgctgggattacaggtgtgaaccgctgtgcctggcccgtgtttcactttttgaggtttcagttacctgaggtcaacaggcatctgaaaatactaattttgagagagagagagtgtgagagaccacatttacataacttttatacagtacattgttatagttctattttattattattgttgatctcttactgtgcctaatttataaattaaaatttatcctaggtatgtatgtataggtgaaagcatagaatacatagggtttggtactatccagttttcaggcatcactgtgggtcttggaacgcatctcccgaggataagggggggctactgtcagtgtgaacctgattagatctcaactgaaacttttttgtcacatgaggccatcagttgaatttcatgcctgcatgtaggtttagattttaattacttttttatggtgtcagcataacaaatgagagtcatacaaactattgtttaatgacaaagtgggtcaaacccataattaaaaaaattaataatagatttttgttctacttgaggttttgtagcattacgtaaagcttgaaaacttggaaattgttttacttaaaacccaattaaaataatttgatcttttgcttttacatcatagagtggcacaataaaaattgtaatggaagatgttattttacattttttttctttttttttttttgagacggtgccttgctctgtcacccaggctgtagtgcagtggcgtgatctcagctcactgcaacctccgcctcccgggttgaagtgattctcctgcctcagcctcctgaatagctgggattacaggcgtgagccactatgtccggctaatttttgtatttttcgtagagacagggattcaccatgttggccaagctggtcttgaactcctgaactcaagtgatccgcccaccttggcctcccaaagtgctaggattacagacactagccaccatgcccgggggtgttgtacatatttcctttaatctaaaagcagaaccatctttatatatttttatttttttccactagagggctctgttgccctttgatataattaaacaaaagaggcagcattgcaatatagttctgttcctctcagtccatcttgctttcattttggttaaataatgtcttttacttttctaacatatcttttaggtcttctaattctctgtgatgaagttcaaactgaagactgttactagtgtcgtgtttgtttctttttctctctcttttgttttgtttgtataaaatgccagggatgaagggatccacttaataaaaaggcccattgtgttcagggagcagcctgttctgccaaatcacacaagggcatgtgttttcatgacattattgcttttgagtgtgctggcctagcaataatatgatttttttttcctaagtggaaattgtaatatttaagtattaatacctctgtttaaggttcattttgaacgccttggtgaccctatgtttttttctttgttttttgttttgttttttttttttttgttttttttttttgtttttttgagatgaagtcttcctctgttgcccaggctggagtgcagtggcgcattcttggctcactgcaaccttcgcctcccaggttgaagcaattcttctgcctcagcctctcgagtagctgggagtccaggcacctgccaacacgtctggctaatttttgtatttttagtagagatggggtttcaccatcttggccaggctggtcttgaactcctgacctcatgatccacccgtttcggcctcccaaaatgctgcgattacaggcgtgagctactgcacccgcaaccctatgtttttttctaagaatatagtgtcccttgccccctgctacaagccttacccagtgttacataatttattgtaattaaattgtttattaatgatacattcttgctgtagaagaaaacgtgtccttttgggctcagtacagtatatgtttcttaagtaagagggatcatattaaaccagctacttaatgtgaagcagatagccagtgttctccatgtacaatcttagggagggtaatttttgttttggctgtgtaattatggtttgaggcagcccattaatcgcatatttcagctgtcaaatagaaatttggcccagaaaggaatacactttggctttacaaaactgcttattttcaaatttttaaatggggacaaaaacgaatatgctatattatatacttttatttatataatttttttttcagcaactttttctcttttgaaaatgcaagagcctgaaaaacattgtgaatatacttgtaacattgcaaagctatttcaccagagtaaagatattttggttgttcatatacgagtgtgttcgttgtttatctaataaattgttaaaactagatggcgattctgggaattattatagacttcataataaataagatgctgacagttgaaacccccttgaccgttgcctgtttggtatgacacagaccttcttggacttttgtagcctatacatgagtagatatgaatcctcagccttctccaaaataaggttggggtcactaggaggccttcttggaaagatgtcttaaattaaggcaccagtagatggatcaaaaagcaggttccaatagctcgcttttagtttcttgcctaaatttgtgatctccctttggcttcataaataacggtacatttcatgaagagctggtctcagtctacacaagcctaactgaatggggtgcataggaagggttgcattgtgtgacaaggtttaaatctaattgttttaagtctttgagttatttgctcaccaggctgtgcttgatggttttactttttgtgatttttggagccttcatgttagaagccatagtcatatggtgctctctgaaagcaagacaaggtttcttcactagactctaagaggagatctgagacagagagatgggggcggggaggaaacctatttcagtgtctctactatttctacctaggtggaggataactagccagatgaacggagctaagccttttgtatgaagtttatttcatataaagaggaacaaaatcagaatcaaatttcttctgtagttgcacagaaactgaagttaaagctaatacaatgtttttcatttttacccttacctctacaatgtacttaattgttacagattcgtatttattgattatcatgttgtattacattgatagccgtttaaaatttatgaagattccgtacttgtcatatttaattctcagcaccgtgcttacagctgtcttgtgataatgtcgaaaggaaagagaagggaggtgaggtaacgtgcttgagatcatacaggtcttgggcggcgggtgcctgcaggatagatcaaagggtaattgagtctgtgcctggggccccttccactgtacatgccaccatcctgttgggaggaataacagcacactcctgaatgagctctttctaagcagctcattcattttgttaatcctgagtttggaatcaaccaatttatttaaacccgtgaagcctcgctctgtgcccggtcaagtgctgggagtggcatctgcggggagggccaaggcagatgtcatttccagactgcattggatcctggattcagaagctgaagcttaggagtgggcatggtggttcacgcctgtaaacccagccctttgggaggctgaggcaggaggattgcttgagctcaggggttcgagagcagcctgggcaacatagcaagaccccatctctaccaaatcaaattttttttaaaagctgaagctttctttaccaaaaccactttggtattatgattgtaaaacaaacattaaggaataagtctgggggaatgggaagtagcattcatcaagcgcctgtatatgccaggtgttaggctagattagcttgatgtgccttctcatttaatataagtaattattttaaaggttattgtgattaacatgtattccttatggaaaatttagaaagcgaagaaaaataaaaataagaataaaagatttaaaaaaaccccaattcttaccagttagaagtatactattaatatttagcatgtatgattgtaagcatgttttcccttctttcgtgatttttctatttaaattgtgattatctttctgtgttgttaaatactccacatcttaaatggctgcatagtattccattatgtggttccagctcttctcccagtgtggtacattcgggtggtttccagctttttaatagctgtggaatggagaagcacattttgtaattaaatgtttgtacccatccgtgactcttctatagttttattttgtggaagtggaattgctgaatgaagtgatttgctccccaaccttaatatcttgatttgttttgtcaaactgccctggaagattgtaccaatttgaatgctcctttgcccagcatccttgccaaacttgagaattagaatttttaaaaaatatcacttaaatttgcctatctctgatgattagcaagattgataggcttttcttatgtcgggccatttgttttttaacgaattgccctttcatcttatatgcatgactattggatatgtatcgattactaattgattgcttgcctcatgtgctatcatttaattttcaaaatgtcccttagaagttaatttataaagtgtctattactttaagtacctgttcaatcctgtgatcaagaggaaattcacagagaaagaaattggcctaactcctcagtttgcttcactaaaatcttttaagcacacatcttgtctattatgccagctgcaactcaaatcaaaggcactgttgctttggtacccgcatttaaggagggaataccccaaaaaacttaaacttgtctggctttgcaatggtggtggagtcccaagatgacacagtaggcaagatttgattactttggttatgcaaatttcccctagatcttctattaatgacagtaacagcgcttcagagcttttctatgcattctctcatttgatgagcctgctttcaggtggagaaattgtaccattgctgaaaatagcttcgctgacagttagggcaagcttcattggtagcaagtttctatctggaaagatgtaggagaggaacactgactctggaagcagacgtgacctagttttgaaacctgggataaccacttcctatctgtatgacccgagcaagttactttccttctcagaactcctgttccacctctgtgcaatatggacagtactcctactttgcaaagttgttaaagatgggaactccagagtgcccagggaattgtctactcatcattgcaggcgtttaataacgtgtagccatttctggaatgggaggcaagaggatcgagttaccagtgaaattagtttggtattttcctagcttcctggttcccagatcctcaagaggctgccataatctctgtgaatttgtcctaaaatgacctgtataaataactgctttagacactggcttgtctttggtatgaaggaaaacattttagaatttttttggctggaggtcagtagctttcatccagaaaagaataatcaacggaaaaaaaaaaaaaccaccgagacgaggttatttttgttacagtcaaggaacaaaaagggatatattaaacttgggggaaaaagagaaggaaaactattattctttaaaaccgttataccatgcatcatggtaacatcttttttactgagagttctgcattagcacacttgttcacccaagtttgtgatagtttataggactgcctggtgtattaagtagaaatgctcaactttgctgtcctatttttttgatcatatccaaaaagtgtcagtgtttgaatatagttttattgccacttaaaaaggtaggacagttttattggcgtctactggacatggtaggaagagagctgtaatttgacacagattgtccttaacttgggtgacttaaggcaagtcacttaaccatctgagccttaatttcctcgtttgtaaattcaagagaataataacttctctgtcacatactgttttgtacagatcaagtaaaacaatgtgtgaaatgctgtaatgaagaagtccaatagtgtatgaatataaggttgctggcgtttggggaaaaatcatagttatagaagaaagactcctaaagggaagattagggttggaagaagatggaggaagagagtaatttaattccttaatggaaagaataaaataagagctcttgactttttttttttgttgttgttaggatatggggagaggtttctgcaaatatcttcttcagggtttacgaagtgaaccggatgtccggtaacagggttgcatgtcatgcaattgactgggtggtgatgactaaaattttaatgatgcgatctcatttaaagttgacaggctctgactctagccagatattcaggagcagaaacttgattcaataagaagggaacctgcagaggcagaaacttctgtgggttgcagttgtgttgagattacacaggtggaaatgttgcgagttcttgggtgatgcgatttcttcctgcttgccttaagtttcacctgcccaggtccttacttctgctcacagtgcagcacgaatttagatactgattggggattcagacacaaacgggatgctccttgcttatataacatcaacagaattgctggccacatcttgattatagaaactctttttcctggtgatcacacaaagcaaaagaatgaaaataatcaatctctttcaaatggagagactccgctgtgtcagccaccattggctataaggatgaactctcaaaactttttgtatcttgcaatataatgtcttccaactgcctttgattttactgtgtggctgtgtgatacagcaaggcagctgtggcttctaaattcagcagctaggtttgagaagcttctatcagctgagagatcatcagtacattccaaatggcattaaaaatgctgttacagctttatctattagcaaaggaagtttcaattctaagttcacgtacagttactagattgagtgtttgacaaggtagagagctctgtagtagatccatatggggaacatctcagtcagggtgtggagtcagatttttggcaagggataccatcctttcagcctgaaaagctgacttgggagctgtcagcctgtgtgcacgaggacctttttcctcccagggttagcgtcgccacttgcccagtgtttcttttttatttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctactataatggaccaccacaaactcggtgcttctatgctgcaaacctaagattataggcagtcataacacagtgttaagtatttgtgtatctaaacatagaaatggttcagtaaaaatacagtgttgtaatcttatgggactgccgttgtgtgtgcagtccattgtcatgtgatagtgattaagggaggtggacatttttgtgtttgcttatttccataagctcaagggtaaagcttcccaatcagcctttaggacagaggtaagaactggttggtggcctggagcctggatctggcctccagatgttttttgtatggaccacacaaaaatggtctatagtgggattttttttctttttttttttgtcagactacttgccagcatactaaaatcaggatattttacttaaatgtagatttatgacagttttgaaaaatcagaatgagtattgtagactaaatgtttatgtcttccccaaaaattcctatgttgaaaccctaatcttaaggtcatggtatttggacatggttgtgtccccactgaaatctcatcttgaactatagttcccatgatccccatgtcttgtgggagggacccggtgggagataattgaatcatgctgttctcacgataatgagtgagttctcatgagatctgatggttttataaggggctttcttcccttttgcttggcacttctcttactgctgtcatgtgaagaaggacgtgtttgcttcctctcctgccatgattgtaagtttcctgaggtctccccagccacgtggaactgtgagtcaattaaacctctttcctttataaatttcccagtcttcgatatgtccttatagcagcatgaaaacagactaatacaggggcctctgggaggtgattagatcatgagggtggagccctcataagtaagatttgtgccctgatgagaagaggatagaaaggtagctaactttccttaagctatgtgaatgtgagaacacagtgggaaggcagccatctgtaactagtaggagggccctccccaagaacgtgaccatgctgccaccttgaccttggactttaagcctccagaactgtgttaaagaaatgtctgctatttaagccactcggtccatgatattttgttgctgcagcttcagctgactatggcttatgtctatcaaggaacatagttgcactgaggttgaacagagctgttcctataggctgaccccctgtaggcaggcacaggctattttccatggtcagtttacctgcctgcttcctgtagaggcttgagcttggtttagagtctgcaatgaaaactgtgtgatgatattggactcactggctcatagccactgccacgcccttattcagtcttttgtgcaattaacaaacatttattgactactgagtaccaggtgctaagacttcagtgtagaaacaggcagggtccctgcccttgtggaggatacaaaacacaccaaaatgcagtcagcttcactgaatgacagagatatgatctgagaagtgtgtcaggcagtgtcatcgttgtgcaaccctcataggatgtacttacaaatcctacgtggtataacccattatacacagaggctgtatgggatagcctgttgcttccaggctgcaaacttgtatagcatggtaccgaactgaatactataggcagtcataacacaatggtaagtatttgtgtatctaaacacagaagtggtacagtaaaaatacagtgttgtaatcttatgggaccgccgttgtatctgcactccattgttgaccaatgtgttgttatgcagtgtgtgactgtaccagcagcttgatctttgtgcttctagagaacatttaaattgattcgcttttgtgagacagggtcttgctctgttacccaggcttcagtgcatcagcgtgatcatagctcactgtagcctctccctcctgggccaagtgatcctctcacctcagcctcctgagtagcttggactacaggcatgcaccaccattcctggctaatttcttttgtatttttaatagagatgaggtcttgctatgttgcccatgctggtcttgaactcgtgggctcaagcagtacacttgcctcagcctcccaaagtactgggattacaggtgtgagccaccacatctggcgaaactctgggtagtttctaattatttctgtatttctatttgtatttaaaagtacaggatactaaaatgttttttttttcttttttgagatggagtctcactctgtcgcccaggatggagtgcaatggcccgatcttggctcactgcaacctccacgtcccaggttcaagcgattctcctgcctcagcctcctgagtagctgggattacaggtgtgtgtgccaccacgcccagctattttttttgtatttttagtagagatggggtttcaccatgttggccaggacggtgttgaactcctgacctcgtgatcctcctacgtcggcctcccaaagtgctgggattacaggcgtgagccaccgcgcctggcaaggattttttttttttcatacttgaggaaacatctaacagcaaatatgttcttataagttaaaaagaacttttgctattttgaatgacactctcattaagtcttactactagtctctgatttttcttttttctttttctttttctttttttttttttttgagacagagtctcactctgtcgcccaggctggagtgcagtggtgctatcttggctcactgcaagctccacctcccgggttcacgccattctcctgcctcagcctcccgagtagctgggactacaggtgcccgccaccacgcccggctaatttttttgtattttttagtagagacggggtttcaccgtgttagcaaggatggtcttgatctcctgacctcgtgatctgcccacctcagcctcccaaagtgctgggattacaggcgtgagccaccacgcccggccttgatttttcttaacctttatttccaattatgcatcttctgagtaactataaagaaaagcaaaatctacagtaggtatggagtgagtgcagagtcaccatcagcttgaacaaatgtgtgtatctgtggtcaagtttaattgcttcttctgtaatttatattaatcacgcttccattgcttgccttttgttaatacgtatgcggccatgtgatgattttttaaaaggtcatccagtatcttgatgtccagtccatgcttataacctgagcagtttatgtactcttgagatggtatgtgctaaaaatgagtagctagtctgagtggcagccttacccattttattttgtgggcagatttcttttacagttctggctgggtttcttttagttggcttctttgctttgctcctgttacgacttagccctgtagctctgggctcttcgattctcacgtgctgatggtgtagctgagctctgctaatgctggttattaatctgacaatctataccagggaggttttataattgccataattcttatttgctccattccatttcccagcttctcaaatggggtggcagctgcaaagcacagtatttgaacatgaagtagagaatcgtcacttcagcttatgattttacattctgtcaaggctgcagggaaagcggtcatgtttctggatggtatttggatctacaaattccaagcaaactttttacttcttattatgtaaaatggaagggttagccaaattaagatctcaccatcaaccttgagggagtgacttctacatgccgtgtattactggttataaagctagtcttgtttggattgaagaatttaatcatatttaacttttcaaaggatgctttttaaaaaaccttatccgcgtgttatgtttaaactgagaagtacctgaaagtgaaaattttatttatttttactttttttgaaagatggagtcttgcactgtcacccaggcttgagtgcagtggctcaatctcggctcagtgcaaggtccacctcctgggtaaaggagattctcctgcttcagcttcccaactagctgggacaacaggtgtgtgccaccacgtccagctaatttttgtatttttattagagacggggtttcaccatgttggccaggctggtcttgaactcctaacctcaagtgatctgcccgccttggcctcccaaagtgctgggattacaggctcacgccaccatgcctagctgatttttgtatttttagtagagatggggtttcaccatgttggccaggctggtctggaactcctgacctcaggtgatccacccgcctcggcctcccaaagtagtggaatcacagacatgagccaccatgcctggcctgaaataatttcaaattaacccctgaggaacaaatgctcatgactttcaatgaatagaaaaatcagactgctagaacctccagactgcatgtcatgcgtagaagtagaatcctggggaagctagctcacaaaagcaagggagatacctgcaaggctgagctgagcttgcaagggaagaaaaatattagagagttgtcacatttagaaataagtgattccaaatttacagtcaatggactgtagatgccttccatcttcttaagagattttgtgcctcttgcacaggtattatccctaagatgtgttttcttcaatgtacctagactgtttccttaaagaattgcttttgtatggtacggctctatgtgtctgtgtttctcatgttggttaggagaactaacccttgtgacgaataagaaatggcaaacattgttaatgttgactttactagttgctcaaatattagcattggattttagagtcaacatgctagcaggatggctttattttaaaaccatgtgatagaaagctatctgctattattgatagcatttctggatggctgtcagaagtctttctttagaaatttaaccatatttttaatggtgggcattgcagtcaacaatagtacagactttgcaaagactatttttttttttgggtgcagtgaatacttcgcaatgcctgctgaattttacctattctgtaagtctttttgggaaccgttgagcccctcttctcttagttgcctttagcctttgtttttattatgacaattggtatgaaatttttccttttcattacttcttttattcagagcacacctctggcttatctcttcattctctgtttagtttcatattttactttaatttctgtacatcaatatctgccattatagtatttaagctcttggaaacatcaggcatttgttaacttgttgagaaaataaagcactccactgttgttatgagctgcttatggcaagtgaaaaactcacaatatttggccaaacttgggatcatttaggtgttgtttgcaattaatggcaggagatattttccttgttgttaagagtataacgttggttttagaaagcttgatctatgtttttctccatgttagatgtgaaaagaaccaggagagtgtgaggatattggtaatattgtcatatggtgatcccactgtggatagatacgcaagagagaaaatccagaagaaagcatttcactgaagcctggggacatttctggtgacaaatggtgctgatggcacagtgagaacgggagagggcagaagcaatgcacagatagaaagggtgtcacctgcgcattgaaaaatcccagtgccataacaatgcagtccctgcaatacagacaaacctgactcccaccattcctgtaaatgaagatggggccttgctgagaaatagaggatgcagattccaccctcaggcttcccgtcttgggatgcagagaaaactcacccacgtgcaacaactcaagagtcgttatttacctagcaaagtgttcacatgacagtgtttgaaatgtaccacgtgccttttcatgtttagtttagagcttgacactagagctctactgtggtttaccaagtgtgagggactatttctttctgagaaggaggggaagctttagtttccttgaatgtctaatagagtctgagtttccttttagaagcataaaagacgtacagtaggcagaatctggatttttaactatacagttgctgaagttatcttcaattcaaatcttctaaattcaattttgttaatgttgtttagatattattatagaagccagctttactgacttctgcacatttaatcataggagattcttccattctgtgaacttagatttcttttttctatccatgacatttatctaaatcaggctttcttttctttctactaaatttttcaattaccaataggctatgagaataattagactgacagtattactgaaaaaaaaacaaaacaacaacaacaaacaacaaaaaaaacaccttccactaaaactgactcaaaaagataatagcagggaaaatgacatgtcgatctgtgattccttttttacttgtcagtccttttgggagttgaacatataagcacatgtacctctatgtgacttttgagacgtctagaatagagaattcacctttgtagctggaatttattcagcatgcaaatgtgggtgggtgattgttttatagatgcctggtgttgaatgatgggcagttgtgataactatatataaaattatattaaagtccaagaggtgcttttatgaggcaggctggaaatggcatccgattttcttatggctttttcatgtccattttgatgaatctatttattacttctataatgagtagtacacatggttggttagccaagttattgaactttatcaaccttggctgaaattcacaatgcgtgccaaacttgttgtaacatgtaagaaattacatctgggctaaaaggttcaataatgattactcttataatggaatcttctacaaagcaagggatttcatgatatccctatgcttttaaaaaattattgtgatacagtgaaacaaggaagaacgtgtagctggaaaaatagtatttgcttgtaatatacattcagattcataacaggcttatttgattcccaggacagggtgagcaaaggatgctgtttcctgggtgtctgctttggtgttcattgagtcatgtctctctctttagaccttactggatctagtcttcatcatggggcctgtgagctctttcaaatctagaggacaaaacctaataaagtgctgtcatatcacatctgtttatgagtttcaaactgaaatgaaatgtgtagccgtgttattcttaaattacagagacttgaggaacgtagagctttttactctcactagagaaatctaagcacaggttggttcgttaacctgtaaagagatgtttgggttttaagaggtctatcaaataacacagtttccctttcccaagttactacctaactgagcagtaagaccacccattaggcaaatggaagaccaaaacatcacctgagtcattcatgaagctgatactggagaatatgtatagctgtgtgagctggtgggctttctaatcctgaccaccacaattagacagggtaatgggtcagtgctaggtcaggccagaccttcgcagagggcagaccccattcatgcagcatgttcaagacagtgcaggagagcagggtgtgtgctctctgtaagaggagaggagaggcagagctgcgtgtgcccggttctcaatcctggaattaccattcacataccattcacaacataagttggatcagctcccttgagcaggaataagtgagtggcagagggggtcagggatgttaacgcaaatggagatcccttcacccagaaagacacatctgaaatggagaagatgcctttttcctcctgcaaccaataagagagtgatgaaaattatgacgccttgggaaataagactgcaacgtaaatgtgtgtccaccccctagttttcttttggattgtgaatcctcaccctccgataactagacgtgctgttttgacgtctatgctttccagcttgccaattctggggcctggcacagtatctttcaccccggagtctcagtttcctcatctgtaaaatgggaaccatgacgtcagcatcacagagttgtgagaattcgacaaggtggaatgaaagcaactagtgtggtgtctgaccgcttgtgttagtccatgaggaatttccttacgtattgttttgtgtctaggaccaagttcttattttcttcttatggatgacttcatatatatgccgccacagagggaattaccgtttttctttgtaggtaaaaaggagctgggttaagatgcaccgtcatatgaaacagggaaaaagggtttgcttgggttttagattcctgaaacagtctgctgagggattctaaagttgttgtggtctctgttccactttgggagtttgataaaaattggcctgttttatttgacagctcttaggtagtgtgcaaaattgtcaacagataataaaagttttttgcaaagctatggctctatgtgctgtacttgagcagtatccatactcttaatagaattgatatatgaaagcaggtctttttccttatccgtttagacctaaatcttatccatagtgtgtggatatcacaaacagcacaagaggaagtgaaaggaacagagtgggtgagcaaaccattgttcaaaggaaacagaacctcgctcaaggaaaatgagaattcttctgatcagcttctataatggatgcaatgaggaaagttgtctagcagactgttcttggccaactgtctaaatggctcgctgcatcctcttcacgagagctgatggtaggactgtagaagagtcacaaaacatcacatgacaacgccagtccctctgataatcctgcaagagccagcccagttttgctgacagcacagtctgctgtttaattattgtgtgttcaatgacttacctctttttagtttaattaaaattatttctcagattaagagccatgctatgatgcttgccaacggatatttaaaacatgtaactgatttgttttttataatgcttcaggagaactcagttgagcagtaaagatgtgctcgtgatgtggttagctcagaataaggatgtgaaaaccaaaagggaaaggaggacaggagtgaatctggcacttatctttcagtggggcctgagtgcaaattcttcctaccttccatatgagagaatagggaaaattaaagaataaatgtctctgggtttaatgcaactttactaaggaatgaaagtccgataagaatccatatcttttgaaagaagattttttaaattccttatttttcctttctgcatggtcataaaacacactggggacagcccaccctgagaagtcaccaggcatctgcctgccttcagtagcaatcacccaactgctgtagaccgtaatcaagctttcaagaaccacgtgcagcacgctgcgggagagtcccagcgaagtgcttaatgcgccactccacggatgtgagtggggagcaagtgctcaaaatggggcttctgaattgcaatcatcatttggcatctctattacctacagctgctcaaagatgttccccccatgcaactgtttcttgcaactcctaacatttgcaacgaggcctctgatgcagacaacccgtttatacctctgggtggttgaaaccttcatggtttgttgtaaagaaaggtacacagtcccaccaatcagaccgtatctagaatattacgttcatttaggggtggcgcatagacaggctaaaggatggcaaagtcattgggtcatgtcctaggagcaacccttaaaggaagagtgaatggctggttagttggtagaagaaaagatttatgtaaattagttctctcagtagctatctaggagagagataatcctagctttcttcaagggacagaaccaggaccaatggacaaaatctgcaaggaggcagcatttaactgattagaattgtcgggggtggggttggcgagagggtgttgcttttctaatgattcacattgtataaaaagcagacagtaggtctggcactgttggctcatgcctgtaatcccagtactttgggaggccaaggcaggtgaatcatgaggtcaagggttcaagaccagcctggccaacatggtgaaaccccttctctactaaaaatacaaaaaattagttgggcgtactggcaggcgcctataatcccagctactcgggaggctgaggcaggagaattgcttgaacccaggaggcggaggttgcagcgagctgagattgcgccactgcactccagcccaggcgatagagtgagactctgtctctaaatacataaataaataaaagtagagagtaagttttctgtattgaaaatgttttaagagttctttgtcttaccttaggttcctccaaaaacagaaccagagaaaaagacatatttatgcataatttgggatgtgattacaaagagagggatggggaattcaggaaggaaggagaggcaatataaaaatgtgttttttagttagtcattactagaggcaactagtgctcaactccaggcactttaggaaatgcatctcatagctgtctgcctgcggaataaagggcatttatccaccggcttctgaccccgttggacaagggcgtcccataagttttgatgtcccagaattttgggtttgcacatgtgcaagtgccaagcaggttcttgtaggcatcccatgctgcagagtcagagaatctctaggatggaaatggggggatccatattgtagccccaggtgaggccatctggttgcatttgtgtcaagttggttgaaaactgcatggtgagcgtaaaaatggtttgagtaaaatggagctgtgagaatttgaaggggtgcatgagaggtgcccgatacagtccaccccctgcaccatgctcaggtctcttaagagtaagcagaatctaccacagtgtatccttaaagttaaaaggctctctgatgggactataaatgagtcccagtttgatgaattctggggctttagccttttctgctgtggtattagttttctggggctgctgtagcaaagtaccataaactgggtggcttgggacaacagaaatttattgtttccaagttctagaggctagaagtctgaaatcaaggtgttggtagggccatactccctttaaaatgtgtagggaaggacccttccttgcctctttcagcttctggtagccctagatgttcattggcctgtggcagggtaattccagtctctgcctccatctgcacaagccattctccctgtatcttttcacatcatcttccctctattactgtttgtctctgttttctgatctcctcttcttctaagggtgacagttttactgggtgagagcccaccttaatgccctcagtttaactcgatgacctctgcaaaggccctgtttccaagtaaggtgacattctgaggtactgggcttaggacttcaacatatctttttggggggacacaattagaccaatagcaactgtgctataaaagagatgttgctttttatcattgatgctatccagatgcatagcaatcattcaacaagtcattcgaaagaaataggtatttcctgagggtctagtatgtaactcagctctgctctaggacctggtgattacagcagtgaacaaagtgctcctgcctacgtgcagcttactttcttatggagcatgattttcagaagtaattgttcttttgcctcgttatcatcagacattaggaaccaaggggggattgcctgcttttggatcacagagcaagctgccttgagcaagtgagttcgaattgcaaaggtgtttaagcatagcttggtggctgcttagtgaggatgttgcagaggcaatttaaatgccgagcagggctttgggtttgtgatggttaaagtccatttccactgcggagatggtatgattgtacaaatggacaggttctgggcctctgtctgttttgtcaagtatacaacacttctgtttatctttaaagggaacaaatagtgttttcacaggtctctgcttaaataaaaagattctagaccactggatgtcaaccccaccatcccccttctttttttttttttttttttgcatcctgtactcctttgagaatatagtggaacctctggcccattctacaagggaaaaataaatgtattcctagccaggcatttgtgtacaattttgtaggggaggaaaggattgttcatagacactgaattaagaaatccctacactttatgggaattgtaatcattagtagcagttacgtagacatacttccattaaatacacatacttgctttagagagtgtgtttattcataaaaattcattgaataggattaggaataaaaatatgcatagaaatatttgttactttttcattgtaatggttttttttggatagaaatttatcagtgtgtaattaataaagtagtattgatttcagaattatacggtgctaaacaatggaaatttcctaaataactggcaggtaatggaaaaaaaattcagttactgacagcctgtcatagttgaatctaagagctaggggcaaaatacatatattctatgtagtttccatttctagaccctggatttctaaattcttccttataaaattttaaatttctttttttttttttttaaagatggtgctccctaactgatttccttcattttattatctcataacagatttgattttcacaatgaaggtaattattaaaatgcttcctttggtagtcaataaatataattagtttaagaaaactagaaatatttgttattagaattaggtgaacatctaagagtcttatttatggaagcaacatggtcaatatttatggaattgagttgaggctttgcaacactttcaacagctttttaaaaagcaaaatagttactgcctctgtggaaatagaaattacccacctattatgtaatgaaaaactaatgttggtttacttaaaacaaaactgtgtagcagtgtgttatagccacaggaactcctcagccaaatgttaagttaatgcaatgaaaacatttgtaaaaacattatcaagctgcaaaagaactagaaatgctagatactccctagtagctgggtgttcaaaaacacttgtcattctcacagttatatttgtggtatcttagtggtcattcaccttggatgtgattcctcaagtatgccagaaaagcatcgtcttgtgcaagtgttgtatttaggaagaactttgtgtgaaatcatgattgtgggtgaataactttaaataaataaatcgttttccttgatatacaatattgtgctactttccacagaaagatggaatcaatgctcttgactgtaatggaggtttacagtttttctaatttcttatttaggctgatctgagcaaagatgttcaaatttccacttatttaaacaagatagagtttttgctatgttgaaggaatatttttagcttagtaatttacttagaaactgccttattcaatattcgatgttaaatttgaactaaaacacatagcatcatatgacatggagtcttacattcacattttgttggactggaaacagaatcaacatattagtcatcttaattcatttaagttggctttctccagaattctagaatccaaaaacaacacatttgtcagttttacacacaaaaggagaggcaggatgtagtttatagttaaacatccagctttgcaatgaaaagccaatgtagctatagcacactgaatgaaattctgggtgaaacaaactgtgtaataagattttgatgcatattgaatacttagaaaatttgttttatatttgttttaatgagattctctttatatctgctttcatagaaacttgtaaattgtctaaaattaaattttctgtggttgtcatccacatgggttctgaacttgctgttataattattcacattttcttgcagtgaaaatctacagatcaaggtcatcttcacgtctttagttcttgttttgcttcaggtcagtttagaaccgaatgttaaaaggatattgtctattcgaagggtcagattgtggcacgtggaccaaatccagccccccgaggcccacttttgtaaatcaggttttattggaacacgggtgctcatcgtttacatatcgcccatggctgctttcacatcataacagcagaattgagtagctgtgagaccctatggccagcaaagcccaagatatttactgcatttatttactgtatttatgtttattctcttgccctttacagaaaaagtttggcaacccctggtttattctgttaacatgtttcctatataaggattcctctaataagttttcagaattattaagaaaacaaagctcattcctctaaaagaattggtatgtttttttttttttttttttggtggtggttgtttaatgaggaggacattataaagtattatatttcgtttccttaccttggttgccaggaagctcagaactttaaacattaaaatgtttaagtaaccagctcacttcacgtttcggatcagctttctttttcttaacacggggatacattttcactttaaaaaaaaatcaactttttgaagcataatttacatgttgtaaaacccatacatttaaatcatacacatgaaggtcttgacaagtgtgtacacacacataaaccaccaccccagtcaagataatagaatattcacatctgtaagaaattttccacctgccccttggctcaggcaatttgtcagtcttactactgattattgcgttattttaaaaccctgggttgtatgcaattgtctattacaagctgttttaaatagttttcggtagtggctggggcactaatgattaatagttgaatagcacagctggagaagttaagattcatttattctatttagtcttcagtacaaatttttaggtttccatgggagaatctgagatacagctcacatggagagccttttagctaatgtagcaataattaataagctggatagcctgatagcctgatgttttattagggtggtgcaaacgtggtttttgccattactatatatatatatatatacacatatatatatatacacacatatatatatatatatatacacacacacacacatatatatatatatatatatatatttttttttttttttggagatggagttttactctgtcgcccaggctggagtacagtggcgcgatctgagctcactgcaacctctgcctcccaggttcaagcaattctcctgcctcagcctcccaatagctgggattacaggtgcacgctaccatgcccggctgatttttgtatttttagtagaggtggggttttgctgtattggccaggccagtctcaaactcctgacctcaagaaatccgcccaccttggcctaccaaagtgctgggattacaggcgtgagccaccgtgcctggcctgccgttacttttaatggcaaagataattcttttaataattaaaatttgaaataattcttttaataagaatttgctgcttgccaagagctctgcagttattttattcaattttcctaacagctcttaagagtacatcttattattcccctttcacagatgaggaaattgaggttcacagaagttaagtctattagtttgctagagctgctgtaacaaagcaccacaaattgggtagcttaaacaacaaaatttattgtctcatagttctgtaggccagaaggttgaagtcaaggtgttggcagggttggttccttctgaggactgggaggagatacctgttacaggcctctctccttggcttgtagatgagtgtattagggttctctagaggggcagaataggataggtgcattaatatttatgaaggggagtttattaaggagtattgactcccacaatcacaagctgagggacaaggaagccagtttgagtcctcaaacctcaaaaatagagaagccgatagtgtagccttcaggctgtggtcaaaggccccaagagcccctggcaaaccactggtgtaagtccaagagtccaaaagctgaagaacttggagtccgatgttccagggcaggaaggatccagcatgggagaaagataaaggccggaagactcagcaagtgtgttgttccatcttctcctgcctgcttttctcttggctcgctggcagctgattagatggtaccaacccaaattgagggtgggtctgtctctcttcatccgctgacttaaatgttaacctcctttggaaacacccgcacagacacacccaggaacagcaccttgcatccttcaatccaatcacattgacactcaatattaaccatctcagtaggcttcttcgtgttcacatagtctcctcaccgtgtgctgtgtccagatttccccttttcataaggacaccagtcctattggattagggctcccccattatgacctcatttatccttaattatgaccataaaggccccatctccagatgcagtcatgttgggggttagggcttcagtgtatgagtttgggatggcaggggagcagttcagctcgtgagaatcgtaagattcctgatctgtttctcttccaagaaattgtttggtttcatgttgattttatctccttttccctatctgtctcaaagcactgaagaaaatcaagtcccccttgccctgataaggactttaaaatggtgtttgctaaaatggtgtgtgcttaggggcagctttgagccagataacaattctagttgcgcatgcttccataagctgtttactctaggaaggagaatctctgttgggatcttttggggagtacttgcctcccaagtgcttaggctcccgctgctgacaagaccctctgcctggcaagccgtgcaggttggaatcctctgttagggttccaaagccttcaccaactcagagctctttctctctctgtttctcttttttgaatttaaattgatcctagtcacaatgttcacattacctatgttggggatcctaccaagaccctctttttggcccagaagcagcagcggggtgaggggaatgaaacaaaaatttatagctgtcgagtctccagaagtcatgtaaaatcagcctcagctggaagctcctccgtgcatccctcacattcacacaagcaggtgcctgatcacagctgatggttagattacacgtttcctgagaggtatagatttcaaaattggtgtatttcacccgtccctcatcatggtatccccaaacaaaatgttatcaaatgaagaactccttcccagctctcccttctgagtgtctgattttattcaagctcagatggcttctcagatagcgtaaaaagtgatggagaatttcttttaccaattgtatgccctgtgggaacctgggtgctgtaatcactgaatatgttataaccaaaaaggtcaaactcgcaatgattcggtgtgttttgttccgtgcatcctggcatgtgaaagaagtgaggtaaagagtataatttacttccttgttttaaagctagcattgcccgtgccttccacgcgggactgttgtggatatttgaccactgcaagaaaactcacagaagcagaaacttagggcttgctttaaatgttatcagtgtgaattgagatggtgtcagcattatttttttaaagaccaaaacaacaatagtaacaaacacacacaagccactgttagattttacaaaactttaaaaagtaattatcttaaagatatctaagatagtgatctggttacatagattatcagagatacttttttttttgattatcagagatacttttaaaaaagcaactacaaggtaaggattatcctttaatttagtgtttttctattaaactcaatttgctttaaagttttttacattttgcctcttttttgtatgtttgagtaccacttcctaaccaatcacaataaatgtccggtttggagttggaggagtcattgattttaggcaaggtgatggtgagcccacagagcacagagttaatggaactctggccgttgatgtagcttcgaagcctgaatttaagtcatatttttgaaaagttgcgtcttaaaaagttactagcgatggagaatgaaaagtcaatttggacactttaaaagtgagcctcaaaaaactgctgaattttcccaacattgtgttttgagcacttccacgtgactttggtagcataaagactttagtcttttcaagaggcaaagtaatataccacttttcgcttttttaatggtgagagccaaggtcaatctgaatttttctttttctttcttcctttttttttttttttttttttaaaaaaaaaaaaggtgcttgaattagaaaggtagcacattgtccacatggacagtgcaggatggggctggctttttcatttctgagagctggcaatggaatgaaggtctttttttttttttcttaatttttcttttttaaacaattccctcctaagcatttcttaattgacaggggtggaaactatgttgccaagagggatcacagcccttttggtcattaagaaagtcaaggaacggggtctctttggatgagtgtgtgcgtgtagaatcctggtggctggcctgcttgctctaaatcataaagaaccctgtctcgagcagacgagaaagagtaacggaggcctcaatggtgaaaggaaatcctgtaccagctgtgaaaacaatgagacacgttcagtaatagaatatagtgtgcttacaaattcagagttgggttcccttcttctcttgaagtggctataaattaattcatcaaaataaaaaaggccaaacttcaggataaatctttctacttctaaacaaccagaaacactttggttgtcttagtagataggagtgtgagtacagaattatacgaagtgagaccatgggtgtgtgtgtgcacgtgtgtgcgcatgcctgtgtgtgtcattggttagttaacaaaaggattgccctctgaagaacatgaacttgggccagacagcacgtgtagggggtggaattatggagcaattgttactttcttgtattaagaagaaagggagcaaaagagctgtgtcttcttgagaacctttaaaagacacagaggtctctgcctctaaaaagctccattacatttttttttttaacaggaggcctaaattttttatgttttattttgtgctgttttatttttcttcctaaggttctcagacaagtttataaaagtgccatgttggctgggcagagtggctcacgcctgtaatcccagcactttgggagaccagggtgggtagatcacgaggtcaggagatcgagaccatcctggctaacacggtgaaaccccgtctctactaaaaataacacaaaattagctgggcatggtggcgggcgcctgtagtcccagctactcgggaggctgaggcaggagaatggcgtgaacctgggaggcggagcttgcagtgagccgagattgcgccactgcactccagcctgggcgacagagcaagactccgtctcaaaaaaaaaaaaaaaaaaaaaaaaaaaagtgccatgtatattttgattacaaaaaatttcatgcggtgttactttctttttattggtagagggtctttatgttttatttttttgagacagaatctgctccatcactcaggctggagggcagtggcaggatcgtagctcactgtaacctcgaattcctaagctcaagtgatcctcctgccttggcctcctaaagtgctgggattatactttgagccactgtgcctggctggcctttgtgttggacgttaatacagttggttctttaaagtttgacagtgaagacttttggaaattaaagaaaaaaaattgagtataacttgtaacggtcatggtgtaaagatcattttttactggttggaagtatagaagtggggttaaattaagtctataattgtaaactattgatgttggaagaacatagagagaaacttattcctgtggactggtgatcccatctcacagcccttacagataaatgtttgtaaaagcaaaggacagtgttaattctgagccccaagatgaaatatcaagtaaaagagaagaacatttgccaatgcatcactgtctgggaatggattccatacagcaggtaggtttatgtaatacagtagctgaagagacctcaattctgtgccttgatgggattacaccgaagggagcactggtaggctgttgatgaaacaggtggtatttggaccacttctccctctttccggacagctgcttagtaggtttagcttaaattatacacatgccaagcatgtacacatatgagaagcctatatctcgtaatatccacagagaatagatggcaaatcccatgatttgtatttgactgacagtcaagaccctgtggggtgtgagcctggtgggggcattccaggctggtttctcctgcctccaggagctgcttctagtgtgtgctcttaaccctaaaggaaggaaacactgtgtcttcctcttctctcatacagagcccttcccatgacaaatgtgtggagtgttccctccttttacgtaattctccaattttctggaccccagcttggtgtcctacaattcagttttgacactaacgacccagagtcagcacagaccccatggttgagggctcagtcctacaggatcatcccctacttcaaatgccagtagcaagttcaagattgtcaagtgcacttctgactcactggctacaaattggggttcccacgaccatctcctcaggcttgataatttgctataatggctcataaaactcagggaaatatttacttatgtttacctgtttatgataaaggatattacaaagagtacagatgaagcggtacatagggccaggcatgcggaggggatgtggagcttccataccccctcccggcatgcccctctccaggcaccacatgctcagcaatctggaagctctccaaaccctatcgtttaggtttttgttgttgttgttttgagatagggtctcgctctgttgcccaggctgcagtgcagtggtgcaattatgcaatcatggctcattacagccaggacctcccaggctaaagccatcctcctgcctcagcttcctgagtagctgggactacagttgcacaccaccatgcctggctaagtttttttgttttgtttattagagacgaggtctcaatatgtcacccaggctggtcttgaactcctcagctcaagcaatcctcctgcctcggcctcccaaagtgctgagattacaggtgtgagccactgtgcctctccatttaggattcttagagaggttttgttaccctaggcatgattacttaaatcattggccattggtgattaagtcaatctccagcccctcctcttcccccaaggcggggaatgtgggggttatcaattattcacaactctctaattgtgaataataaaagactctcccctcacccacattgctcagaaaatttcaaaggtttttgtttttttagacagggtctcgctctgtcacccacccaggctggagtgtagtggtgcagtcatagctcactgcagcctccaacttctgggctcaagtgatcctcccacctcagcctcttgagtaactgggactgcaggtgcatggcactgtgctccacaattttttttttttttttagagatgggatctcactgtgttgtccaggctggtctcaaacccttgggtttaagtgatcctcttgcctcagcttcccaatgtgctaggattacaggcatgagaccccatgcctggccaatttcaaggattttaggagctctgtgccaggaacctggatgaagacccagtatgtatttcttattatatcacaatatcacaaatccacagtcacatggtgattgtggtagtgtggggggcctgatggtggggtacacctgcttgaagtcaggctaccatgcccattggggtcctcccccttttttgccctctgatcttgtgagttccttaacattggggatcagtggtttttctcttacatgaaatgacaatgacactttatagggtttctgtagagaataccttagaattagttaatgtgtttcataaagcacatggcgtggtacccagccaagagtaacactctgaagtgctcctccttacctggacattacagcatcctttgtataaatcaggatgctcaggaaataccttgtttggaataggaataggctcctccctttttttctcacttgccttgattgctctgtattaaaattcataaaggcccatgaattatcaattagatagcatttggtttgttatttttagtttcttcctatagcaggcatgtatgcatgtgttaaaaatggaagtagcgtcgacattatgaaatgcacaagaagttttcctgcccccaaccggtaactctctcctgcagtaatcaatgttggcacctgtttaaccacttttgtgtcttacgtgcacgctgttcggtactttgactttttttcttaatattataacatggaggccaggcgcggtggctcacgcctgtaatcccagcactttgggaggccgaggcgggcagatcacgaggtcaggagatggagaccgtcctggctaacacggtgaaaccccgtctctactaaaaatacaaaaaattagccgggtgtggtggcgggcgcctgtagtcccagctactcgggaggctgaggcaggagagtggcgtgaacccgggaggcggagcttgaagtgagccgagatcgcgccactgcactccagcctgggcgacagagcgagactccgtctcaagagaaaaaaaaaaaaaattataacatggaaatgtttccttgcatctccgtatcatttctcctcattctttttaggtgtaacacagtattttgtcctattcatgcaatataatttatataacctaattgataaaacattttggttgattgcagtctgtcgtagataatgccgtactgaatattcctcccacatatttgcaagtctatttgtaggataaatttctggttgtggctgggtcaaagagcatgtccacttcaaatttgatagctatgtcccaactgcccccaaatatgttaagccatttcctatcccccatccctcattaatctatgaagttgcctggttgccccacatctttaccgacaggactgccgctcaatgtagttacccttgtagaatctgtctgcatgtgcctgtctaggaccatgttaattgtaatctttgggcatttttctcactcattcctaaccaggactgtcactggcaggttaaatgagaacttattcacccagcacagtggcagcactagtagccagcctggggtcagtcttgcctctcgagagatctcatgcagtcaactgggatttattgtacagctttacaaaacattacggcctcagccttgtactgcccaaagcatgcagatgccgcctggtgtattttaaagatattccacatgaactgacccgtttcccacttcttgagttggtatgttttttgattaatatatttgagatgtatttatgttattagggctatttaggaagctctgtagggatttgttgcttgctgtatataacacatacttttaaaaagcagggctggctatgacttatttttctctagagagacctgtgtagttttgtaagttcttaagatttggcagctgtggatcgtgtttagtaagcacgatctctaactctttggaactcagaactatgtaattgaaatggcctgggaggcaaatgtgatcattcaggtaatcaaagtaactacagaaacagaggtatggattagctagtcattgcagatgtggcattgagcatataggcgtggtgtacttcttagaacttcatctggaaatgcctgtgggggagttggatttcaagatcatcgtcaatgtcatgtcactgtaatttcatttacattaatcagattagtttggaaagtatggtcttcctacttttaggaggatataggagaaactcatccttaaagatagtagtctgttaatacaaaaacagtccccacatttgcattgtccccaaatctaacccaagctgaaagacattaggcctatcttcttgctttatgcataatggcagatctccagggagggagaggatgtgtgctggaagattctacaacttgttgattggttcctaaagatcgttttagtgctatgtttgtggggcggggctggagggggctggaaatcaccatctctgtggccttttaattgtgcccagttacaagtaacatttgtccccagtgtttcacaattataaattaataataaccacccattagaaattacgggtattgtaagccccaactcctttgggcgtcttaataaaaatgataattaaaaccataatttacagtaaatggggacactgcccaagtacatccacaatatggagaaaattaaaaaacttaaaccagaaggaaccttcctggcatcggggaaagaagctgcctttttcttagctcctacctctgtgggagctttgtcagtatttgaggggacagggttcccaccttcatgttttttgtgcctgaggattctgtgggcgactgtccccacctgtccaacctaccagtgagtctcatggtgtgcggctgcctgctccgatgctctccaccaccatgcccaagccatttctccctttgtgttccctgtctgggtaaacaacttgccaagctcaccagtggcccacagggcaccttggacacctagacttaggcagtccctggctttgtagattttttttgcttcctacatgattttctaatttataccttgagctgctcgggataagagggcacctcgtccatttctggctggtcacaaggccacagtatcttgagcgagtccattgtgaccactggaggtactgtaaatggataaaataataatatgaataataactcatagtgtttactccctgcctaaatccacaggctcccgctgcctacagaggagtcccacagttttcgcttgcttcatggagcttcatctctgttgtattcatgtgatttatttacacagagttgctccccaatccttgatctttttttttttttttttttttttttgccaagcaccctgcctttttgcttgtctgtttcgtctttatctctccttccagtaaagttcttggcccagaggttctgctgccactcagtgacatttgtgaaatgcaagggagcttgcaccatgggttcaagctcctgcagatccctgagcctgctacccttgtgcttctctgtccacgcaaagccaagtgctactgcggggttttccaaggcatagctagcatcctaatagtctcacacttgacatagtagggtttgacatggtttaaataaaatctcaaccagatcagtgggagatgttctttgagattcggtgattgagttgtgaacgtatggactgagggtgttttgtggtaaggcttgagtcatgtctgtagcaaggatgtttcctgaataatgtgcactgagcatcaagtgcctgcagtggcctggcgggtaatgccagcagcacgggtgatgatcatggtcaacatgaccaactagaaagcccaaaccccacctctagctgacagtggcttctcagctaacctgtcaccacgtgggattgggcccccagtggtgtaagctttttcagagaagctacacatctagcttttggacctgtgatctccccaatgttttaatgctggcaactaattcaaattaggaaggaaggaaggaagagaggttggaagggagagagagaaagaaggagcaaaggagaaaagaaaggagagaaggaggaagggagggaggaaggaaggaaagaaaaggaaggaagggaaagggaaggaaggaagggaagggaagaaagtatgggccacacaaaacaggtctgtgggcttgacttgtcctctgatcatcagtttgtgacctctgttctaaagagtgaaaactatgtaagatagtataagataagtaggtatttaaattactttgcaccttttccatttcatagaacttgaatgtttgtgttcaaagcttaaaacccaagacagtgagctattaagcctccatggccacgtcatttttctgattgcatctgatgtaacaagtgctagaaaaactgatgctgttcattgctttaaaacgtctttctttattttcttggtattattaggtttacatattcttccgaacacactcttgccatctccatgcagttaagctagttcaatttaaacattgtcataaagttaattttttataagatgaatcaggttattaaatttagtaaaccattgccttcattattttgcacaaactttggcactgtgcagaataggcttagcactactacatttagctaattaaactggccgtcagctgcagtattacaagagtgagggatgttattctcttgggttttatccaggactttaacagtaggtagcattattaagctttttttatataaaactccacactctagagatatggtttactataaaagtgttattgtccttcctgttaaactatcatcttttgaaatagccacgctttgtttctgttccaaaggcaattgtaaagggtaagaaaatggagttgtctattgcagcttttaaaagtagactagcaacgggtaatgcattgcttagataaaggaagatgtaagaaccagagtgtaatttcacaagacacagagacagatggcttacccgtaactacagtcaggaattctctaaaggagagagggtggaagcttgagcctgtagcctgttgctgctgtcttgtcagatgtgccctttctggtaataaaaagtcctttgccgtgggttattttgtcaagtgagatagcaggacttaacaggtttgtttgggaaaataaaatttgatagaaaaacggcgtgcttttcccccacagatttcttggtagcatcattcaaaactacagtgagcagtatctttgcaggattttaatatttattcattattataaaggaaggaagagggccatcgtgttgcagtttgaaacagcctggattgttttaaaatagtccagagctgcagcctattagcagtctgcaagaaccatttgtttcttcagcagatatttattgaatcctactgggtgctagtctggcgaaatacggagattggagggtgtaaggctcaaggagcttacctgagaaactggataaataaagctctgtactgggtgtggtggctcacgcctgtaatcccagcactttgggaggtcgaggtgggtgggtcatttgaggttaggagttcgagagcagcctggccaacatggtgaaatcccgtctctactaaaaatacaaaaattagctgggtgtggtggcacgcgcctgtaatcccagttgctggggagactgagacacgagaatcgcttgaatccctgcggtggaggttctagtgagcagaggttgcagattgcaccgctgcactccagcccgggtgacagagtgagactctgtctcagtcagtcaatcagtcaatcaatcaagttctggaacctgcctggccttgtgttatatcgatgctttctcaatctgttaaaaacgtagctgctattgaatgactaagaattgtttactctcatttccactctcttacatcttttttttttcttttaataccctgtgatgaaactgtgaagaaagatattcctgatcattgctttgacctggaaatttcaaagggacccacagtccaccattccgtccaagatcttctgggtgtgtgaagtcccgggctcccaaatgcagttgtgtttggtcactgtgttgcttgcatatggctgttggcatctcattagcctgattgatggggcagatcagtcagcaagactttgttcggtgcctgcccccagccagctgggctacaaaacctggcattttacttctctcattttccccaaatgatctaggtgtcttttgctcactggtgataaggggtgacattggtatcacaggtaaaaatgagtaaatttgagattattgtcgtcttgctttaaaggttggagatacagcttcaaaaaccttttactacccacacacccaaggggagtcaaatggatttaggtgttaaatacttcaggtttgaaatcctttgtgcattatttcagcatctgatttaagtatcagaggtcatctttaggtaataagtaagtattttggaatatgggatttggcaaaatctcaagaaataatttcaggttgtctcagcaatgaggttaaattgtgctccagagtccatattcagacaaacggaatggtggagcccgaggttgatttctttgaattctggttggtattaaagtcattcagccctcgggttaccattggtagcacatctaggagcaagttttaattttttagtcatagtgactgtgctggatttggtaggtcgtacgaattgggtaagaggcataggacaccaaggattttgcaaaaagcaggcaactaacatttgttttccacctactatgattatgttaggctctcaatatatgtttaccacttattccccattttacagaaacgataactgagtttcacatgggttcaaggcgtgaccttagatcccacagcttgtacgtgcttagaactggcagcaacacaagtgtgtccaacttgagttttcctctgtgctatgctgattttccttgagaagtattctgtataaatagactgttttctatgaagattaggcctgtgggagtgatatgaatgaatgaactttactaggctctttcacatggtgatgtcaggaagataacggtatgctgattttgcgtgcatattaacattatcttgtaaacaataatttatggccatttgacatgggtttggctgaattgcatagctgccttctctagtagaattgactactttgttattgtactgtactctatagggtcttccaccacagattacaaaatatggtattttttagtttagagcaatgggttggtgttcaagctctggattagactgcctcttctttttcctccctccctcccctcccctcctctcctttccccttttttgagatgactttaaaatatagattcatattttttaaatatacagaactttttcagttttccatttcttcttgtggcaactttttttgtagtgtttttctaggaatttgtcttttttacctgtattgtaaattcattggtataaagttgttcaccatatcttaagatcttctttgggttcataggatctgtagtccttttctttatttttcatttttaaaaacaactttattgaggtatgattgatgtacaaaaagccttacgtatttgatgtatagaacttgataagtttggagataagtatatacctgtgaaaccattatattttataagtacatgatacaatatgagcacagtactatatggtagatctctagggcttttccatctggcgtacctgaaacttcataccctttggctaatacctccttgtttctctctcccctcagccctttgcctacaccattctattttttgcctctatgagtttgagtgtcttagattcctcatataaattgtatcatgtagtatttgtccttctgtgtctggcttatttcacttagcataatgtccttcaggttcatccatgttgttgcaaatagcagaatttccttcattcctaaggctgaataatattccattgtgtgtgtttgtgtgtgtgtgtgtttgtgtgtgtgtcttccacatttcctttatccattcattcatcagtagaaatttaggctgcttccatgtcttggctagtatgaataatgctgcagtgaacatgagagggcagacatattgttgtgatcctgatttgagttcctttggatatgtatccagaagtaggattgctggatcataatccagcaatttttaattcttgtttcgttttttgaggaacctccatactgtttttcataatggttgcaccaatttacattccactaaggaatgtaagtttctcacgcataagggggctcttgtttccacaccctgaaccacacttgttatctttcattttatgatgagaaccaccttaagaggtgtgaggtgacatctcactgtggtttcaatttgcattttcctgagaattagtgacagtgagccccttttcatacacttggctatttgtatgttttctttggagaattgtctatttggttcctttgcttgtttttaaaatctgtggtttttttttttttttttttttttgctattgggttttaggagttccttatatattttggatatgaacactatcagttatgaggtttgcaagtattttttactattttgtagcttgccctttcagtgtcttgattgttttctttaacgtgcagaagctttttagttttacgtaacctcacttgtctagttttgcttttgttgcttatgcttttatgtggcataatgttgtccttttattcatccctgatattggttgttcaagccctctctttctgtctctgtctctctctctgtcattcttgctagccctttatcaattttattagttttttcaattgacagacttttagcttctttttttctctgtattttatgtttgttttagatttataagtttctcctttctccttttatttccatcgttctgctttctttaggcttaatttgctgggttattttcctaatgtaatggatgcttagatcatcttggatgcttagatcatcattttttctttctttctttttttttggagcaagatctcactctgtcacccaggctggagtgaagtggcatgatcatcctcctgagtagctgggaccacaggtgtgcaccaccacgcccaactaattttttgtagagatggaattttgccatgttgcccaggctggtctcgaactcttgggctcaagcgatccacccgcctcggccaccccgattcctgggattacagccatgagccactgtgcctggtcttctttttaatatatgtagttaaggctatagattttcttttaaccatggctttagctatactccttaagtttgtatatgtgtttgtaattaccgagtttaaaatatttctaactttcattgtaattttttgagccataatgtcttatttatttatacatatatttccagaaatgagaattttctgggatcttgttattgatttgtaatttaattccattgcggtcaaagagcatactttctaattttaatcttttgaaattcattgagacttgcttttgcccctgcaaatcatcagttttggtaagtattcttgaagtacttgagtatattttgctgttgctttcagtgtttatcatattcaattattttcagtttatcaattaagttgttcaagtcttctatatactttgtgtttgtctgcttattttatctgttactaagagggatatgttaaaatcttccattataattgtgaatttgtctatttattgtcctaattctgtcaatttttgacatatatgagaggctctattattaagtacatataaatttagaattgtcatgtattcttggtggattgaaatttaccattgtgaaatattcagcactttctcttgtaatgcttcttgctttagagtcttttttttctgaaattagtacagctatatcagatttcttttggcccgtgttatacagtataccttttctattcttttactttttttatgcttatgtttaaataaggtataaaacataatgtacattcttttttaaggacagtatatgtatatttatgttttcttcagtctgacaaactttttcttttaattgccatctttaggccatttatatttaatgtaatgacagatatatttgagtttgggtttaaatataccaccttattattggcttcctgttaagttattctatattcctctttcccttatttctatcctttctttctcttttttcttttcctttttcctttctctctctctctctctttctttctctttcctttctttcttccatttaaattgagacagggccttgctctgtcactctggctggagtgcagtggcataatcatagctgactgtgcccttgaactcttggactcaggcaatccctcgacatcagccttctgagtagctgggactaccggtacctgccaccacacctggctatttcttttttaattttaatttttgtagagacagagttttgctatgttgcccaagctggtcacaagtgatcctcatgctttggccgcccacggtgctagaattacaggccactgtacctagtcatcttctctcctttcttgcctttttatcattctgcttttcttctccattagctttttaaatttgtagagatttacatcttgcatctttgacttattaaaatctaatataaatcagtattatatcacttcctggagaagacaagaaccttaggatactttgcttccattactcacctcctaggttaagcattgttattattattgatatagtaatttttgctatatattttaaaactcacagatttcactcttaccatttggatcttaacatgtcgttaccctttatgttgctctttgttactttctgcatctctgggtttatagctaaggtcattttcctcctgcctgaagagcatcctttagtgtttcctctagtgtgggtctatacgtgacactaggtgtagtgtaggtgacaaacaaaaagcagctttcgtttgcttaaaatttttgttctctgcctttatttttcaaaaatattttcactaggtatagaattctaagatgaaagttttattttttttcagctgtggcttccatcattttcctgagaggtataactatcagtcttgtagctactggtctctaactacttctaaaactatctgcagtttttagcagttttactctgatgtgccttgctttgacatgtatgtgtatatatgtgtatctacacacacatacacacatacagatacacactcacatatatatttctgtttgcggctcacacagacataaatatatatatatatacaaacgtacatttctgcttgtagcttgcacatatatatatacacacacacacatacatgtagacacacacatttatacatatacatgtcaacacatacacatacatatttctgcttatggctcaggatacttctttttttggccgtgtatgcgtcattgattttgtaacattatcagccattctgtctttaaatattgcttttcttagtctatttcacttgttttggaactcagattacatgtatgtgtaagagcctgggagaatgtgtttcatatgtctcttttgtgctttgttttattgtgttatttttttctttttatgcttcactttggatttttttgttaacttattttgtagtttcctcaatcttgtcgtcagctgtgtcttgtattctgttaaactatatgctgaattcttctttactcttattactcttattttgtttaagtttcagaatatctatttgaatttttttattgtttctaattccctggcaaaattctccatcttgcctttttgttccttgaatttgtcagtcagacttattttaatcactgtttctgaataacttgattagacagatctcctgtgcatttatttccatttgttcccctctggcttttggtgaagttttttctttttgtatgcttagctattttgtttgaatgtctgagagtttatatgagtatttgaaataatcatagtggtaatttgagactctagataatggtatcttcctccagagaacattttctcttgcttctggaaattggatagatagggactgatcactttaatcaaactaggaattgaaatggcctgaagctgagtttccactcttgtgaaggctggactgtctcttgttattacagcgagggtataactctttaggatcccgacccaaggtttggtgtgtttaccgtggccctttcctggtgggtcctgagctcaaatttatgtctttttccttgttataaaattgccaaaagctcagcccatcttctcaggcttccaaccactatgtttggaaatgaaatatgccttgaaggaaaaaagctgccaaatgctggccttgcagtttttgcagatcttggcccccaaaattcttagtcatagtgcccttctgatgccttcaaacagatatgggtgtgtatgcacgtgtgttattttgtccatcttttctaattgttctcagtaggaaatggggctaagaaacctaggtaacactggtagaagcagaggtgctggcgacacttaccatagagtagagcataaagtccttatcgtgggcacaggatctggtcattattgatggttaaatggctggacatgccgtgaactcttctatgtcccagtcttcatctttgaaatcactgcatccctaggacaagttttctcaccatcacagtgttgacagtccgggccagatggttctatgttgtcaggggctgccctgttcatggtaagatgttttgtaatgcctggtgtttacccactagatgccagtaggactctaccccacaactgtggccactgaaaatgtctccagacatttgcttctgtcccctggggatcaaaatcacccctggttgagaacttggggtaatttaagtggtgctccggtaaaggccattcaacatgactcactgtgttgatgttatgttttctaacattgactttcctttaaaccatagggttcgaaaccgccaagtcttttgccctccatggtgcacatgtgatcttggcctgcaggaacatggcaagggcgagtgaagcagtgtcacgcattttagaagaatgggtaagtgcttgactgttgttgttttttttaattgtcaaatacacatgccgggctaaccatatggagatttcagtggagtgtgtaaagtttattgctcttggaatcatgtctttatttttaaagtcatcttcactttgtttgtcttatgaatgaaagcatgagcaagtccattattattcacgcatttgtttgtagttcattgtcagtgtcatctgctttattagtcaggggtttgagaatgtttcttcctttaactcatttattaagaaaaataaaacgtggtgaacgcccatgattgcaactaggagactgttatgcttatggttgttaagattagaaagaaggaggctttaaccctatctctaatttcttacttttctctgtctatgtagaagttgatgttgatacgtgtctacataaatatttactaagggcttgccttagtcttgggaccaaggatatagtattaaacgaaacagaatccctgccctcataggcttaccttctaggtaggaaaaatagaccataatcaagtttaatatttgccataatgtcagtaaataaaggactgtaaagcagaggaaggtggggggaatgatagcgtgagtgtgatggagtcatcagcagggagccttccaaagttgtgacatttgatctgagacctgaatgaagtaggggtaagccatgcagatgtcaagagaagtattctcttagcagtgagaagagcatatgctaaggctcagaggtaggcacaagcctggagatttcaaggatcatcagggaagctagtgtggctggagatgaatggagtgggtaggagaggtgctgttgggggatgggtatctggtagactctgagatagcggtgaggaagacattagagggtttgagctagagagtgatgcgagctgtttgatttttgaaacatcgctggatttcagaatgaagtccagactgcattcattcacttttcattcattcacatattcatgaagtgcacctctgtgatgggtgctggggtctactgttaaggacaacagacgttgccactgtctttgtagagctttcagcctattgtggaagacaaatttagtcaaaaaacacagatcttaatgtaaacttgaaaaagcagtgagtggtcctaggaatcagtaatgatgccagggagttgggagacctttggggtccccaaggaagaagtgattgaactaagatctgaagaaagacctgaagagggtggagaagggtcagatggggtaggggaatggcaggtgcagaggccctgggaggagggggaggaggagatagagcagcgtgtttgggagcagagcctgaagggggctgggtacaccctgtggaggccgtcttcatttttgaatgctgtgaaagatttcttgccatttgaagaaatagactacagtgtacttaagaaaatttttggtactctggactgaaaagtagtgaaaataaagaaaaggaagatttatttctgctttttcagtgtatttatgatgaaatatttgaaattcagtatatttgaaatgagcccttatcttgagctcactgagcttattattttgggttaaataaaaaagaaaacagagtcttactttttctgatcattttattgtctttctgactaatgttaaaaagtagtaacctctagtaggtgggatagtagcaatttttagggatgtattgagaagagtacaaatgggaatacgtgcatcttatttgaatctacacgcagaatgggaaggtgaaaaatgaaatgtgaaagtcgttcttggtccttctcttggaagataaacattatgtattcttccagaaaaaggttatctatataccagcaaacacactcacattctgttctgtactttttttttttttaaacttagtactgcaggagatctcttattagtgcatatagatctacttcattgttttaactgctgtataatattccatcatgtgcttatgctataaccagtcttccctttggtggccatttaggttgtttgcattgttttgctatttgttattccaagcaatggtgtttcacagttctctctttcttgcatcagtctttcttacgatatcatctgatattgggcctaaactatgctgctgtgagcattctttatttacgtatttgtgagtaaatgcctggggcagaatcttagcactggactccttgattcaaagggcatatgcatttaaaattttggtaacagttcccgagtcattttcttttttcttttttttctttttcttttttattttttttttgagactgagtttcactctgtcaccaggctggagtgcagtggcacaatctcgactcactgcaactttcacctcctgcgttcaagcaattcttctgcctcagcctcccgagtagccgggactacaggcacgcgtcaccatgcccagctaatttttgtatttttaatacagacggagtttcaccatgttggccgggatagtctcgacctcctgatctcatgatctacacacctaggcctcccaaagtgctgggattacaggcatgagccaccgtgcccgacctcccgagtcatttcttatcttgttgctccaatttccattcccactgacagtgtagacagacaactgctgagggcttgcagtgttcttgggactagcaggagggcgtgtcaaaattgtaaaactctgcctatttgatgtaatatttgaaactagaaaggtaaaattccagggacgctagtgacactatggtaacctgattgtacagtgacattcatgtttaaaccagtcttggaagataatgctgtagcacaactgtttttgcatcattaaatttatcctcttcttttctgagaacacaatatatatgagaacacattcatctgcatttatcctattttaattattgtttgatgcttagagcagaaattcctggacctgccccaattagcgatgagaccttgggtaagcctctggatctatttggagcctgtttcctcatctttaaggaaaaaggttggatggatgatgtcaaagacccactgttcagtctttctttcttatattttgagccttaattgggtccctgtgagtcaatttccgatgatagaatttgctgttttatagttttactctaacatgtagtaccttgagatagaccagtgatcccagactaagaattattcagaatcattcaccgtcggggacacagaaaaaggaaaatggaacagaaacaaaactaatacacgtggctccagatgtttaaaattagatttgataggttgtaggctgaagaaactcaacctgttcatcatctctcatcttttcacttgttctctctgtatgccattatattgtgttcctcattttcccaagatgatgattatggaaactcaaattttgcaccagaagctgtagttaccatttcattccattgcaccattcataccctgcagagaggatgtgaagtcgtaaggccttcttgctctggtgacatctgttaggcttcgtctctatatcatcccccaactccttgacccttgatatttgctggtctacttcccttcaggtccttcctcacctcacatctctgcgcaaggatttcatctggtatgtcactaaatattaccttcctgtgtttctcaaggtcaatttgatagactccaatttttcaagctgctggccagcttgagcgtattcatatgttacctacgatgaatcacatcagtgtcggggccgggaaggtactgcaacatattggcgcctcacgggaggctctcaaaatgatccaaagttttttgttgcagcaaaagctcattcagaagtctttgggccatttggctcagcggaggctgtcatgtgccaaggctccgtgggcattcttagctctgcttctggagataagagttcattcctccatcccaacttgttcttccctgcccattcttcctcttcctgccttcactgcacattccgggatcgccatgttctagaacattcatgtctgccttttagccagcagaatgctattctcacatccacaatgggacagctaacagcccccatttatcaaatccctgtcatatgctgtgtcaggcactttatatccctcatccaggaggatgcaaaaacctggtgtttttcttttttttttttttgcattttccagacgagccaagggatggctcagaagggtgaaggaactcacccgaattgcacagctggtgagctcagagtcaggctccttgcttggtccatctggcttccaaactccaagtctgtctgctccaccccatggcccatctttttaccatgtttagtatcaatgttcatactttgcagattttgctttcaaactctctagctgcggtttgagtgattaatttcaggatccatcctatttcttagaggaagccactctgatctaccctgtcgtctctttatattcaagatatcctttatagagctctcaaattacttttgggaagaaggagctatttaataaaatacaacttaagtgaaaacacattccatatagaagtatattaagaacctatatgtaattactatgactactaattatttcatgggaaaatgccctcctgctgagatgttttagatgctccaaagttagaagagaaaaaatgaaaacaattaaaacaggataacatggacagtacagaagtaaaccactgtcttaaaaggccaatccatttggcataattaaaaaaagagggaggagatggaggcacatcagcccccattcatatttaaataaagaaaacggggcagtggggcttgttcctatgttgtggaacagcacacagatgtgatctacctcattcacatccttatgtgaattatacactggtgccctcacctcttaagacaagcacctatcgttttcctgtgtattccaagaggccagtgtggctggtggaataagatgttttcctgttttcaagatgcagtggactctcttttatttaacagcagtgtctatgtgttaggaatccatgtgagttctctaagtctgggacaacgataggtgtgtctgagtcctgcattaccatggtttattctttcctttacccagtatctattggagttgggcttctgttgctttatttctcggggtctggcatatcccactccctgtcttgagatctcaggacctctgagatctcaggacctctgcatgtaaagaacaagagcttattaggtatcaaaacatacttcatgaacagctacagcaagacctcgacattccagtgtagagctcttgaaagaccccagtggggctctgagttcctccttcttctgtttctattagatttctaaattttagtttctaaattttagatccccggaacttgggatctaaaactctggtcctgtggaagaaggaggtagggtagagtgggagcagatggacctgatgtcatccatctccctacgttgtttgcaggaggaaaagggatgaggctgaggctgggaggcaggggcggtggattgagagagaggagagggattgttatgagtaaccaatgttcctcatgcctgccaggccctcactagatctgtttaacagagagtgcagaagagcttctgttggggactggccattagtatagcgaggggcccaataagtgttgtgaaacatcagcatctgctggacattgagatggccacaggttggtcagagagggctggtatgggaagaggggcaggtggctctcccttagagttactatttgactcacccctgacttcccagaatgtgtcttgagtctattaccctctcatatgggaggggtgacccaagtatgtttgtggcaaccaaaatgtctccaggcattgccagatgtctcttgggggtgcaaatcgtccccagttcataaccacggctataaaacatgctgtattatagtggcaaagattagaatcagatacatcttatgaccttgggcaagtttcttaacttctttaaacctcagtttcttcatctgtaaaatgcacatcataatatctctattcagagatacaggtggttctattaaacacatcaactctgtgtatataaagtcttaacccattgtggaataaattaagtgctcaattaaatgttagctgctgctattaataacaacaataataatattttcttcacgcatgaaagtgcaaagtgatgcttacttttcttaacctctccaactggctgaaagaggagctctagggcagatgtttatcagcctgatttcagtggagttgcaatgaattctttttctgtcttcatatgtctggactcctacattttaatggatgtgtatttagtttgttgattagtattttccagtgtagctcatattagcactcaactgtcatttgaaaagccatcttaactatttatgtgattgctttttcttttgtatttacaaagaaatacactctgcatatattttggaaagatgattaagggattagtcatcaggaacagcaagcaatggtttatatcaaaatgattattgagaaagcagagagatgaggggtaaaaataaaagatttattagccagaggtaatggaatgtgcatgttttagggagagagcgcatgctcagttgattgcaaccacacggtttgctgctgaagtgctgtaatgattcaggttttcaatagagttgatatcgggtctatttattttgtgggagtgaagggatagggatagtactgacagcattatgtgattgcagcctcattgattagcatcggaaataatgactttaacattattttcagatagggagcactcagtaccaaccattatattaggctcatgggctcaacattttgctgtgcttttcatagatactgacacctgtgttttcattttgttgttgttgttgttttccctgccgggaaactgccgcatcctgtgttttcatggcatgatattaaggaacgatgggtaggatgctgaggagtaaattgctcgcacttttaaagacttctgcaaaactccacctacttttaggctccttaaaattcagtgactttatgagctggtatagcttcactgtttgtgggaattccatgcaatctcctttgacactaaaagcttaagtcccatgatttgcctttgtggatggaaggccttggccttcttttatgatatatgtgttggggggaggcatgtggtatgtggggcgggtaaaatacgagcctcatgcctgtctaagctggtgacttggcttggaaaagatgatcattcgtcaacgcatcacaagtcacagggcttatctccattgttctgaacgatctgtagctaaacaaaaagataaaagctattaatattattaatagttgtagattaccgggaagagcgcatcctaaatcagccattagatttgttcctcatttctttgctttacaaattgtttttctgtatagtattggattttcaataaataaaggatgatataaacaagtctgcaaaccagcaagaactatataagccacttgctcaagtcaataagcgcatgctcacaaaggaacgtaaagttctgaagttcttctttggggcgtttgcaaaatgtcctattattgtcacctgcaggtggggggttggatattcctatttgtctttgtactaggtactgtgcttagcatttaacagtaaagtatttatattatgtgtgaaacccattgtgcagatgaggcagtttagaggctggaagaggcatagactttcccaggctcacacagctgggagataacggggtggatccaagatttgcagctggtgtgtgggtgatgccggaagattggcctttttcaaggacttagacaagtattgtactcatacattatttgcatttatttgtatgaatacttctgggttcctaatatgagggtacctaaaaagtacatccgctgcgcttcttgtaatctgagggagttgatgaacatgggccaaggaagctctttccttcgccttccgttccagacttccttttcgagtagtatatcgtgtatttactgttctacttcagttgcctatttgacctttcttgtcacaggctcagggaagattctttatcagataataaattattcatccccctcatagacataatcggttgctaaaatattctgagtttcctgtctccagaatacctaaaacttgtgcttggtacttatcctctaagttttccgtttcatttctcattctgaaaattttgcaccgacttagtcttgaatgttattcattgttctttgatcattgtctttgtgtcttctccttttttttttttttcctggccaccgctcgcagtcttgaaccgaatctttcaaactttatatccatgtaacctttgtataatgagggctgtgattaactgcagagttttaaagagtgaaagtcaagcataggtggctggctctgaaccatcactcccaataatgtgaaacccaaagcagatgcatcctttcattaatgtggggtcccctgagttcttattaagcaattttgacatagtttgaagagacggatttcatgttcagacagtgttcagccgccaatggctgaaaggcctgcttttggccacttggcatttagactccattatttaagaggggaaaaatatgcctgagactgtttttcatatttattgtgggacatttagagaatctcagactagcaggtgttagattaaacagaggagaaacggtccttgtggtgataaaacttccctacgcaaggacaagtagagaaacaactgtagatgaagcagccagtctcaggctggggcagcacgccctgcgataggttaaggtttattttagacaaatatttaaaatgcagctaatttttacatatgcagacgcaacccagtggaatagaggtagccccagctttggagtcatacagatctggggttaaatcccagtgtgaatactaactcactcggtgtccctgggcaaatctggtcatctctctctctcttttctttttttgagatagggtattgctctgtcacccaggctggtgttcagtggcacaatgatggttcactgcaaccttgacctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattacaggcatgggccatcgtgcctggccttagtcatctctttgaaccttggctgatttacctgcagatgctaatatgactctcagattctggcacatagtaaagattcagtaaatggtcgttgcagggaaagctaacttgtccaatgcagatctgtaaaatatactcataaatcttgttggagcaatatttcttctttgtcttacttcgggctaataacaaaaatatcatacaatgagtggcttaaatatttattcttacagttctagaggctggaagtccgagacgagggtgccaaccttgttgagttcttagtgaggtccctctttctggtttttaagtagcctgtttcttgctgtgtcctcatatggtggagagctgagaggaattgagagagagagagagagaggtcgcactgtctcatgtgtcttgtaagggcactaatcccttcatgaggattccactctcatctaatcacctctgaaaggccctgtctccaactaccatcacatgggcaattagggtttcaccataataattttggagggacactgtattagtccattttcatgcttctaataaagacacacccacgactgggaagaaaaagaggtttaactggacttacagttccacatggctggggaggcttcagaatcatggtaggaggcgaaaggcacttcttatatggtgtcagcaagagaaaaatgaggaagaagcaaaagcagaaactgcctgataaacccatcagatctcttgagacttattcactatcatgagaatagcatgggaaagaccggcccccatgattcaattacctccccccgggtccctcccacaacatgtgggaatcctgggagatataattcaagttgagatttcggtggggcgcagccaaaccatatcagacacaaacattcaattcacagcattctaccccagccctccaaaattcatgttcttctgacatgctaaatacatttattacatccaaatatccccaaaatcttaactcattccggcatcagctgtaaagtctatgtctttttaatttttttaaatgatcaaagcactgggaagtagccacttctttcctcagcttcccaccaatgtgtcaattaataatctgactaaggtggccgggtgtggtggctcacacctgtaatcccagcactttgggaggccaaggcgggcggattgcctgagctcaaaagctggcgaccagcctgggcaatacggtgaaaccccgtctctactgaaaatacaaaaattagctgggtgtggcggcatgcgcctttagtcccagctactggggaggctgaggcaggagaattgctttaacctgggaggtggaggttgcagtgagccgagatcaggccactgcactccaatctgggtgacagagcaagactctgtctcaaaaataatagtaataataataataataataataataataataagaatctgactaaggttattaaccattaaggtatgctgtgctaaggagcagggggccccttccatccgtagagggcagaaaggtgcctatcatgtcttcagtgtcagtgccctggtatggagctagctggccttccacaggttctggagttaatgctggagagaagtaggggtgtcagagcctaccctgtgttcctaggggggttcatctggagctagtccctgacccttaggtggaagatgcagctatgcccaaggttctgaagaccctgtaaaaggaagccttagaagtggctgcgattgttttaaagtctgtccacaaattctttgataattctcctttcaagaagtagaggccagttctcctctcttggaatatgggctgtacttagtgactcactctccatgaatagaatttggcagaaatggccgggtatgactcctgaggtaggtcctaaaggcttcgtggcttcttcttgctcactctcttggatcactcaccagccaccatgttgtgaggaaactcaagcagacctgaggtgaggcccatgcaacaaggaattgaggccaccagccatgtatatgatcccccttggaatcctccagcccagtcaagccttcagatgactgaggccctggctgattcatgtcatgagagatcctgagtcagaaccacccagcagctaagccacttctgaatccttgacccacaaaatatggtaagataccaaatggttactgttttaagccactatgctctgggggaatttgtgatgtagcggtagataactatcacaggatccatggcctcaaggggagaaggatccttaagagagactggacagtgagttctaaggataagacatgtatacttacccaggaagctccactgtgtgcaaggaatcctaagttcccggggttgcatccatctcccaggtcaccttgtttgacctctctccaacacttttaaaacatacctgatcaggaatcaccccgctttggcataagttcctctctccccatgctgcccatcccatttctgcacacctcttaattagtaagttctccctcatattgaaggcagaatcttcctctgagcgtcttctatgcaccggccctggtcctgccctccgagttccactggctgcattctcatcagaacccagctaaaactcacgtctctcaaattccctaaataataaatccaaagttattgaagatattgggatactaaaagttggcagtgagactggccccactcatttctttgtaacccctgtccctctttttattattgaagcttgggatgcacttggtaaggctaggcagctggagagcgtgcagactcaggagccaagacctgccttgccttccctggagttaatgaatcagtgtgaatgaagagcacagtcttcttttaaatggcaggggaaccatgcacttatttaccggcaattctcagattctaattgttccgactacaatgcgtcctgtaaaccgggtagctgggagaaacttcaatgcatctttgtaatggctttgttgttgtttattgagagggactaattaactttgattattgcactaatattatggcactttgacagcccttcagatttatgactctgggaaaataaacaaatgaaatgcaggtgctggagcagaaagaataagttattactgaactttaattacttggaatgcgtagccaggagagaattagttgatgaattacaggatgcttaaaatctacatcaaattgcaagcaataagaagataaaaataaaaaggaaggggcaggaagggtgctatttttaaggcagggaaggataggatgcatttgcagtggtctccgtggtgtttcattgattaaactttgtggtctctaatgctgcagatatgtacatggtgctactcaaagcatggtccctgacctgcagcatcagtgtcacttgagagcttgttggaaatgcaaattcttgggccccaccccagacctactaggtaagaatctctggaggtagggcccagccatctgtggtttgcagttactccaggagattttgatatctgcagaagttgagaagcatggctcaacagttctcatgcagcttgctttttcttttataaaagggcgggtacacatttttatctttgcttatgaaaatcaaatgttttcccaacccagtttaccaagtagctcccaaattttcaagctattttaaaaattggctgaaatttaaaaattttgggcaattttaatttatccaacatctattacgtgctaggtggtagagtgggtgacacaagatagtctagaaggattttgctaatgaggtgatacccctaaactgtcatcgatgccagcgcctgggtagtgtggtaagagtgatactcccatgactcatgaaagatggtctccccacgtgctttaaagcaggatggttgcaggagaaagtattggtggactgtgaacagcccccatggcaagggtgcatctggagctggaggaagagcatccacagagtgtaagtagtttgtcctgggaatggagatgtcaggcttgggtgtggtgtcggggagagggcaggcagctcctctatgaggccagatcattcggggccttggattccagtcttaggagaatagactttattctctaggtcctggcagccatcactggctgagtctgagtggtggtgatacagtccatactcagtgactgagatagacagacatttgggctgaattagcgaggggagtgcggggtctggagactctgttggcctgttggccatggtcctgggcgcaaagagcagaaaaggacgagacggggactgaacagacttgcttagttcctgacattcaaggaagaactttaacgtccatccacggagcctcaaaggctaaaaataatcatccctttcaatagttcctgttgtgaggaccattaacaaattataagagaaagcattcctcacttgtagaaactccatgaaaacagacatgtgtttacttatctgcaaccctgtgttaggaggagggtgatgagacactttactgtttgaatcaggaagtgctgacagtgaagggaggagctcttcataattatacccggagagcaggcaagacagccacatgcaagtggcctggcctggctgggtttggtacagaggggattagggcagattcaaacctcactggtcccccgtcccagcacttctgtgctgtctgcagttactaagcacttttcctgtttaagttgttgctgttttcattcccgcaaaagctcagccagcctctagcccaaaattgtctctgtttattggacagttggaaatgtcactgtggccccacagaccttgttgtcaagcaggctgctacgcttttattctagagcgtctttcatctgatttcctccaccatctggaaccttctggattcttcctcttatgggtagtgatgggcactttaggagtaggaatacatgtcagtgctagaccacatcctttcatacccggaattcgcatagtgacatttaaaaatagatagcaggccaggtgcggtggctcacgcctgtaatcccagcactttgggaggccgaggcgggtggatcacttgaggttaggagttcgagaccagcctggcaaacatggtgaaactgtgtctactaaaaatacaaaaattagccagttgtcttggcgcatggctataatcccagctgctcaggaagctgaggcaggagaatcccttgaacctgggaggcagaggttgcagtgagccaaggtggtgccactgcattccagcctgggcgacagagcgagattccgtctcaaaaaaaaaaaaaaagtaatcattttagaattgctttctcttcgggatggtttacctcgtgtttagtctgtaaacgcggataaccgagagctggtcaaatgtttacatggggctgtggaccattttgtatcattggaggagaagccagggcacttggcaggggtgttcatgatgataatcaggtggctgggtggagtcaccatttgtggcatcctcaaagacttgccaacatagacatttttggggagacagaaacacagaaataattctgcagtgctttaaagaatctgttaaaaatcaagtttctttcagtcatgtatgatccattgggctttatataacttttagcctttgctttgcagggacagcaaagatgtgagcaaatttgtgcaaacctaatagggtgaaaaattgaggtatgaattagtaaagtcatttgtccttctggaaagagttatggattaacagattacatttgggtatattgtggttgtgaaaaggtaacattctcagattggaaaggactttctgagatcatccaacttaactttccccacttgacagacaagaaaactgaggcccacagaaggtaacttaggcaattaattaattatagttaataattaattctgcctgcagaacaggaatatggcccccaacgcttcatgcttaattggatggcttattaaattcttatttttatggtagtgatgatgatgataataataataataacagtagtagctagcattgttttccagtgctaagcactttaaatgcattaattcagttcatctttatgacaacactatgagatagctaatattatgaatcctattttcagatgaaagactgagtcttagggaacaaacagccgagagatgaaatgccacagggatgtctaggttcaaacagcaacagaggtgcgtaccatagggatgtggaagccttgcttgtcttgttcctcttggtataaccccagtgagtagcatagcgcctggtcaattggagggatttggtaaatatttactgagtgagtgagagggtaaaacagctgagccatgggagttataacttgggcagcagtaatcctgccattgtaggaggggacagatcggctggttagtttttggaaagcagaccagcagaagttgcaaataacttgttgtgttttcctaagtactgagctgtgtgaattggtttcatgttgatgttactgaagtctccccaattcatcatctaccttgtagcttgttgaagaaagagtccttatttacagtctattatgttaaacgtattttattccagttctttgaaaatgacccatcctgatttggaaaatctctaacttgcctggtcattctggagcagtgggagccgactgtgatgcagagtggactcataatccagcttgattttgagggacagaaacctgggcctttaggtagaatgaacagcttaaaaggctgcacctgagagtagggggcatatgggtaaatccagctgtacccaagagttgggggcatatgttagccctactgggtaaatccagctgcacccaagagtagggggtatatgttagggctagtgcgtaaacccagctgcacccgagatatggggtatacatgagtgctattgggcaaatccagctgcacaggagagtaaggggcatatgttagggctagtgggtaaacccagctgcacctgagagtaggggtatatgttagggcttgtgggtaaatccagttgcacctggcagttggggcatatgttagggctagtgggtaaacccagccgcaccggagagttgtgggtatatgttagggccagtgggtaaatccagctccatctgagatatggggtatacatgaatactagtgggtaaatccagctgtacacgagagtagggggcatatgttagggctagcaggtaaacccagctgcaccccagagcaggtgtatacatgagtgctagtgggtaaatccagcagacgtccggactgtgcttgagggtgtcatcgagagagagaaggttgatccgaagttagtaaaggctttaaaaattaaaaggcctgagatgatggtagggttttggaggtaagtataaaaaccttcttgttttctactacttaaagctgaaaacccagcttgggttggctttgcttctaatatccttcttcctttttgtttcataagtaattgtcctgaagcctgtcgagataaatgtatactgaaagagaaagacacagaggagagacaggcatacagagaaagagagacacgcagacacacgaaggggaggtggagacacggaggagggacagaaagacagagagagacagaaggagagagagagagagaacctgtctagcggtgtttttatgaggtttttagtgctgggctttgcatcgtggtgacggtgtgtgtgtgggggtgttgatcactgttttcagtgttctctgatcatttcttgcttagaaaggaggaaattagaattgttgagctatgatttgttttaatcagaaagaaattgtctaacataaatctcttcgtgagctctggaaaagcccctaaagcggccaggaaaaaaatatcaatactttgcaaaggaggaatgattgttccaattcgtggcttaattgactttaagccttaatgaaactaaggccggagcgggtggcacactccgtggctgggatccacagtgaaatctacgctgggagaggaggaatttagggtggtaatttggttctttgctattgacgaaattttctaattgactggggttacttaataccagataatatttttttcttgctataaagagagtaaatttgtttttttctgaggaacacaggaatttattttaaattacagctttttctattggaagcattcatttatgttggattattgttccctgagtgaaatttcactgatgctgtataattaaatatagatttttttagagatagtatatattttagatgtataagtggataaactggaggtatggaaggtctttatttaaggagaataaatagcccaccccatcaacatgatggcccttggaaaggactcttttagcctccgcgagttccttttccgcaccaggctccacttacgaaggactgcaaaaacttgctaacgtcatcagtctgaaaggattgagctgtaaaatgtgttatgggggcctaagcaacgcatctggaatttagccttcccaagttcaaatccggtttatgccacttgcgaaaaccatgtgaccttcacttgttcttattgcctcagtttcctcatctgtaacttggggatgatgacagtatttggatcacaagattgttgtgaagatgaactgaagtgctaatgtgaaatgttcatgatggtacccgagtacttgcggtggtacctagcgtgtgctttccaagtgctggcaaagaaaagaaaagaaatgcttggggctctgcctacctgtctaggctcctgtctggccattctctttcttgttccaaccatatcaaactcactgctgttgctaaaccttcctgtctctctgcatcttggcacagactatgtcctctgcttggaagggtctcagctaagcttttcctccccacatctgcctctgtatcctgtgagtctctgttcaagggtatctttcccacaaagctttcctgggcttctctttcctgtctcctgccctcccttccttcttttgttcagcacatcgctgtcaaccttcttctctgggtcaggtagagcactgagcaccagtgatatggcagtgataaagaaagcaaaggttctcactgggtgtggtggctcacgcctgtaatcccagcactttgggaggccgaggtgggtggatcacgaggtcaggagatcgagaccatcctggctaacaaagtgaaagcccgtctctactaaaaatacaaaaattagcagggcatggtggcgggtacctgtagtgccagctgcttgggaggctgaggcaggagaatggcatgaacctgggaggcagagcttgcagtgagccgagattgcgccactgcacttcagcctgggtgacagagcgagaatctgtctcaaaaaaaaaaaaaaaaagaaagaaagaaagcaaaggttttttcctcccaagaactcatggtccaagttttggtttttaaatatgcatctatgacagcacggatcacatagtgcattgattgtttgcctgtaggtctccttatttagtcaacaagcatgttttgatcctttattctataccagccgtcccactggactctcagcacatataggtatgcgagacgttgtccttgccctaagtgtggagacagacacgtaaattaatagtaataataatatctaccacccactaggggtctatgtgtgtatgtgttgggggcggtgtggctggggagggaagcaaggcctgtattatggcccaagctcaagaatattcgggcaagagcagatacaatgcctgtatttctcatcacttttgggtggcataggaccagttggttatgagcgtgaaaggttttctttgactttggtggtctagttagtggttgagaacatggattttggaatcagcccggtggaggttggaatcctggctgcgccgttctgtagcagtgttgtggatctcagacaaggtgttcctgcatatgcctctctatcttcctacaagaaatggaggtattgcatccccgaaccgtaggatgcttgtcaggattaaatgagataacagtgcctggttagtggcacatgctcagtaacacctgccaagtaccactcactgagccgaaatctcctgaataccaccccttcatgccttgcacatcctgggttctaactcattgaggtgcccccacctttccttcttcccatcaacaactcttgtgcccacgagggactggcctcctcagtgccacacagagcctcccctgagtagatttgtgtcattttcaaacaaagcatcctggctgcagtgttggattttgtaggatggtgaccgtttacagaaacctctggtccgtgagccaatttggagaaaattgaatcattctctgtgcctttcggcttgcatcctaaaagcctgcacaaacactttgggcaggcttcagcaacttcacatcaagggctcaattgcagctccaatataaaaacctcccccgttgctctctgtgtgtgaagctggattccatgcttggcacagacctcggtgctcacggtaatgcttccttccaccatatcagaaggtcctcagcagccgcagccacttaacatgctcggtgcttctctgtaggaggatttttaaaaagcaggaactgtcagggtcccaaatgttcagtggcacttcagccagaggtaggatagggattttgaagtgtttggagaagtgttttcatatttgaatttacggggatggggtgggctggggtaggcaagggacagactgtagcgattcgcttggtgttttctcatgatgccagagaaaatgacctcattatcatcatgctcacattcacctttgccaggacccctgtgtagaaataatcatgaacttagtgactgacaatcataagcgttttatgatttgtggaggatttatatgtgaaggaaaatggatgaattaaaaatattaaacagcttagccggcacccacatggatgaatcaccgagatctattttttccccgtttatactataaacatatggcatgaattttctgctctcattacagatgctgagagaaggcaaagacaaatatttatattacattcatgttttacagtaaaaacactgttcggtttgtttacacagttccactgttacagtttttatggtcggtaatgcaaccaccgtaaaagcaagtctgggttatatagcagatgtgataagccctcatactcagagagatgtctgggaaagaatcgttgatgtcacatgtacaggatcaacaatggaattatgtgttgggacagtctaagttatgctgtaataacaaccaacctcaaaatctctggggcttgaaacaacaaaggtttatttcttgctcaaactgtattttcatcatgagttgcttggagggatctgtgagatggggatctcactcagccaccggggcccacagagcagcctgcactgctggatgttgtgacagaggaagagagggatgtgctgaccctcgctctggctcaaaagtgactcctgccatctctgctcacattccattggccaaagcaagtctcagggccaaggagtgggcagtagtagggtgctgtgtgtgtgtacaaacccaccatatgtgcatagagggaggccgagaactggactatcagagaatagccaaagatttctttccacggtcatgtcaagcctttttgctgttatttaattgatgttctatttttaatgcaacatggaatcagaagaatatagaacaggcgtcaaagaccctcccgcctctgtaaccgcactgtttaaaattgatgagactctgtcttcattcgaagatgatctgataggaaggattcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtaggcatgaaatgctggagatatgcgttcattcaaagaaaataaaaaggcgcaattatgaaaagctctcaaagtgactttttattttattttttatttttacatggagtctcgctctgttacccaggctagagtacagtggcgtgatctcagctcactgcagtctccatctcccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagagcacccggcctcaaagtgactttaacagcaacttaaaggcggtggctagctctgccccattcagtatggtagccactggccatgtgtggcagttgagtgcttgaaaggtagttagtccagattgaaatgagctgttgatataaaataacatgactcccaggtttcagacagtataaaaaaatcttaattaacatttttatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagaggaaaaaagtacaatttggtatttttgtcacaaatccttaattgctagaactcacagtttaacctgacagttgatcaattgatatcctttgacttgttggaattttattctttacattcgtcttttaaaaagctttattttatgccagatgcagtgcctcatgcctgtaatgtcagcactttgggaggctgaggcaggtggatcacttgtggtcaggagtttgagaccagcctggccaatatggcgaaaccctgtctctactcaaaatacaaaaagttagccgggcgtggtggcacgtgcctgtaatcccagctactgaggaggctgaggcaggagaattgcttgaacttgggaggcagaggttgcagtgagccaagatcgtgccactgcactccagcctgggtgacaaagtgagaccctgtctcaaaagaaaaataaataaaaagctttgttttaaaataagtttagattctcatagaagttgcgaagaatagtctatagtattcttcacaagggttctgggtacccttaacccagcttccccagtgatagtcacagcataacaatcaagtctgggaaattgacactggcatgataatattaactaactacagattttatccgagttctgctagtgtttgcatgtactcatttgtgtgcggctctctctgtgtgtgtgtagttctatgaaaagttataacatatatacatttggtttaccaacatcatagtcaggatacagaactgtcccatctccccaaagaaacaccctttaccttagtttttattctttgagttatatcttaaccaggttaactgagggtaattgtcttaggcaagttagtaccaaatgatgctcttggttccttgtctgtctttttgcccatccaacccacccttcacacatggccgagttatgccaaactttgcaagaggtgccaggtgggcacaaagaaaagaggactgcactcaaggaacttagtctttgaggccaagcacggtggctcatgtctgtaatcctagcactttgggaggctgacacaggcagatcacttgaggtcgggagttctagaccaacatggtgaaaaccagtctctactaaaaatacaaaaaattagctggccgtggtggtgtgcacccgtagtcccacctacttgggaggctaaggcaggagaattgcttgaaccgcggaggcagagattgcaatgagccgagatcgcgccactgcactccagcctggtccacacacagagtgagactctgagacttcgagactctgtccccaaaaaaagacgcaaaggagctcagtctttgaagggttacagaaacagtttcactagaaggtgtgacattgtgtaacagaaatcggttccttaacctgccaaagggaagaaaatagtgcggaatcttttctccaggtttcaggacccatgtctgttgtccttcctttaccttaacttcagcagggcaagaatggttcaagccacattagaaagcagttactttctcacccaattttaaaggagaaaggtagatgcggtgggttctagggatttcagtgacgtaacaggtgtttcccaggcattaagacctagtaaggtttccatttccattaggtattatggatgcattccaagaatttaattactataacatcacttcattcattgtaattccttactagagttatgagaacttgggattgtgtggtttcttattcaatcgattaaaaggtacttgctatagttttctaactagctatttatatgaaatttagtacttgtcaatatgtattaaatcaatacagttatatttatcaaagtggtgagaagagtttacatctgaacatagaatagattgcttgccttggccgggcgcgggagctcacacctgtaatcccagcactttgggaggccgaggcgggcagatcacgaggtcaggagatcgagaccatcctggctaacacggtgaaaccccgtctttactaaaaatacaaaaaattagccaatgtggtggtgggtgcctgtagtcccagctactcgggaggctgaggcaggacaatggcgtgaacccaggaggcggagattgcagtgagctgggattgtgccactgcactccagcctgggtgacagagcgagactctgtctcaaaaaaaaaaaaaaaaaatagtagattgtttgcctcagttgggaaaaaataaagttttaaggctctagaattggagtgactcagctttacttgaaaaatcccagaatagtaggaccatcatttagaagtttcgagacgataatattagggaaaaataacagcaaatgttacttgatagacactaaactctggggcatatgagatgacccaggctggaaaaccactggcttacataaaggtattgacagacccatgggtgttaagatccttcatggctactggggagaaatgacaggccttttgaaatcgtatcagtggttttccctgggatcactggaaataatacccctgtttgacaagatatgacacatgctctgttttaattctgcatttgactaacagaaaagattggtgaagatcagactctgctttaaagttattgaagcagggtacaaggaaaaggggaagggaatagaggctgcagaggagaatgggggaagggggcaggaaggtaaaatttggaggtgcaggcagagtcaaggtcatgcctgaggcccaaccttcctgttgaagctggtgtttgattcaagctgtggctgagaacgtgcagctcatctggagggtagagttgcaagacatgggttcaggtctgagccaagccagaaactggagaaagcgtggcttctcaagactaggaatacctagattccagaggtggcgtgggcatggggcacattgtgacaagttaacagcaagatcttcagagctgcagctcacctgtgccacgatggtctcctaggagccctttcctgctgtagtcccgccccgaggggtttcacttcccactgcctcttggtagccgtgggcactttggtgctctgatgatgtaacatggagattgtccttgtctccatcgctgtctttactggtgtatgcccatgaggtatgtcaaagtctgtatgtctttgtaataatgctggatcatttgtccaccttcagagacaactgaagacagttttaagtgaaaccacacagagggcatataccattgggacaagaggtctgaagtctatttttgagaaagagaagagatcaagtagttaacagccagtggctatcataataatggcacctaaacaaatccttcttttttattttatttaattaattaacttatttatttttgagttggagtcttgctgtgtctcccaggctggagtgcaatggcgtgatcttggctcactgcaacctccgcctcccaagttcaagcgattctcctggctcaacctcctaagtagctgggattacaggcacctgccaccacgctcagctaatttttgtatgtttagtagagacgaggtttcaccatgtttgtcaggttagaccggaactcctgacctcaagtgatccacccacctcggcctcccaaagtgctgggattacaggaatgagccaccacgcccggctcaaatccttcttacttttcctcaagaactcacttcccacccaaacctttcctattgtggcagctgttatcttgtccagcacatgtgtccacacttggtattaatagctccatcttaggaactatgaaagtgaggggggtggtggtaatttgcatgaactggtttgggccagttatggtctgttacatccttgctgaaatggttggtgctaagatgagcacttggcttaggccagaccagtccctagcctgtggagaaggggcaatctcttatctgaaggcctaggaggtgcagggatgtttatatgggctgctagcgcttagtttcctgccacagggagacagtaagaaaggtgacgtcaatctgagatgagagagagagcaaaacagttcttttgaccaccttgaccccgaccttgaaataaggtggaactaataaatcccgctttgtgctggagcaagttttggctgagtttctgtcacttgcaaccaaatcagtcctatccagtatacctagtgactctctggtctccaaaggctatgcctgctgggtactgagtgtctccccgaccgaccccatgatggctacagtgcacatcccttccagccaactctattgtgcacacatattcgtagggtgagttgggccccaggtagagtgattggctcagatcctgcatcctttcagggtctgactgtaatcacactggcatggcagggggaaagtgtattggatttcagagtcaaaaaccacttggtatgaaacccagctcattttctatgtggatgtccaacctgagccagataattaatcttggagatgacgctgcatacttcatcaagttgtaaagttgactgctgtgataatggagaatgctggacaggctgcttttcatgtcatgggttcgctatactttagttcccattatatcatcctgccaatccccatttgttgtttttttgggacccagggtatcagtcatctgatcattgtgtgactttctcaaggacctttacttgagtcttgcacctctggtccacaatgtccacataccagcttgatggtgacttgtgtcattctccatccccttgttaagagaaaatctactttatgagccctctttccaaccgcagtgttgaggactagaccaggcaagatgatgccgctggaccactggatccagctggaccgctagaccacagagcccctggagcctcccaaggccaagcccgccagccacacacacctttgtgagaattaagaaaagatgccccctcctcttggggcccacagctcctccacctgggcacccagcctggtgaacagggtgcaggctgggatttagccctaccttgcttttggaccattgagctactaagttggagcaacaaggcttgggaatttttctttgatcataggtaggaaaggtaaaaaaacataaatctgccaatagaaaatagcatcgtaatgagtttctactatatttgtttgggctttgaaaaatatgccgccacaatatatcaatgtatggtcccaacgttttaggaagttgcatttaaaaaatcttggatacctgttttgtacatattatatatagcatcccgtgtgaatatgttaattcctttttatgagtttcggtcttttttccctctcctatacatgattgctgttttatagctccagtttggtggaattaacatagatttcccacatggggaaggttttgggtgaggatttagaacaaggcaggttcttgatcctcggaagagattcttatctgagaggggatttgagaatggcattgcagagtgggaggcgctgctgtgtggaaaaatgaactggaataattattagaacagttctcagaatttacaggatatttgatcataggagtaactttcctcaggagtgatggatggaatgcctgtacttggaatatttttaaattaatctattttcattacattgaaagtatgacacacagagaacactaaaattggatgaggcactacctggaattatataaagaatgacaaagatgcggttatccatttattttctaggcaagttagttagcctctctgtgtttctatttctttgtttataaaagagggacaaaaataggacctattactatctaggtgacaggatcattcataccccaaacctcagcataatgcaatatactcatgtaacaaatctgcataagtacccccttaatctgaaataaaagttgaaattattaaaaaagaaaacgaaggccgggtacggtggctcatgcctgtaatcccagcactttgggatgctgacgcgggtggatcacatgaggtcaggaattcgagaccagtctggccaacatggcaaaactccgtctctactaaaaattcaaaaattaggcttggtggcacgtgcctgtagtcccaagctactcaggaggctgaggcaggagaatcacttgaacccagtaggcggaggttgcagtgagccgagatcgcaccactgcactccagcctaggtgacagagtgagactccgtctcaaaaaaaaaaaaaaaaaaaagaaagaaaacaaaaacaaataggacccatatccctggattgttgaggaaatacgtgaacatatgtggcacacattatagtgtctggcatacaataaatactttgtaatgttactggtgtcttcttaccgttattgtctcactggtgaccgtttgaaatgttgaagctttattgttacagataatggtggatatagtctcttccttgtttattttttgacagaatctttttttaaaaaagtttttatttgtttggtgagaatttacttgttacaggtctagtgctgttatagttgaatgttttgaattatgtaacttaagtgaaacataaagctatgacttgaattttgtggttagaaattttctcagtcgattgacaaggatggcgtattggccaccttttgccgcagtaacaaacaatcccagactctcaaggcttgcaaaaataaatgtgtgtttgtttgctcataacacatgtggctgagggttggccgtggctccacagtcacgggtgggctttcctgggctcagcttctcacagcgtctccttgcagggcccaggctgtaggagatgtcatcagggcctgcagagggcaaaacctcacagaggcttctgttcatacattgttgtacctcatgtgtgcgtcatattgtcatatatcaatggcagtagccaagaccaacagccaagaccaatgtattctgcccacaggaaagtgaggcaaaggcagggagggaatgataattgtgaacaaagaattcacttgaccaaagatggttttcttgatatggttgccacttacctttcagtaaaatagcacttcacaaatttgtttaatgttttatctcaagctcccagaagtagctaaaaccacgaacatacatgttgaaaatttcaaaagggaaaaaagaaaagaaaggcacatctgagtcaggaaaacattaactagtcttatttctgagaatcaaaccggtggtcttttcagtgatcagtcaccccattaaccacacatgaatggcacaagtaggaaatgcctgcttcaataccaagaagctggtcttatttagatctagtcttatatcattgaaatatcattagaattcttatggaaaatatgttttggctgtttaggggatgctaggggctggaagtgagaaggtttcaacaccatatgggtatgtgagtatagatgcttacaagaagaagggtagacttagccaaaactaatttgggatttttgtttgtttgaattgttggagggtggatgagagtgaagacatatccttttgaaacttaatttaatttttatttattattattattattattttcaattttttatttttattattattattattttctattttttatttttattttttgagacggactctcgcactgtcgcccaggctggagtgcagtggcgtgatctcggctcactgcaagctccgcctcccgggttcctgccattctcttgcctcagcctcccaagtagctgggactacaggcgcccaccaccgagcccggctaatttttttgtatttttggtagagacggggtttcactgaagtagccgggatggtctcgatctcctgacctcgtgatccgtccgcctcggcctcccaaagtgctgggattacaggcgtgagcaacttaatttaattttttaaaacaatatatgtctctttggagtcagggtgtttgttacagtgatgttttgcagacaggtttattggaactgcttggtaggtgataggtttttctttctgttttttaattaaaaaataagattggccgggcgtggtgtctcacacctgtaatctctgcaatttgggaggccgaggcgggtggatcacctgaggtcaggagttcaagaccagcctggccaacatggtggaaccatgtttctactaaaaatacaaaaattagcctggcgtggtggtgggcacctgtattcccagctactcgggatgctgaggtgggagaattgcttgagcctgggaggcagaggttgcagtgagctgagatcatgctactgcactccaggctgggcgacagagtgagactccatctcaaaaaaaaaaaaaaaaaagatttatgtcaagaattcacatttctggcctctcttaaaaatattggaagacatggcaataattatctgggactgaatagcagctgcttctttttgggacaggtgatcacccccaaccccaaacccctacccttaactcttctactcctttggatgttatccctgcctggtttaaccatcaaccctcttaactcccgatccttttaaacttcctctactctttttattcttagcacttagaacccactaacgctctatgtaactgtcttacgtgttccatttcttgtttctagactgtctccctccagtagaatgtgcgttctgctatacagcagtgctgtgtgacgcgatagcaggtcctttttaaacatctgttgaaggagaaaatgaaggcacacgtggccttgctgacatctgagtttgcaacttcttttatgccttctgctaactgggaccccagtgggcttccctgctacaccctctgaggttccccagtcctgccaagctgttccatccccagttccttggtgcctgctggtacttcaccctggagagcccagcccttccacttgttcagatctcagtctctcatctgggagggacagcttgagcactatgacctgtgtgaagcttttcccagtgctggcagactgactggaacctgctccttcattaaacctgacagatgcctccacctggcagttctaccctaagaccatgaacttcttgagggagggagatgtgacttttcatccctgggacccagcagctggctcacctcctactggttagtgggtgatgattggatggcttccgaatgaactcaggtgtcttaagtaccgttggtcctgacaccatggccaccttccagaaatttccacatgttaagattgcagatgcaggctggacacattagtgatttctaagtgctaagaaaaaaaaagagcggctcacacctgtaatctcagcactttgggaggctaaggtgggcgaatcaccccaggtcaggagtttgagaccagcctgagcaacatgacgaaaccctgtctctactaaaaatacaaaaattagccagacatggtgctgggcatctgtaatcccagctagttgggaggctgaggcaggagaattgcttgaactctggagacagaggttggcgtgagctgagatcgcaccactgcactccggcctgggtgacagagcaagactctgcctcaaaaaaaaaaaaaaaaaaagaaaaaaaaaagattgaacatgtggaatatgagacaaatgaaaaagattgaattccgttccaactgggcttttgaatttattttcgcacttcctattttttgagcccgggagtgcaagatgtaagctaagaaaagataagatgaaagtattgctctaacattctggcttccttctattagagaagaatgcaaatctttgccttatctcgatgatgggccccacttaaccctttgttttactgagagcacttttctgcagatgatcaagtggaatttactatgatggcctgtcaaatcttgaaataatctacctttaaggaagaaaagtttaactagatgattgtaccttttagccatatctacaattaatttgaatgtattgcaagctgtttaaaatattccattagtgaagaaggtaagcctagcttctggtaaatacactactaagtgtttatagtacatttcatattttacatgatttcctttataattctgcttatcttttcattctaattccctgaaggacatataaaagaacccctaaagagagtaattactgctgtactctttaaccaaggctccttttgcaaagagaaatctgagctgctttttaaagaaggccgtttttaaataaaaatgcaaataagctactttgtaaccacattaattacccacctagcctcttattaccatgtttgtattgtttgcaaatactatttacagtcgtgtggaaattaacattactggtcctgaggaaagattgtgttggggaggttgtgctttggaaccaattagggcgaaccttgtctccactgagactctggggaaaagcacagccttgcaatgtcaaataatagcattagctctgactgtacaggcagagtgctgtaattatattattggccctattttgcttctgcaatgaatttcattgcctgcattgtaaaatcagcaggtagcaaagtttctgctaatgatttaatgtactctctgatcattttggacaaaagtcatggtaagatccacaaggcaattttatcatccccactgactactgcctggtttaagcattttaagtgaagacaaaacatgattctcatctccttgtttcctggtgaattccttcccacacagaagagagaattacttgtctaatatataatttcaggcataaggagaaggtgatattgcattgcaaataatagcagttagtgggagttgagagccagctctgcaccagactcgtatcagccacttgacctccattattccttattccttggtacctctgcgccatctgtgatatcagatccttttttctgcaaggaaactgaggctcggcgatactaagaaactcagccagggtccgtcagctgtcaagtggcattgctggcacccagattgagggccatctgactccaaagccacctgactctttcccatataccacagtttctaatacgatattataccaagctttaatatgagcacacctcctggatgatgctgtaaattagttgcctcccaccacaccacatcaagtataatggatataatatgatttttcagaattcagctaattacctactgagctttacattttgtaacttttttgactgtccatcaaaatgtctttgggattaaaaatttttttcatatgttttgaggtcaatttgaatctgagtttaataaacgttaccatgaaacatttctcccatctttttaggaaatatctgtgaataaactcattttgtgatagaaggctgtgtgtttatccagttttcatcctaaggagagggggagaagggaaataatacttcacgtctttattgcatgccaaacgtttatagacattatatgatttcatcctttaataaccccatgaaaaggatgtcattgtcttcacttgacaaatgagggagatggcagtgcaatcaagacatactgacaaggagaggaggtgagcgacttgcccgaggccacgctgctgataccttggcagaagcagaatttgaaaacagagcccccatatgttttaactgctcattggaaactgactaggtcacatactcctcctccttccctgtactggtagtttttcttttattttttttttaaatttcttccattttctttcctttttacagcaaatttgtagttatggtggagcaaagggcagttttcactcctcttccctaaaactgtagtttaactaaaaagtggccactgtctcctggtagcggttggtaagccatccagtctctgcaggcatctacgctccaggtctccagtctgaggagtctggctcctggggcaggtgcctctgggggtctctgccaggcttgtctggtcatgcagctacttccagactgattcctagatcttgcatttttacataggacatccccagcattcaaagaagatcctgggaactggattcctaccagaggaattagaatgaaaccaacaaaactaaaaacgacaccctcccccatcccccgcatccgatacacatgcaaggtaatatttgatgtcagtaggaaaaaaatccagtgttataggagacaaaccatagcaagcaatggcctctcacccttcccttcacaccctccactctgtccacttgtttgttccttcaataaatactgatggagaatgggctctatgccagtgtttctctggatgttggctgcagggatgaacaaaggcaacttctaggagaaatttctgtttttgatgctctcgtggctgcttcctgtgtcttaatattgtgcttaaactgccacttcttcagctgttgatttcaggcactatctaatgacttttgctgttacgagcatggatttagctcatttttaccatcttccctagttgtatcaccttcctcccattatgtttgtaacttcagattttgtatatttcgcatatgtcaatatgtaaacattttatatatatatatatgcattcacacacatgcatacatatatgtaatggtatatatacatgtaagtttccatttttgctcaaattgctctggacagttctttgctctgggagttctttactccctttctcataagaagaggctgtttgtaccctgatcaatccctctacctcttcttttcccctttcacccgtaacttctgctacttatacttctgccttatcatggtccataacattcaccttccactctgtagccataattaaatctcccatgcatcccactttgggaggctgaggtggatggatcaccaggtcaggagattgagaccatcctggctaacacggtgaaaccccgtttctactaaaaatacaaaaaattagccgggcatggtggcacgtgcctgtaatccaagctactcgggaggctgaggcaggagaatcacttgaacccaggaggcggaggttgcagtgagcccagatcgcaccactgcactccagcctgggtgacagagcgagactccatctcaaacaaacaaacaaacaaacaaacaaacaaactaagaacaacaacgaaaaaactcccatgtattatctatggattgactgtaaaatatgagaagcaataaatatgttcatcactagggccatctagaaatttctaacccaagggtcaactaatctttccctgtgttgtatttcctgctctgcggatccggcatcatgacctttgtactacccaggaaagccagtgttctcatgggctcttctcttttttatgctctaccagatgctagcactgtggcatgccattcgctcactagcagcttaaagggtacaggttctaaatctccttagtgctactcacctgttatttctgagcctgcgtagatgatcttcttttattcagacgtctgtgtcacatatacatgacatcctacccccttcccataaaaaaaatcacatttgtgaatgtctctcttaggctgagttccagactccaagatccctcttctctcttgtcagaatccagcagctgatggcatttatgtctgtagatttcactgtcaatgagtcattgacaggctaagcaggctgttggatggagtgatcaatggtatgagggaaaacactaatgtatgcaagaagagccatttcctagtaggaaaaatatttatgtatggagccacaaaggtgatcgcttcagtagaaatcaccaaggacctggtagtcaatgtgcaacctaattttctttcaaaagctgtaggaatggcaagggaggaaataaataatgcatttctttatatctcctgttttaagttactgagtgtcgccaagagatttctaaggccagacattgagtcagctgtaaaactggaaggagcaatgtttgctgactgttgcctcagccgctgaccctgatctcctctgcacgtagtaggcagcttaaaaattcctcgcccgacttctgattttcacgtgactcactgcttagttgtctgggtttgttttaattcctttccccctgctgacagttctttaagtggatgtctataaaggttggggcattcgctcttacaacaataggaaaagaaaggaggaaggaataaaaaagagagaaaaggaataaaaaaaagtttggtttagatgtctgatttctctgagcctcagtttcccagcatgtaaaatgttgtgagggctcacactggtcttgtccaggtgcttagtagagcatccattacaccataaagtatcacaaaaatttttaatatcatcattattactgtgctttcccttgagtttttttttttttaaatcagttaatccacatactggcagatctgacttccttgttttaggccctggggaatttttgttatctgtagagctggattaattttacagtgtggtgcctttgcccaaggtgaacctgtctgtttatagaaagtgtcaccaagttctgtcttgggcccgtccactcggttatatgtgctggaccctgggtggaagcactttgcacgtgtgcattcacgatgggctgtgctggaggggaaaacaggcatcactcccaaattctattcatgcaattaaaaattcctttcatttttatttgtgagagggtatgggtgcacagcagacggcaaacagaagaaaagcttttgattgaaaggtaaacatttacttctgccttttaaatagacatagcaagtctctttactctcatggaagcagttataaggaacatagagctgaagagaatatgaccatttctggtcttttactatgctcgtattaatccaccctggatagaagggactgtactatttggaaacacctaaataaaatgtttttgtcttaaggtgttaaaatgtactcattaatgtggcagtgtattccttttcttctgtgatcgttgaagtagggaaggaatttcaactaagaaccaaaatgattgtctgttaagacacttattttttgagaagacaaattaatataacattattatgtggggaatgtggaaaggctaaggttgtattgaaaacttattaagcttatgagaatattgaaagcatgaggaggcatgaccggaaggtattaatgatttgggcttgattattctaagactgtattctaagtctaaaatgttgataactaagacctgaaatgataaatgtttggcaaaaccaaataaatgagtagcaggttgaaaaaagaggcaagagagaagtagatatttatagttttctaaaacaatttagtcccttctggaagagagtcctacctcagccatgcctaccaggttgtgtttgtgggattatttctgagtcacccttaagctcatctttacccctctcccagacccccagtcccctcactgggcattccttggattatttatttatttatttatttatttatttatttatttattgtttgagacagtctcactttgtcaccaagtctggagtgcagtggtgtgaccttgactcactgcaacctctgcctcccaggttcaagtgattctcttgcctcagccccctgagtagctgggactacaggcacgtgccaccatgcctggctaattttttgtatttttagtagagacgggattttgctatgttgcccaggctggtcacgaactcctaaactcaggcagtccacccgcctcggcctcccaaagtgtaatcctggattataggtgtgatccaccacacccagccttccttttgtttttgatttttcctctttaaactctacttgtaaccacccctttcctttcccaaacttttactagcttcttccatcctggacttgcaatctggctgaaaacctgctaaataagggaacaattttgacatggctcctgtactccccacaaacctagttgattccagaccagtaatgtcttggggacagtgttgtcccatcttcctttctaggctgggctcagattactgacgtggaagagttgttggtcctggtgcaacatgccatgaccatgaggcctctggtagaaaggaaggaatgaagggtggttctccaaacccttggcccatgcctcatccttctgttcccttccttttccaggtacgtagctggtcaggtttcttaaattccgtcgatctggctttatccattttaagccttaggttgttggaacatagctaagttggtcaccttttcaagaattgaatctcaaaaaagccatgtagacctcggttgtaaccatcacattcattgacttggttgttgatctgtttgtcagatcagttttctgtttggggaacatttttgtaagtgcatgtatttcagcttttaacattttaaaaataaaatttcattgggaaagaaatttcattcgactggagtaccaggaacttagaatgaatccatttgtcagcagtatttataccctgtctaaaagagtgtcctcccagttctctgtctctgtactgtgtccccactttaaaaaatagctcaacctctcattatatttgcaattttttgtttttttcattgcctggtgggtttttttttttttgtctttttaaatgctccatgtagaaaagaattcctggaatagttcttggaacagcataggtgaataaatgagcaattattttgtcctcagcactataactgatttgagaaggtcaaaacagaaaataaaaacatgtttcagtagtaccagttcctgcacaggctgtctgccaactatggaagtaaagggaatagaattaggctgtctggattatagtgggaaaacaaaacacaatcacatcctgcctcagcctatccttgaactggtgtctttagaaaggggaggtcaagtaaaggccataaggctggatggtggggaagaaagaggcctgggaacaggtgagaaactgcagagcctggcggagttcatttaacctcactgtggttctgttggacttagtgcaaaatcaagagacccacctttgcctgcccatcctgcaatggtttggggggccccaagtagatgactggggaagatgactgggaaactgcagcactggttcatgttctgggacaaatcaatattaagcaagtttaatgatgggtaggttcattcaaaagggaaatatgtttcaatggagaagagaaatttgttaggttgtataataaatattttgagtgtatttggatagaagtttatgacggaaaaggcaaaattctctgtgtctttatggggagatattcgatatgttttttcttggcagaaataaaacatattcaataatataattaggcaaacttgttttagttgacaagaagaccgtatctccgtctgcaagatgaaggcaagatcaagagatgtcagttaacattcttgcgaccacaggtagggaggagaactggggaggaatttatggataggtgagagcataaaactagatgcggaagggatgggggagcaggtaaaataatgaggctcaatgttcaagaaggtcttgggcaagcgcgtgctagttattttcctcactggtgtggtcgtgacagatgaatcacattttactctcctccctttctcatagtatgattacataaaggagaccttccctggaaagagccctgtgcatggcttttgagagtgggcctgggctaacagtgagtgtggaagcttgctgccttgaattctttccaattctggagagttgatgggtaacaagtgtgtatctatagtctgcttggacatggcggtgtggccactgacacgttgtcagccatcccctcaactccagggacaggaatggtgagaaggtggtgagggcacagtctgcccggagacgggacagtttgtactacctgtagcaagagcatgtctttgagagccatagcagctggcttcctatttggagagaacaagaatgtgaaaagctatttattaccagatgtgggcagaccctccagcctttttttgttcttttaaaccctaatctctttttaaaattttttttatttttaatgtttatgggtacatagtaggtgcttatatttgtggggtacatccgatgttttgatacaggcatgcaatgtgaaataatcacatatgaagaatggggtatccaacccctcaaacatttatcctttgtgttacaagcaatccagtcactcttttagttatataaaaatgtacagtttaagttattattgactatagtcaccctgttgtgttgtcaaatagtaggtcttatttattccttgtatttttttgtacccattgaccatccccacctcctcatcaaccccccactacccttcccagcttctggtaaccatttttgtgctctccatttctgtgagttcagttgttttgatttttagatccaagaaacacaatcttagatgcatagtaggtgcattctgttgccatctgcatcatgggactgcacaatcggagaggcaggaaggccctgagaaatacctgattacacacctgcgtgctgggatgagaaatatgaggggaggagagaaaagatgagcctcatattgcatagcaagtctgtgatggaagcaaagttagaccctgttgatttttatgtcttacctccttgccattagttaggtaaatttagaccaccatattttctaagatcagagaatagagaattttaaattctagattcttgccttgtggatgttgaaaagaacaattaaaagttatttgggatatccaatcagttaataaataattatgaatgaataaactgttttgttgaagacactcttatggcagacatgaacatggggcttaaatcagttctgacatctagaagctcaaatccaggaggcagaggagttggatattaaagaactctgtggtgagctggacaggatgacatgacaattatggaagttcagagcacatagcagtcttttccagtgatggggatggaatgtgggggtcatggaagactttgtggaagagttgcaagtagaattattactgttgaaaagagatggggagttaggtagacaaacagaaaaaatgccaccaaacaataagttaggatagaaaaactccacgtatccatatgtcagttggcccatctgttcgttcatacatcctttcattcttctatccatccaaccgtccttgcatccatctatccatccacacaaccacttattcttcattcatctgcccatctgcccacctacccatccacccttccatacattcatctagtcatccccatccatccactcatctatccacccatccatccacccatgaatctatccatccatctgccaatccacccacccttccactcacccacccatccatacacacttccatctgcctttccaattatccacccttccatccatccatctacccactcatctaccctttcatacatccatacacatccatctgttcattcatctatccatccatgcatccttccttcgttgttttcttccttctatccatctattcatctacccaccccacccacctatccttcacccatctggccatccatccttctacccacaccttccttcctaccttccttccttccttccgtccttccttccttccttccttccgtcctcccttcctcccatcctcccttccttcctcctgtcttcctttcctttccttccttctctttctttcttttgttccttcctttctttcctccctccctttctttcctccctcccttcctcccttcctgtctccattattaacttgctggtattttgtttcaccattgcattgtgtttatcaatagacgattaatggaagaagagaagaaatcaggtgaagtctttgtaggatctagaatgtctaggctaaggagtttgaaattttttatactatgttctattgggaaccatttcagggttttgagatatagtatgatataataacagctatgctaaattctttgaagttattggtggtggaatatcaatccagaatgaaaataaataattttggaaatgagcctgtcattgaaatatactttatttctcgttaaatgtcccagcaaaagtattttggttgttaaaataaaggaacaaccattagaaaggaggaggagaagaattagaaggaaaaaaaaggtaaaggtaaagtaccttggtattttagggtttctaagattaggaactttaaatgttgaccccattttggtctttaccttcaaaagacgggagaaagactgagagaagtttctaagctgatgctgctctactacctggagtaggaatgagaaaccatctataaatattacctttggtgtttccatcaaaaatttagaatttcaccctattctatttttaattctggtttaagactgaaggggttcttggtgaatacttttgtagatacaattaatagttatgaaaatcattactgattacctccagggttcagatattgggctgaatgtcttctctcaccatcagaactaccttttgactagagtgttaattattaacatattttagattagtcagacaactgcaatatttaaggaatacgtccaaggtcacacaactaaaagaagtgacaaagtacggtttcagacccttttagtcttttctgtgttgcaaaattgagataatgataatagctaatgatacctctcccttactgataattgaatgttttatgtgaattaaaaagtttaatctgcatagtgtttcatcaagatagattccttgttatcctcattttggagatgaagagactcaggcatgcaaaggtgaagtaattttcccagggccagagggctaaggaaagggagaattgggattaattctacattgtctactggtaatacctattgctcatttttaccagttaaaactatttaatgagcatttgcccactttctaaaaatatgatggtcttagttacccacatggacctactctatcccaggcagatgccacaaattattttgttttctttttgtatatatttatgctgtttcctcatttttaaatagtgggctttgatgactattcttctacataaattattacatatctgtatcatagaatcttaaaaattatttgattcaagtgtatacataattttcatatccctgatagatattgccaaatatttaccagaagtgaatcaagtagtttttctaccaacattatctaagagggcttgtctttttacatctttgtcagcactaagtattatctcccttacttttttttttttttggtaatctttgttactttgttaggattaaagtagcttctcattttaattttcactcctttaattgagaagcagaacgtattcttttttggtgacttgtttcagagtctctttagtttgaagatacaatagatgtagcatctgctatatccggtaacaggataacagtgcattgctgggatgatgaggctgcagtgggctgtgattgtgccactgcattttcagcctgggtgacagaggaagaccctattacaaaaaaaaaaaaaaaaaagggtctgttatcaaccatgcttttttattttattttattttattttcctgtttctgagttagagtctcttttgctcaggctggagtacagtggcgtgatcttggttcactgcagcatcaacctcctgggctcaagcaatcctcctagctcagcctcctgagtacctgggattgcaggtatttgccaccacgcccagctaatttttgtatttttagtagagacagggtttcgccatgttggccaggctggtctcggactcctgacctcaggtcatccgcccgccttggcttcccaaaatgctggtattacaggcatgagcctctccatctggcctcagcagtgctcttctggctagcttgatcatatgccaatgttttattccttcgtggagctcagagtaagcttgttttactggacgttttctataataaagctaggggatggcgaatcattctaattaccaaaaagctgtctttgataacaatgtaggagataacgaaggcagaaataacatttgagtaattctttgccattctgtctctgaatcttgaaataaatactcttgaatttatatgttcttggtcctttaggagtcataaaaacataccgttacatatgtatatgaaacggtgagaaactgcgtatttattaagagtcacgacccttaggactagacaaatcaaattaaatctcataaaaacctgttatggaatatgaatacgtggcactattttttcttttagggtgtctttattaattttgtcatgtttaatatgttgcagttgcaaacaaaggcataaatgcatgcgttcattcctaattaatttatgtaattgggttttataaatttagctgtttaggaagctgtgcataacacactccatttactgtgtgctgtagccaataaaagcataatagaaagaaatatagtttgaagctcacttcaatggtaaatatagattagttgtaaatgatatctttgtaatgtttattttaaattttgcagtgctgcagattttctgaacataccaattaatgttcttatttgaaataatgactagttaattactataaattctaagtgctccatctctgacaattaaaaattgtcttacagctttttatttatttatttattttttttagatctttccaaattatattaagtgcagcatctggggaaagaagaatgggaatggaaggagtgtgtttaaaatgtgggtggttttgtcaattcctattgggaatgcttgtatttgaatgtatatacatatgcatatttatgtgtaatgtctatttcatgctaaatagggagtgatcaagttgaaaaataagaaatgctgtttgaatttttaaaataggttataaattataacatgaaaatcaaatacaatgggtaaaaccagtaaattttaaataagtttacatttgttgtcgtgatgtgactgtgacgttacctgagatctcagcaaggagctctgcagcccgaaaagaccaactggaatgatttgatcagaaagggaatgggtattaggctgctccactgatactttatccacttcgggagagagagccctgttccttcttcatctagctcaagccaactgtcagaaatgcatgtcagagctacacaattctatccaaggcattaactgttgtcaagtctgttttttatgaatatgtttcaatataagaaattgtcttaggcccaaagtgaaacgtcttcctccttgactcatagcaagctcatgcaggtatttgaacattgttctgtataatatgtgcacctttgagaaatcccatgattcttgctattctttgtaaatctaataccttccatccagagagagagtatacatgtggagtcaattgggagtaccttttgtatcctctagtctgagccttacaggttaaaggagaatgttggatttgcttttgaaagtatgggcttgcggagattaaaaaaaaaaaaaaagaaaccttgaataatcatgtacaaatataaatactgtatgtagaataagtgtaatggatcacatttatgatgaaatatgtatgtctttccaagggtaagaccttcataattcatttataagttaccttctttctcttacatgtaagtagcagaatagtaattttcttcgttctttctgaagaattgccacacagggaatgaaaagaagaaaggataaacttttcttaaacagcagaatgttattcagagataactggaaaaaagtacgagaaaagccaaaaagaaaaaaaaaaattgtgggtcctggtgatgttggaaaaatgacgtgtgagctgaagttccagacgccgagcttcatctattttgtcatgttatgacagaaatcattacaagggtgataggtttatttataaagacttgcttcaatattcaaagtacatctattctagcattcctcattttgagccaggctgtggatcaagatgaaagaaaaattaaattgtatattgaagagctcttaattgagccatgctgtatttaacagggaagcatcggcttcaggcagtcgataccactgaggatttttaatgccctgcatcatgagactgtcagtttgctttggagaatgcaaacaggctaatgacaaagccctgcaaacttttgtagttgctgctggtctctttggaaggcaagtgctaatttacccacagttgaaacctgacacacacacgcgcgtgcacacacacagacacacactctctctctctttctctgtctctctctctttctctgtctctcataaggaactaaatcctgcgttttctcaccagagggctaatgacacactgcttagtcacccaaaacctgtttcctaaggagccactttggggcttgtttaaagtttttaatgtaaggcattatataatattagatttcccctgtttttccttaatcaatgtaaattcaattgcatttcagagggtggccaagtggcatttcatcatctctaatatccatttaaaaatgttaggtctacccagttataattctccaaagtagcctatctgtggtttaatatgttatctacattctctaaggcagtgttaatttccttttgtagttaatctatcctactaccaaatttagtatatttatagttaaagattctgttaagagctaagtgatttaagtacatctgggataaagtggccttggctttaactatgaaacaaattttctttatttcattctcttcactgataaatccatagtaactggaggcatttttagaattgtgggcaatttcagcctctaaagtttgattaaagatacttcagatattcctactgagaggctagagggctgaaaggaatttattttgggttctggccctagtgcagctcagtggaagagaacagacattgtgagtttaattcccacgctgccaatttcccacgagtctagggtgggtgttacttctcaagaaggcgatggtagaaccgctggagacttcttatggctgtggcaggggactcacacgtcacaaggagtccagaggcatggctttgaagagctcttttcattcattcttccttttgttcacttgtacatcaaatacatgctgtgggcctactgtgtgctgagcactgatcttgtcaggttcttggggaagacttcattgctgaggtgacctttgagctgagtgtatgagtgcaagagagagcgatcacacctgggaactgcttaataaagtccccggcatcttgaagccacttgcagaccttggcagttgctgttgctcctgctgctgctgctgctgctgcattgtcaagactacattgatgtcttggaaatatagaaaaaagaggctgctggactgtgtgcttagaatcagtgtgctaactctgttaccaacaccgtagagaagtggttccagaaggaagagttcagggtgagaatgaataacggagtggctttgcagtgggaacctggctttgcagcacagctaggattggagaagatcttcccagcagggagaagaactcaaagaacatgcatgaagggaggaaggttgcaccagtgggagggaccagaatatggtgtggaaagaacgaggttcaaatccaggctctgtcattaactgcccctaccctctctgagctgagtttgttttggacactggagataatgcatgttaacatcctggtagctctatttatttgctaccatggtacataatcatgggagctctatttatttgaacatcttcttttgttattatttggtgtatttgggaaaggcatgtgggagcagcaagcaggtgagcatcctgtttggaatgcagggccgggaactgccctgcccagtccagcctcattccagaggctagcacctggcctcagctgtagagctgctgggagcatttcagctctctgcttctttggcagtctagtgctgtcacagaaggaaagctcactccatggaaaaggggggattgatttcttctctgagggcagaggctgatcaatctaggctggtaggaatagatgtaacctcagaggaaacaatttgcattggcgaaagcaagtcaatggccatccccaaattcaaaaggacagggaagtgtaatcctactgtgatccctaaagcatccaggccccaggaatggtggtgatttgccagggggaaatggaggaacaaccccttctttgactacctctgtagtttatattggattctgcaaagtcccatgaggactgatagatgggctgtgtctgcatttgaattttgtagctgaaatgtgggtgagttcacctaggtccccttcatgacaaggtggtgagaaacattttcttgttctacaaatctgaattaggtccacgaaagagggtatgcagcatagagaggaaccaaaaaggacgcaagatttaggatagatattgccccttgggaggcctgcctggtctgcccttgataactcatgaacagtctggtaatgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggctgtgctttaaagtcattcatggatctggctgggcccgatgcctcacacctgtaatcccagcaacttgggaggtgggcggatcactttaggtcagaagttcgagaccagcctggccaatatggtgaaactccatgtctactaataacacagattagtcaggtatggtgacgtgcacctgtaatcccagctactcgggagactgaggcacaaggattgcttgaaccgtggaggcagaggctgcagagagctgagatcatgccactgtactctagcctgggtgacagagcgagactgtatctcaaaaaaaaaaaaaaaaaaaaaatctttcagggatccaggctgacctcagcaccatctcttacatgtgcctctgttctttccctaatataagggagcatgggggattagtgtctggcttaagcacttccactcagaaatcttgcttctccccacaatccattggtgaaagcaaggcaatggtcatgccccaattcgaaagataagtgcagtcctactgtgtgccctaaagaattgaagatcaggatacttatgagcagcgctcacaactgccatagtggcaatgcgaatggcatctatttttaatgtgactgagaaaataattggtcagatattgcaggatttttgtgggggagagggtggaaaagaacttacagattaaaaaaagaactggcatagcacctagattttaaacagaaggaaaagatgacattggggaccagagacagaaatttcacttctgtgccatgacaaataccagggagatgtaattgcaaaatgaagctgcaaatgtcttacccagggaactaggtgacaacctgcttggcttcatgaagaaggaataatatccaattaggctaagtgtattcggtgcctgagtgacaagccctggagacctgagggcttctggggcccccagggcggtttcaggaggctgtctccagacctgtccggggtgtgagcatgtcacgctgtggcccgcgcctcccctgtacagctgcctctgctcttctaagcactgaaatgagaggtgtaacctgtgttccagagtctgcgcctcccagccactggggcaggggcacctggcccatcagacttaccttgcctcccctgctgcccatgccctgctgcctagggctgggctcatgactgggtccacatcagctccacattgcagactgaccccctggaccctcacgtctcaggatccctatctccctgtcagtgctttgtcacccaaagtcaccgcagctcctcttgagtgctttcaagatcagaccgaggggtcctagttcaagctaattcctacctgtgcgatcactagccaagtactgaacctctctgaacttcaattatctcatctgtaaaaggtgttggtttgtaattgttcctacctcttagggcttttgtgagagtttagatgataaaccaccaagcaacagtggctggcattctgtgcacaatcgaagtctgctgctgtcagctctgtggtcgctgtctgcactcccacccctgtcatcctccaagtctgatctcctcccgaagtctcttcctggacctcagccctcagggattgcacctccctctgaatatgctgtcccttctaatcatgccatttagccacactgcctagcactttcttttttgaatattcgtgtcccaggtccctgaaaaagttgctaagcctgctaaaagcaaggcaaggcctttctttctttgtaaccttaatgcccagcaacgctccattcagtttgaccctcagttggcttcatactttgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatattcaagcagctttacagagactaccatgagaatgggttaaattaagaggattgtctttgctgtttagccaatatgggccaaagttcagtggtttgagacatggcggggtttggtagtagatgtaggatattgctggggaaagagtgttagaggatggaagattgcatgatatttctggctttgctctttgactgtgtgctgtttgtaaaatcacttaagtcccatgggtcattttcttccccatatcaagcacctgctatgtatcaggtgttgtgctcacgtggtgttttatgcacagtgtttcctctttgttaatcctcatgatgattggtatggtttggctgtgtccccacccaaatctcattttgaactgtaatctccataatccctacgtgccaggtagggacctggtaggaggtgattggcccgtggtggcagtttccctcatgctgttctcgtgatagcacgtgagttctcgtgagatctgatagttttataaatggaagtttcccctggccttcattctctttcctgctgctttgcgaagaaggtgcttgcttctgctttgccttctgccatgattgtaagtttcctgaggcctccctagccatgcggaactgtgagtcaataaacctctttcctttatacattacccagtctcgggtagtatcttcatagcagtgcaaaaacggactaatacaggttgggcacggtggctcatgcctgtaatcccagcactttaggaggccgaggcagatggatcacttgaggtcaagagtttgagaccatcctggccaacatggtgaaaccctgcctctactaaaaatacaaaacagccgggtatggtggtgtgtgcctgtaatcccagctatttgggaccctgaggcaggagaatcgcttgaacctggaaggtggaggtttcagtgagccgagatcatgccactgcactctagcctgggtgattccatctcaaaaaaaaaaaaagagaaagaaaacagattaatacaatgatctgtgagatattgggactgttcttattcccatttcacagatgagccactaactggctcctggcaggacagtgaataaggggcacaacagagacacaaacacatcgctaaccaatggtctcatccgtcagccacactgcctgtctcagcatgggccctgtgtggaccattccatctcaatttgtttctgattcttgtcaattaaataagaacagctgaaaagtaaaataataaatatatacataaaaacaatggggggagtaataatgataatagatacaattttttggtctttataatccccagagcctggcttaattattttaaagtaaatcaacactttgaacacttgcaggttagaaaaccagtggactgatggatgcgttacagccattgtttccaagtgtattagtttctgctggccgctgtaacacattatcaccagtgtagcacctaaacaacacaaatgtattgtctttcagttctgtaagatagaagtcctacagggttctccttgggctaaaatgtagttgttggcatttctttctggaggctctgggggaaggtcgttccttggccttttcccatgacgctagaggctgacacattcctctgctatggcctcttcatttttcaaagccagcaagattgcatctctctgtctttcttttgtggtcacattttaccaggactcttctcctgcttttttttttctacctttagggatctttgtgatttcatttggcccacctagataaccagggtcctctccctatttatttttattttatttgtgagacagagctttgctttgttgcccagactggagtgcagtggcttgatcttggctcactgcaacttccgcctccagggttcaagcgattctcctgcctcagcctcctgagtacctgggaccacaggcacatgccaccatgccagctaatttttagtagagatggggtttcaccatgttggcgaggctggtctcaaactcctgacctcaagtgatctgcctgccttggcctcctaaactgccgggattacaggtgtgagccaccacacccagcccctctccctattttaatgcgaggtaattaacaaccttaatttcaccggtaacctgaattctcctttgccacgcagtctaccatattcacgggtttcagggattaggacctggacatctttggttgggaaatgggcatcattttgtctaccacaacgtgagagcccattgccctgcatccacagtcataaaagtctgttcccttcctccctgattcttcctaacttctcctgcctgccttgcaggatatgtggagttatcagttcctagcaccactggccaaagcgaggatagctgattgcactcctactttcctgctggtggaaacagcatgtatataggtacaactctggtgtggggaaaatgctaaagatataaagtagaaatagcctttgtgtgatgtgagcagcagaacaaaaatcgagggtgccaaataatcgtatgaagtggtgaactgcctaagatggaatattgctgttcctaaatcctggctgtgttgagacatgtgatcctgccgatgagatgagagctgaaccactctcttctcccagatgctgggcttccgaccttaatagagaccgagaaacttaacagagggctcagaagagaaatctattgaaagttactaggtgccaggtgtctcggaaagtgtttaacacatgcctgagacgttaaaggcaagattcatgcattctttcagcagacagtttcttcacttaccggggaagggggtgtaatatatgggggtatagggataaataattctgtgtgctgtgcaggccgtggagactcatcttctgcacaggtcaagttctgaagtcagcatataagctggaagtggagtgaagtcaaatgaccctcaaagatccttccagacttcatgcccttggcaactcagtttggacactcatatgctggtttcttccttgtatttatgcagcagcctccttttccacaaaaagcagaggccaacgtatctcaccccctcaatttttttactttccctctccctccctgtgcttgcctttcttttcttttcttttttctttttaagacaggctctcactcttgtcacccaggctagaatgcagtggtgcaatcacagctcactgcagcctgtaactcccagactgaagcgatcctcctgcctcagcctcccgagtagcttgtactgcagatgtgtgtcaccatacctggctgatttatacttatatttatgtatgtgcatgtgtgtttatatatatatatttgtagaaatgggattttgccatgtttcccaggctgggctcaaactcctgggtttaagcagtcctcctccagcctcccaaagtgctgggattacaagcctgagccaccatgcctggcctttgcttgcctttcttaatgtctttgacaattcatgtaaatgtgtgtatgatgtaactctataggactaagggtgtgtgaggatgccaggaggctgttggttgacaggagtcatgatttgactatatgaggtcacagaaaatgctttttaaaatttaccgccaacccacaggaaaactattctccttcttctaaggaaaaaaaaaatgtcacgataaagcagctacattaatgacaggcacatcaaggttttaacgtgttctctagatttatgatgtgtagcgtggtctccattctagaaagcaaagtagggaaagcacgactttggggccagggccctttctggttcagaatgtccctggccagtgtgcgccgtgcagtgtggaagcacgcttcggtgcgcatgtaagtttacgtgctatctgtagggacagtgatttttattcattagagtttttgagtctaattgtttttaaactgccacttttgtttgttaaagatacagatgtctggccatagaggaaagcaaggtggatttatcgttgcaattagatgcttcacaatttgaaaacttatcacttaaattggtgaaatgtcacttttatgcaacttgatgtttagaagtccttggcgtccaggactaaagtcatgtgcaatttaacaagatcttggtgagataaaggaagttgcgcttgaggaaacattgaaacacaccagatggaattttccaattccctcctacatgatagagactaggtgaagggagatagaccacaaattgattttgtgtaactcttaaattaagtggagcagagttaaaaaaaaaaaatcactggatttgaagttggcctatgttagattactccaaggaagttagttaatatgttaatatgaatctagatgaacattgagtgttttgctcttcttgttaatttgcgccatctactaatctctggacaatggagaaaaagtcgtaggttatgagttttttatttatggacattaagcaatatctttaaaatgtaaaatgaagccgacaaaatgcacagccagataacaacaacaaatctaatctaaagtgacaggaagagactctcccagacatttttctctttaatgtaacatgactttaaattgatgcaaccccacagtgattgaaaaactctcagagcttgtctcctatgattacatttctgatctgtacaacttaattttttaactcggtgagtctcagttttgcgaatgaacagttctcttttgctttctctctcatattatttgggaagacattatttggcaaccaggcagataaagctctgttaccacgacgaatactgagaagtcctaaaacaataaagaccccaagaactcaccctggaatatgtacctccaaatctcttctcttttccttctctccttctctttgtttttctttctcttcctgttctcttgttttatcttgacttctctcgactgtggtgacggtttgcatatatctgcgattgtactgaaacttaccaaacattgtacgttttaaatgggcaaaatgtatttgaactatatatatcacaataaagctataatactcttttaaagtgtctcctgaatcattaccagtataattattctgtgaactgtattttgatgaattcagaattaatttaaaatggattatccccctgtagaatgggaggtaatgctgaatgattgtgaatgattgtgaatgtttgtttattcggggtactccctcaaatttcttatccagtggtgtctagaacatgttgggattttgtgtgatagtttcttgagttggaaattgcgtttctttggcctcccatgtgggtatcaatgagttttacatggtttaaaggccagttatgtgatggatacttctattaccttatgtctttctgatttcatacacttaaatgtacagtttttatcttccttcaaaaccttatttttccgagcaagttttatttattcactttcagtcattactgaagtgaataacaaacatataacaatgctattttgggtcatagctgttttgctaagtaatacttaaaggctttctgactatatttttaatttctcgacagtctcccatggttattttctgatcataacttgaaaatcaaagctttctgttcagtttaaccatcttttaaaacccagtggttttagcttgggtattaacctttaacatagctagcgaaaattgaacatttttatttgaaatatgcttaatgttgtcttgtgtaagacaaaaagtttagggacaagtgaaccatttacttttcttttaatgtggaaagcagtttacaaatgctggtatgactaacaagaatgaaaggaccagaatggcagttctgagctagaatgtgatgagtaagtaccaccatagttagcggctagggaagggaggttgttctacagagaaacatgcccatcatttcttctgttacctggtattcactctggcaatttctttttggactcattctaaaatcaggattaaggatatccactgagaagcttgcatttattactctaagcaagaaacttctatttaattttttaaccatttgattcatatgtatttagattttaaaatttcattttctcttatccaaatgtatcatatatctttaagtaggtgaatcttggagtagattttattatatatcacatcacagagttaagctcggttcatctggattttaaaaatctctacagctttgagaatgactttgaaacactctttactgttggagcttaaagaaaataaatctctaatgtcctctgtattaattcacctgcttggaaagttagagattaaaaggtttagtaggatttttatattttctataatttctatttgtattggagtaaactgttcgttgtatggagtggcttagctttcataaaacagaaagattcctatattgagaaaagaggaagaaggaaaaagtgtaatataaatacataaaacttcctctagctttcttgtgttatgtgtaaaggagttagtacgttactttaattgtgtactttgaagaaagcaatctcctatttccattaatggtggactctgtgggtagagacatggatatttttccttttataagaaaggtcttgtctttcctcagaaggcattgtgagcaaaataagggaagaaaaagagaagtagataagaaaaacaaatcacaatattgaagcaggacccgagtactatagccttcctcatattttggtatctggaaccgaggttgctaattaatgacccaagagctaagccttgtttgatgaaatgcaagatgtaatacacagattgccttggagtgatgtgtgattattaccatccattcatgtgtaatcccgtatttggaaggtttgtaatttgtttttgacacatttctctctgattttatacactcatgcatacaggtctcacctccctccaaaaccttatttccaaagcagactttgtttgtttggtttgggtaattcattgggccctatttgtcttccttatacataatctattttcttactgctgcctctgtcttccaaaccaagaatataaagaatgaagcctggggactggaacttaaaacttctgccgagaaaagaaagtcaaggcctgtgggctcctaaaacatcctgtggaattcgcctcagatgcccctccatttgcactggtatatggaggatgtttgaaaaccaccagaacctattgtgtactttggaacaatggcattttcctgcttgattgtgaagatggccgctggaaaagaagccaactcccagggggcacgaggggctaagctgtctcctgggaagtttgagggaggccaagtgttttccagttcatttccaacgcgtatttcttcagggccaagggcccagctgtgcctcattaggggtgagagtttggctgtgacacgacttaatagaaaaaaaaaaaaaaaaggagaagtccaactagctgagtggcaacagaacttgggacaacctgtgcccacagcctttcatgtcctgtaatgagtgtgccatttgctcactgggaggagaaaaaaatgacagtatgcaacagtcaactttttcctgaagaaagagagaaaaaaatacatattttgcagccgagacatcggggtacctgttaactttaggcacagcgctagtgtcagccctggaaagagactccctgtgaacagcactttttaccatttaatcagcctgtacttcttcgtatttatagccctggcgaggctggcccattgttacaagaggaaattgtgatgttcagcagtttataccttgggagctggaagcgtttctccatggtgaatttgtaatattaattggccatgtcagttcatgacaaatgtagtgacatctatttcaagtatttcagttttatggtgctgaagaagtgacacgcgctccagataagtaatctcacaaaagatcttcccgctcgctgtggagcgcctccagaacatgctctcagaggagatgcaaataggctcagggttcagggggctgtccccttccttttgctcaaggctcagaggggagccagaggaatgcagggagggacgcactccctgtcattcccctttcagtctcaggagattctggttgaagctctggcatggactttcctgcccaagaagtgtccttgcggtgatcatttatgtgatttgggtacctgctgcttgtaggctgtgactgtcagtagcagaaataaatatattgcctttctcactgtgtacagtggtgctgtaccaagggtgactctgcccatcaagggacacttgtctggagatatttgggttgtcatatcttggaggagaataggctgctattagcatctagtgggtaagagcaagggatgctgtagaacttcctacaatgcacaggcgcatcctacaacagagaattgtctggccccaaaagtcaatagtgctgaggctgagaaaccctgcacttgtgtggaccatgcccttttatgcttttcaaccttgaagcactaataggtcagagaagaatgccagggatgtgttgatgggtctgcaagaggttgatgggggatgcttgagctcctaccaagtggaaggtggtgtaggcaaagagaaggatgcataggcacattggacggtggaaggcaggggctgctgaatgatgtggcaggaaacatgcaaagtgctcagcgtccctgggcggtgcagagtcttgggaagcaagaggatggagccatcctttcagtttccagcctgggtttcccaaaggagagggtgtttgagttcagtggcagagagagtggggaagagtgttggagcccagctgagtggccacctttgtcaaatggagctgagaaatgattttcacatggctggcgtaatggcggagtttccaaaacagcagcacaacaaaatagccatttacatgtcaagactatattcatagaatccatatgtctaaggtggggaagttgtcattattcctgttttatagatgaggaaacagaggcccagatggagtaagtgactgctgaagtacacatgatttgtcagtagaaaggaagagaccaaaggtggcatcaactttatctttccttcttttttttgagactggagtcttgctctgttgcccaggcaggaatgcagtggggtgatctcagctcattgcaagctccgtctcctgggttcacaccattttcctgcctcagcctcccaagtagctgggactacaggcacccgccaccaagcccagctaattttttgtaattttagtagagatggggtttcaccacgttagccaggatggtctctatctcctgacctcgtgatccgcctgcctcggcctcccaaagtgctgggattacaggtgtgagccaccacgtccggcctgtttttccttctttgttaagtggaacaagtcatttttttggtggtcatttccaatatgtaattcctgataacacacgtatatattatctctttaaaaattaaaaaaaaaaaagccagccaaaaaaagaaaatggaagtgttcaagaaactgccttttttcatgtaatagtatttctgtgtcactaaatccttcaacagcattatttttaatagctgcccaatgtcctaatggatgggtgagtcatgatttacttaaccaatcccctgttgttggacatacaggttattcacagcttttctctattgtaagtggaattgcaatgaatgtttttgtagtacacaccagtgagtgattccttggtgcgcttggaagtgctggttccaagaataagataaggctttgagattaattgccaaattgctttcttgaaatattgaggctactattttccagtatcttcactaggaataagtaacgtttttctaaagctgagtagtaagagaaaggtagaatctaattttactgtgcattttcttgattattagtgaagctaaacattattttttattgatgtgttaacaatttctttcttttgcaaatgatctattaatgttctgtgactgatttctatcttggtgtctttacgtttgtgaatggtaagaatttttatgtgttcaggaactatttaaatgttcaagacattaacctgtggttatgtatatcacaggtacagtcacatcgcttaacaagggagatacattctgaaaaatgtattgtcggaattctgtcattgcatgaagatcatagagtgtatttacacgagcctagatggatagcctactacacatccaggctatatggtatagcctcttcctccagggctatgaacctgtatagtatattactgtaatgaatagtgtaagcagttgtaatacaatgggacatatttgtgcatctaaacacacctaaacatagaaaaggtacagtgaaaatatggtattataatctgatgggatcggcattgtgtacatagttcgttattgactgaaatgttggtatgaggtgtatgactatgttttctcatgacctctgctttttttgtctttaagtttttaatttttgttttacttttgtcttttaattttaattctattgcaaccaaatctatcagcctgtcttctatgatctctgcttttaattgttacgctttaaaaatccttctccatggtaacattatattgactcatatgtcttactggttgaacgtgcctatgtttgactttgaaatcattaaattcattgaggatttgttttgccatgaggaattgggtaaggatccagctgattttctccagatgagtagttcattgtcccaacaccagttattgcaataagttattccttccccaggaaatatacctgggctaattaagaaaactgtgcttcaatgtaattattccaccttaatgcatgaaatattaggttaacatggaaaaaacatggcatcccatgttttagtattttttccttatttccaagcagcacctctctttgaattatattctgttctctgtttttataatttgactcccttctattctacatctaaatagtgcattgtctgttttcactcaggactttaaaaatagttctagtactaattgtatttttattctaatactgctattccttttactggtacttctgcatcttaaaaaaacaaaacaaaacaacgaaaacttggcatgttggctcacttggtgaatgaaagcatatactgttcagttgtttattcttcagcaacatctgagtatcctcgagaaatgagtggaatgaaccgctagagatgaatagccttaagccctcaaagctgagccctttggggtaacttgctctaattctgccctctccagtttgagtttaggttaaattcagcttgcagattgcaccaagcctgatgcctcccagccatcaaggaaaagggtacctaacattttgaatctccattaatcttacagctcagatcctgtgtattaaatctcagcattttcagggatgtatactctggcagaaaaactttaatgattttttttttctgatgctgcctagaaaatattagaaagaagacccttctttcctttcctttcttgtcctgtcctgtcctgtcctgtcctgtcttccctccctccctccctccctcccttccttccttccttctctccttctcctcctcctcctctccttttcttttcttttcctttccttcttcttcctttcttcctttatttctttcttcctgtattattttcttgtatagctcaggtctcactgctttgctgccattcttgtggagaataataggtaacagaggtgtgcacctggcctcatttattgtcacactggataggtaatagacgccggcatggctatgctgtggttcctgctgatgggcacactattacaggtgcatgataagtgtgtcgtacgcaggaagtacgtttcccccagccttccctacctgctgagggctgctcccagcctaaggatttcatccagatagattcatagcgcttccagtaaatgcaccccttgcctttcaaagttgaaaaagaaattactttggacacaaagaggtgtttcttttgacacagcaggcatgtgaaaaaataagcaaaaaaacaagagggatttctgttaccattggcatgtgcttctcttttacttctttagttcacaatgccagtggttcagcttcccgttctgatcctcactgctctaatctcttcatctgtgcttgcaatcacagccacgcgggctcgcaatattaccacgaaatcattttatctgttggaatctctttcctgttcattactcttttttatccccaggtagacaaacaccctaagtttacctcttgcgaattgtacgctttaaggttaaggaattcgtagttgaataagaatgacttttcacataaatttaatggagttttatcttctgagccaaggctttatttaaggagtcttgggaggtaatcatgtgttacctgagactctccgcccataggatgtagttcctttccattggaacacatggggaccgagggaataaagaatgttttcatctctgaaaatatctctcattcttccaatcaatgctgctcttttcttgcatactgtatactgggaagcatttgtttcgatttgtggttaaatgtatgtgtccactggacttcagtatccaccctttgaaggaccgcaggagaagttgttcaggtagaaacatacaagggccggatgcggtggctcacacctgtaatcccagcactttgggaggcctaggcgggtggatcacttgaggcctggagtttgagaccagcctggctaacatggtgaaaccctgtctctactaaaaatacaaaaattagccaggtgcggtggcgcaaacctgtaatcccagctacttgggaggctgaggcaggagaatcgcttgaactcgggaggcggaggttgcagtgagtcgagtcgtgtcagtgcactccagcctgggtgacagagcgaaactctgtctcaaaaaacaaacaaaaagaaacataccgggagatctggttctattgaaccccagtgcagccatgggtagaattttaggcttatttatattccatttcaccacaagatgtcaccagggcaccacaccaacatggtctatggaccctctctctggcaaatagagttatggtcatcaaacagcacctgcccagggctatggggagaggaagctggttggctttgtcacaaatgccttgatgtctctttcctcccctggggcccatctcttccagcctttgcatagagagagaaggcaggcaacaggacacaagaagattttcccagagtccagggtgttctcttacccctgaaatcgtttcttcactggatgggaaggcaggcacccagggggagatggcatcagctgcataaacaatttttctcctcagtagacatttacatgagtcaataggaatcatattctctctttttttttttttttttttttggagatggtctcactctgttacccaggctggaatgcagtggtgtgatctcagctcactgcagccttgacctcctgggttcaagagatcctcccacctcagcctcctgagcagctgggaccacaggtgcttgccaccatgcccaactaacttttgtattttttgtagagacagggtttcaccacattgcccaggcaggtctcaaactcccgggctcaagcgatcctcccaccttggcctcccaaagtgctgggattacaggtgtgagccactgtatctggcctaggaatcatattctcttcactgaaacatttcagatgacttaaaaattcaccttgtagaacttttaaaattgaaactttctggtgaacatcattagttgacagatatgtcattgaagtttcatccttcttcatttcagagtctgctggaagacccttcatttaccactctctccttcctggaggtgtggaaatactctacctgggtgaggctctcgtggctttttgtgccaagtgtccgtaaacttcaacttaattgttttaaatcctttgtggtgattatgcggaaggtcaaatctaacaggaagctccatgtccacttgatgtgtacttacttctatttttgcaccttgtgttgtttgttatcctgaattatgccagggctggtttgtgctaagatacttgttatttgacctcataataccagcatgtcccgtttgtataaccctctctgtagcttcttccagcatgtgatcatacatctacctaacctctcccattggttgaatttaatatactagtgaattttccattgcaaagatgaggttacgaatcatagtgttcatactcagaaggactttataaatattttgcctttttgaagtatatacaagaaatgaaaaaaaaaacaggaataaataaaaagaataaaaagagccaggactagaacctacaattcctgactcttgatcaaattgcttttctttttaactctagttaaatattttccattctttttaactcaagaagcctttgtttttgttgtcatcgttttatgattaacttatatctggtcctttagacatttagattttttctgttttatctctctctatatgtatatctgtatatatatttatctatatctatatagagatatatatatatatataaaataatgaatgaaatggactgtttgcaacctcagatgtatttctaggacttagagtgattagcttgaggcgatggtagtttctgtttttggagtctctgtaggtctcagactcacagtctgtacttcttgttttgggggctaattaagtggacagtttcagtgttggtagctcatttaagccataaacatgcagaccatgtggaatcccattagtcaaaccttagcagagtgccttgatgagtacctccttttctttctgaattctattagttgatgctttgttctttctccccaagagccatatctcagctatttcttttcatttcttgtgtatagttcaacatctttctttctttttttttctaaacaggatctcactctgtcacccaggctggagtgcagtggcatgaccatggctcactgcagcctcgacctctggggctcaagcgatccttctgcaacagcctccctagtagctgggactacaggtgcatgccaccacacccagctaatttttatattttttgtggagatggggttttaccatgttgcctaggctggtctcgatctcctgggctctagcaatcctcccacctcggcctcccaaagtgttgggattacaggcgtgagctaccgtgcccgtgcccggccttacgtttcagcatctttcaatccatctaatacgcagtgccagggaaggtttgtgaaaacatttgaatcacagagtcacaaacagtgagaatagctgcagttatgtttgtgatgctctaatgaacttacaaaaggccaggcctagtatttcagctgtgtccatgatgtctctgatggaaatggacaggtaacatgatgtacacaagcatttgactgttgcatcctttgattgggccatgttcatgcagccagcctgggaaagcaattagtagttttaagcatgggaaatcatataaaagtaaactaaaattgcatttgaattaattgatgaacatgtttgcttgaccatatcctgctgttaggcgtcttcaagttaacttaagtggttgataaaactttccaaaaagaatactatcaactgctgagcacctgttgtcagagttgtgggtaattcgcaaaggttttcaaatggaaaagttgttttctcctgctaggaagcatggtctcagatccacttctaaggtcagtgtgaaagggaaggcaaattcactttgagcaggggaggcatgatctggaagataaagcagctaggagtatagactagggggctgatggaggggaacacctatcacaatatgtgttctcacaccaatggtatatattttccacacatttagattctccatgccactccttatctctttagtgcagaaaacggagaggaggttcagtattcttaagaaactcccatgattgctttgaggcaatggatttaacaggtatctttatcccttatttacgcactgactgtggtactgagtcatccctggtgtttctggattttattggcaatgccaagagagcaggaagactgggacgtgaactgacaacatttatgattctggcagcttgacatcacccaactgttctctttgtttggttttgcttcagacttagtttagttttgttttttaagggctggggtggaggagagggatttgctcttgcagttttcctttcaaaccaaactctttcaaagccttttgcaaactcttttatggattttactcactggttgagcaagagttacttatgagatgtggcttcggcattttcacagtgtccataaaaaaatgtatattactatgcattgcacatttgccacttagaatttctgaatgcaaattaatcaacttgcagctgtgactaacaataaaacacaggataatgtacctacagaaatgagggcattggaaatccgctctcaggtggccatcgaaaatagtcagcctgagtgttgctacctgttttccataattgtgtagctttgcctttccttagttaatctgttcaataaactcctctgcagaatccaaatgcttaaattcagtttctttttgtctttatggtgtttttcattgttaacgtggcatcggagtagctcgacttttgcatcatgataaattcataacccaagagaaggcagaaaacataattattatcaattgcctctctcctggaattgccattggctgagtggaacaaaatacgaacttaaggagtagctgattcagagaaatccagggtaggaacgggtcccatcttgatttcaatgtcttttttgaggaggccttcccattgcacttctcttcaagtttgcccagatagtaagttctactagacatgtcaattttttctgaggtctaatcttgattttttttttcctgcacaatatggaattcagtgtttttatttaatcattcagtaagtcttgactgcctgctatggaggttaagccctttactaagttccaaggatgtacctgtgaataaggcaagttcctttttatcattgtctttgcagtctattaggggctacacaatttaaacagagaatatatataaaatggtagaaagtacaagtaagtataccttattttttttaaaaaaatgaatgtggtatttcacccacagcctcaagaatcactttccttaaaattgccagagtaggaaaacttacaattgaagaatttcaggtatttatgggaaaaatagtattagggcaattgcggtcaaacacattcgtctgttcgttcaattacagcagtaaggatggaagtctaaagagagtttctacgtgatcttatttatcctgcatttataaatacacaaattcttgtacaattaactcagtttttcactcctttcttgcttgcaacttgtcaggtcgttccctccccagtagttgtgaacttctttatgctagcttcttccatcaggggctcacaaccagggactgtagaggtttgcagaggtaaatcttggtagataaggattttatgaaaagggagctcactgttggtgaaaaatccttgtttctacagattttgggtcaagataagaaaaattaacttttaaaatctgaggaatttggagattatctccaggggctgaatatatttttatgggagaaataaaatggatagttttaaacttgaatttagtttttcctaatggaggcccttttgaagatcaaatgggatctgtaaaaactctttgaaaaatgtagactgcttcttatgtgattcttactggtctattatttatcaagaaattaaaaaggaatgaatatctgtagctgtttttctttttctttcttttcttttctttttttttaagatggagtctcgctctgtcaccgggctggagtgcagtggtgctatttcggctaactgcaatctctgcctcctgggttcaagcaattctcctgcctcagcctcccaagttgctgggactacaggcgtgcgccaccatgcccagctaatttgtaattgtttgtttctaaaaggatattcagtgcttccactgtcttttagaagtctgtagaaggaaggccaagaaagaaatacccattattttggctgaagatgatcactttagctgaaaccagttcaggttcaaactcagacattggtgctattttcatatatctgaaatgttctgaaaagattactgacgatcaacatgctgaactgacatttcacagatatgcagatttattcatctctgttcaaggtatgccttttccaatcataatagccacgtagaggacattaaacaaatattttattgtggtaaaaacacttaacatgagacctacccttttaacaaatttttaaatatataatttattattattgttgactataggtaaaacaggacatttttaacgtgctgtggtggcctattggactttcagcctccctgggtgtatttcgctgtatatgtgtaccatgtcagcttaccctagaatttgaaacattttcctttgatgattaaattttttttttttttttttttgagatggagtcttgctcttttgcccaggctggagtgcactatcgcgatctcggctcattgcaagctccgcctcccgggttcatgccattcttctgcctcagcctcccgagtagctgggactacaggcgcctgccactacacctggctaatttttttgtagttttagtagggatggggtttcaccgtgttagccaggatggtctagatctcctgacctggtgatccgcctgtcttggcctcccaaagtgctaggattacaggcgtgagccaccgtgcctggcctgatgattcagtttttaccccaagatgcagtatgcctcagtctcactaaaatatgccaatatgttcttcttcttgaggatcagggctgatttcttctactgggaaaatgtatcccctgtgtttggccccagaggcatcagggtaacctgctctcttccattctcaaagcagaaacagtgttcctaacattctaagcctgggaataggatggcaggtcgtgggaccagcattttaattacctaaagggaacttattgattttagtccagaacacggtggggaggagttcatattcttttttttttttgagtctggattttagaataaattcactgtgtacatagctattccatctttaaaaacctttgtgaatgttaatatacagcctttataaatttgaggtataatgttcaaaatgctctaatccctaaattttccagtctaggttattatacttttatgactattcattttgatgtaggccttttaaaatcaattcctccctgttattacaatgctgctttatggtatttgtgatatatcatatgaatatacttgagggtcatgagaagttcatatgtgtgtgtgtagtgtgggccccagactttcgccataccgctggctaaagtggccatgtttttgtacgtctctgcagagcttacaagttattcaacagccagatttctattctgatatgcccttttagttttcaaagcatcgaaaaagggtaatctttagaaccgaagtatttggaaaactcctagacttgaataaggtatttttgaatttgaagagctaagaacccatcaaatcaaaatgctaataattcttccaagtcaaaaggtaactctcattttattatgcattgaccaccattcactttctgttggactgcttttggaaaaagaaccacaagtctctatttttaaaatagaggtacaatgataaaacaaaacaaaacaaaacaaaaaaacaacaaaaaaaaacccacacaggtctcatcagccaagggatttaaaaatcaaatttaacttcaaaaaactgaagttgatatagcaggatcttggagatgcagtttcttcacttttcttttttttctaactgagggattaaggatataaacccaacttcaaatttctttctgggtggtcttgaaaacttaacagtaggtcctgtaaagaggtgggggagaggaaaaagaaatcctttactctcatctgctggttttaaaatgagaaaaatacacacacacacgtaatgatgttcgtgatgttaatggagggaaatatcataaataattaagaatttaaaattattataaaatatttagtattattgttgttactgttattagtaggaaggggccttgccatgcttcctttcttcaaacagctcagtactttaaaatcgagtgtggctgtgtttgtcagtcgtggtttgtgttctttgatttgttctgcatgttcttcttttggagaggatgtgtcactttgccaatcttggtccttgctgttgtctggtggagggaaacaagcctgccaggccggctcatctgacccctggtggcagggagtggaggtgcactcaggatgctcttggggaatcataaaggaggttaaagaaagggacagcagaaccctgacaatccttgcccctaagcatggaaaagcctccggaccgggtctggagtgcaacagaggcccctgaccttgtctctagctctctgtctgcatcttcagcgtggcttcactggtttctaagtctctggtgtcttttgtcttttgcagccggcttgcaattgcctccttctaactctcaaaaggatgcatgggatgggttcagtgtagtcactgttgtgccttttggacaaggctttccagccaggccaccctgtttacaaggctgtcctcacgtcatgggcgctcatattgtccagactagatggtcaaggtgattgggggaaggaagtcacagagccaccaattactaaggaactgcccagagatcctgcctcactgggaacctgtgagtgggctggtttcccccagcagaggggctgtagcatagcaggtacccacaggagcctgggcatggcctttttctctaaagggctggatagtcaatatttttagctttgtgggctttatggtctctgttgcaacttctcaactctcctgttacagcaggaaagcagccacagataatatataaatggacggatgtgttccaataaaactttatttataggaacaggcagtgggccagattcagcccgtgggccataggttgccagcctctgactctggtgttcagatcacagactttggatgtctcatatctgaatctttctaatctcgtgatagggcaaggtaattaaaatgttaatacgttagttttctcactgtcaatgtgttctatgacatcatttatgcaaagcatacaaagctgagaataaagtctcagcaaatgctagtttcctggcctccttatacatacttacaaaggatggtgggagatagtttgagatttgaggcctctgaagaataggtgtttttgtgatgattttggcttttcagtttgacagttggctttgcttttttgacagacacattaagagcttcaagggtcatttcatggtttgtcctttccatgtcagggacacctttcacgtggccattttaagcacaggaattgccttcaagtagtttactcgtacgaacttgtctgtaatcatctttccccatttggatggtgggttgcccattttaattcaaggtttgtctaatgtgttagtgcatattcttggctcaagcaggataagacactagtaaccatgaacctgtatatcaaaaagcgtgactagagtttcatagttaaacatgtgctgaaatccacagtggacaccagagagggtcatggaatctgggaatggatgacttgtcccatgatgataatatctgtgttcctacggctgggcccggtggctcacacctgtaatcccagcactttgggaggccgagatgggaggatcacgaggtcaggagttgaagaccaccttgatcaatatggtgaaaccctatctctactaaaaatacaaaagttagccggtgtggtggtgcatgcctgtaatcccagctactcaggaggctgaggcaggagaatcacttgaacccaggaggcggaggttgcagtgagccgagatcacgccattgcactccagcctgggtgacagagtgagactccgtctcaaaaaaaaaaaaaaaaaaaaaaatctgtgttcttgcctggcttattgagctccatggtaaatgttcagaggctgcaggaatgattcaaagtctgactgatttatgtgcattgggcattttgttgatgtcattcagattaatgatggcactgaaaatgtgtaatggaaatgagaagtttgtatcctgcctgctataccatgattccaatttaagagggggtaaaaatattgcactttttaatctattgttttttgaaagagactgtttaaaacacgtaattttgctaagttatggctcatatcgtatttgttattttggttttgaaaaattgagtaggaagcaattgcgttcttaaatgacttgaacatcaaaggcaagtagtgtcttgttttaggagcagccaggctcctatccctctgatccagccaagtgctttcacttggtcccactctggggaatcaccagtggttctcactctgggagaggcccctggttgacctggaatgacctagaccagcagtcacaagctcctgcccatggacaaaatacagccggtacctctttggctatggcctgcaggctcagaatagttcttacattttcaatcatctgcaaaaaagaataaagaggagaatattatttcttgaaggaggaaaatgatatggaattctgatttcagtgtcataaagttttgaatttcatcaataaaaaatttgcagaaatttgtttttctctcctgttatgtaaatacctctgtaatagcctcggttttgcctcttggctcacaaagcctaagttgtttactatttagccctttacaaaaaaagtttgccagcatctgatgtccaacaacaattttcagtcttttttgtagctcccaaattctctcattaaaccagatcccttgagggaagcctggtttacaaaatagattaagtgatgtggctgtttggagcaggaggctgtggtctgagtcttgctggcctcaaccctcaactcacttccacaccttacctcctggggataaggctgccttcgtctagaaagtgcctcggttccagcttggaaatatccatgtacagtcccttttttgttattccaaaacccaaagagatctgaaaagcaaaaacaaatttattgtatatttatagcaaatttatttggtggtgaaatttgacttcagctttagcgtccctgtttctcctttctagtgtgaatgttcattttgttttgtttgtttttttgaggcaaggtctcacttcatcacccaggctggagtgcagtagtgtgttcacagctcagagaagcctcgacctcccgggctcaggcgatcttcctgctgtagcctcccaagtagctgggactccaggcatgtgccaccatacccagccaatttttgtgtctttgtagagatgcggtttctctaccatgttggccaggctgaataatcatattttcactgaagaaatagaaatgtcattgttataggatgttgccccaaaccccgcaaaggtattttgtaatatgcagtatatgtgctaaattactttttttgttgttgttgagatggagtttcgctcttgttgcccaggctggagtgcagtggtgtgatcttggctcgccatgatctctacctcccaggttcaagcgattctcctgccgcagcctcccgagtagctgggattacagacatgtgccaccacacccggctaattttgtatttttagtagagatggggcttctccattttggtcaggctggtctcgaactccggacctcaggtgatctgcccaccttggcctcccaaagtgctgggattacagtacctggcccaaaatacctttctaacatggaggaattaggaatactgaaggcatcggcccccaagggtttgatgtgctcttgtccccaaggcctgcagatttgcatcacctctccacttcgtggactcctcgtacctgcctgattccaggatgctctaacctggccacgcatcccccgtggattctcagctgttgtgtgtttcctcctcaggtggccactgtgtctggtgctcacccacattttggttcatcctgactttgcctcagcctccccattctgcatttctcccacggcttctcccagccctggcccagtgacactgtaatgtggactgtggcatcccctgagtctaagctgttgaccagctcttgatggacagatgctggcagagatggggaaggtgctgttcccttcctcctgggaagggcaaagaaagcagggtggtcctcccatccccgtgaggaaggaagagcctcattcatgctgagaccctgatggagaactgggtccagggataatgttttgtgttcctgctcatgggactggtgtgttattgtcaagggatcttacaggccttgcttcccaggcccctctatcccctctgttcttgcttaggcattagtgatttggttcttctagctttttttctttttttgagacagggtctcgctttgtcatacaggctggagtgcagcagcgcgatcttggctcactgcaacctccgcctcctgggttcaagcaattctcctgtctcagtctcctgagtaggtgggtctacagtcacatgccaccacgtctggctagtttttgtattttttagtagagatagggtttcacttgttggccaggctggtctcgaactcctgacctcaggtgatccgccagtctcaacctcccaaaatgccgggattatagatgtgagccaccacaccaggctggctcttctagtttttgaagctcacttttcttttttcctcaagactcacagggaatgggaccaggcacctgtctttatacattctcaaagtccatggtgacgatgccatgctccggttctaagccagttggacagacacaggcaagggaagctgtcagtgtgggtgtgagttgcagtgtaagggtagtgggtggaatagcgtctccccaaaatccacacccacacagaatcacagatgtaacgttatatggaaacagggtctttgcagatgtaattagctaagaatctcaaggttaaatcattcaggctttagagtgggccctaaatccaatgacggttatcctcatgagaagaggaaagcagggggcacagtggtgggtgtgcctgcaatcccagctactcgggaggctgcggagggggcatcacttgagcccaggagttcattgccagcctgggcaatatagcaagaccccatctcttaaaaaaaaaataacaccaaaagacaaaacagaaaaaggaggagaggacacagaggagaaggctctgtgaagtcagaggcagagattggagtgatgcgtctacaagccaagagatgccacggtcatgggcagcccccagaaacgaggagagaaacctggcacggtttccacaaggagtcacccctgccaacaccttggtttcagacttctggtctcctgaactgtgagagtcagtttctgttgagcttgtgctgatacgctagggcagccctagcacactgccacatctggtttcccggaggaacttcacagggtctttgttctttatctacagtctctggaagtctcagcagcctcctgtgttcgcaactgtcattccagagcagccgtctcgtgttatgcatttgcttactcataagcaaatatttcacaagaacctgcgagggccaggctgggccaggcaggtattgcaggtgcaaggatctatataagacagtgccctttagaagatccctgtctcattgagaagcgttgagtaaatgggtctctctggtcattctctccagaacatgaagccaaagggctgagagggagagactccaagaatgaattagtgtccagcaaggtatcgcttgtctcaggatgacaacttgcaatttggggatctctcaacgtcctgacctccatctcagtgggcatgttcctcacctggctggctgcccctgcttactgatgcagcctcctgtcacacggtactcacctctattcactgtattccaccaacactggccttgggagccagcagtacccccattgtacagatgaaagtcttgtgactgtcaacattaaaatgagaatgatattgacccatgatacttacccacctgttcagtggattcggtgtgccgtcagcatggttcccagcacatagtaagtgctccgtaaatgtcagcatctattattatcatttgtgtttttttttccccttctctgccttcctttctctccctccttggtctgcttcctcctgttgctatcagagcctgcctgcctcatccttgttccagccttgatggtgatgatgattgtggttgctgttgctatttgtttttttggtttgtttgtttgttttgagagggagttttactcttgtcacccaggctggagtgcagtggcgccatctcggctcactgcagactcttcctcttgaagctggggaagttcaagcaattctcctgccttaggctcctgagtggctgggactacaggcatgtgctaccatgcctggctaattctttgtagttttagtagagatggggtttcagcatgttgtccaggctggtcttgaactcctcagctcaaatgatctgcccacctcggcttcccaaagtgttgggattacaggcgtgaaccaccacgcccctcacgcgcagccactgttgctattgatgattattatgacatcattgctcagattcacttggctcagagagggcggagtcagagtgacccaggtggtcactgctccccttcttgtccatcaaatcagctgcctccaacagcattgcctggcagcgtcacgtagtagccctctccctcacaaggcttttgaggcagacaaatgccactgataaagcaaaagcaaatgttttgggtgaattccccatagctacactagatttgaggctgagaaatggaatgcctgtcattgttgactgaaaaatacagctctcctaatagagtcttggtgcaggagctgttagccttgccgccctgcagacttgaagaattgcgacgtcggcctaacataattttggtaactttgtctgcttctgcctcgggtagaaataattcagatttcactctccattttctttaatgggctaaacagccactttgtaatacctgtattttattagacataattctggatattgtttctgcagcgtttttgaaaagacaaacctgagagagcccagctatttaacttaagcaattttaaagttatttgtaaaatgatatgctgtcttttttgacccagttactttataaagctacattctttggcaaacattaacacaacttctccgtgtgtgggctaaataaatattcgggcaacactgattgagcactgccttgggtaaataattctctctccacacatttcctagtttataatgaggagttttcttcgtggtctgaccaaatgtaacattccattgaaaatgagacataaatccttgagtgagggagacgtggaaccagggtttgaggagggttattaaaaaggtgagggtagcagggtgacctcctgagtcccctgctctcccgagccttctctcctctctggaacccatggctaataggggacaggagagagcggaagcagaaagaataagagatatgaaagccagccgggcacagtggctcacgcctgtaatcctagcactttgggaggccgaggcaggcagatcacttgaggtcaggagttcgagaccagcctggccaacatggtgaaaccctatctctactaaaaataacaaaattagctgggtatggtggtgtgcgcctgtaattccagctacttgggaggctgaggcatgagaattgcttgaacctgggaggtggaggttgcagtgaactgagatcgcaccactgcactccagcctgggcaacagagggagactgtctcaaaaaaaaccaaaaacaaaaaaagagacatgtgagccttcccttccctctccccatcctagcctcctctcacccaggtccattcttccactgtcatcccatgatgctctcttgcattttaaagtttggaagcccttattcctttgttttgtttttgaaatacaaatatcaacatttttattgttctatagtaatacacgtttcttctatagtacattaaatcacaagaggtaatagtgtatctactaacacctatacttttgagtagtgttgagtgtaaatgatattttgaaatatctgcagtaactgatgtgatatgcaaacatctgtgatttcttttaatttttattaattttcattttttaaaaaactttagtttctggggtactcgtgcagggctgttaaataggtaaatgacatgtcatgggggtttggtatacagattcttttgtcacccaggtcagaagcatggtacccaataggtgctttttcggtcctctccctccttccaccctctaccctccagtaggccccagtgtctattgtttccttctttttttgagacagagtctcactctgtcttccaggctggaatgcagtggcaccatcttggctcactgcaacctccacctcctgggttcaagcgattcttgtgcctcagcctccggagtagctgggactacaggtgtgcaccaccatgcccggctaagttttgtattttgcgtagaggcagtgtttctccatgttggccaggctggtcacgaactcctgacctcgagtgatctgcctgcctcggcctcccaaggtgctgagatcacaggcgtgagccaccgcacctggcctattgttcccttctttatgtgcatgtgtactcaatgctcagtttccacttacaaatgagaacatgtggtagttggttttctcttcccgcattaattcatttaagataatgaagctcctgtccttgacccaatctccactctaccgtttgatgtccagtgtggactgcccctctgaaagcccttcactgcggcttagcctgtggtggaaggtgtccaaggtggctggaacacctcctgctgggggtgtcagtcttggctctcctgttttctgcctgtgcaatggtgggtaggtcccttgatacctcgtaacctcagcatccctgtgggtgataaggagatgataatagtctcttcccgatgggggttaaataaaataattctcggagtatgtgaagcagtacatgtgaagtgctcagctttgtgtctggcacataaggaagtggtcagtgtttaatgttagggatcatagatgctgataaattgccgtttatggcatatttcatgtattgcctcatttaaacctccttgcaatctgtatgactcctgctgatgatggggaatttgagactgtgagaggcttggcaaaagatctaagctgtgaagtatctggaataggattccaccttcagccctgccttaatgaagaccatggtcttgccacattgcatctccccaagatttttatggttctatttttagtcacgttggcctgcgttggtaaatttacctttcctggtccttttgagtaactatctctggaaaggattaagtgcagtgatcaatcagcagcaaagtcctggaagaaacccatttgttagtctctgggcctccccaggccttatcagggcttagccttcgagcagtagcaacacttgcacctgcagttactaattcctgtggaatgaagtaggcgggcccgaaatgtacagcccttatccagtgaattctcataggagcaaaaaaaagtgttttctttcccccttggagttctgtttcttcttaaaattagctatttctcatacacaatagggacatattcataaaaaagggaaaatactccaaagttgaaaaaaagattgaaaaagaaaatcctccaatatatatctactcttagcattttggcacatattcttacagtagtttcaaatgcccaggccattttgttttattttgttttgttacaattgtggcatatgtactcgtgatggatttgcttgttatctctaaattaattctcctcctgcaattcaaatattccagagatatgtatatttttaacacattgttaattatcccatatggataatagtttcttttctctcttaacattttaaaagcatgcctccaggttgttctagacggtcctgaacagtgctttgaatggggacatgttagtaaaccaatgagaggaaccacggtttagttcatcattctccttctaactgtatttttaggttgtcactaactcttttcagtcgtcatttccatggccacgaacatctttggttctaaagcatttttcccatttaaaattatttctatgggattgatttgccagaagtagaatttctaggtcaaaggtacaaacgcttgagaagtcctgatacatattaacttgggccagaaatctaccatgtaattgagagcaccttgagcttggcttcagagccaggatgaggacaggaataagtgggccttttgatttgaaatgttgagatacgaatgtattctagatgggccaaataaccagcttattttattttaaagtcgagtgaattttctgcctcactaatgtgcatgtcttcaaagacaagtagtgggaacggagtggggatttgtcatcccatagaatgccaccacatggaatcggtcctgaggcttctgaaagcagttccaaatttgaatgtttcctaagttagttcttgcggtacagcgcagacaatattcttcctcgacaatagctgagacccaagtgcctgggcgcttccaggtcataattaacctcttcaaaataagagcaaagaaaggcaggaaaaggtcctctccattccagaaaggagaacaaagagggggaattctaaccctcttgccacctctgttctcgtccgttccatattaagaagcattcaaagactaggatgccattttgcaaacgtctcattctccctgaatggtaaggctccacgctttagcacaagtggtacaaatctgccttccctcattcttttttgcagatcatcccgctccccacccctttctttatcatggctcatttggagcatctgtgcattttttaaaggctggattttctttctgttgccattgaaacattgcatttgtacaggagaactacttaatggcacagtttgttattacatggaattaaatacaacctatttaaatcatgtaccgtgaaaccaaagagctgtgtatggaaaaagcctcatataacccagtttgccaggtcctaactcccttcatacatatactaacatgcaaaagacctcctaccttttttttccccttctgtttctctcttggtataacactaccctgtttttgaaagtacttgtactgctaatatattctttaaagaagaggggggaaacctgttggtcccctcataaaacagttaacaggaagcccaaggcatctttcagtgccatttttggctgatgtttggaatggttccatcaatcactgctgttcatgtatagctggtttttatgtcagttaaaccatcttccatcaagttggtgaagcagagtcagggaacaagatgaatagcaaaacgtcttctgtggcatggaaaaggctttgcttttaaatgcccgtgttgatttcttaatattttcaacttcctcttctgaagccagttccccccgaccatcagtcatgagtccgttcttttaaccttgttcaggtggcgtggggcggtgtgtttggtggggagtgatgggtgcttgcctggaagtgcgagcaattgatcagctgatgaggggtatttattatctgtccctgactcccgagagaggaaataaatccttggaccccagagtgattttcggagccacaagaatgcaagatgtcctgtttccagtcagaccatagcagtatcagtctgtgcagttggaatcttgcatggggaggtgtttttatttcacacaagaaagaatggcacatctttccttgaaagatgtattttgtatatcttaatgtcagttatgtttacgtgtttgctgctcagaaatcaacaggatttctgcccttccccagccccctttttttcagcccttcagagaatatttgttgagtgcagtgtgtaaaatcatggcggtgccaagagggggtgtgatgggtgtggccgcccccctgccagcaggaggaatctgttttcactgacattgtttggaatcaccaagcatggtgatgataaaaagcagttaaactttggtcacttttattaatacttttaagtccttagcgaacaatgcacccgttattacttgcacctagtggacatggttctcattgctgctgcccacctttcttttttttgccatgggtgcaaaagatgcctctggggatcccagaggactcagcattggtaaggatgcagtcctaatcctgaaggagggtacagctgaccagggaggtaacacatgaatgcagctgatagggccagttggacccagatttcaactgcaatctctatttccttcggatctgttgcatctgctcaaacactagttctgcaatttcccaacacctgccccctgccccttataaaagctcatggttccatgtgactttccactcctgcgtctctggccttggggcaggtcagtccgtggatcacctcactgtcctagggatgctcttctggtccacactgtgcctaccttggatatggagttccacttgttcccttacctttcacccacctgtgctcctcacccaagcaggcattgatggaggtctcatactttactgaagatgtgaggaaagaggacacttatgtagaacccaactgcaggtggagccttggcgatccatagccctctgtaaagtggggattgaagcacatatcttgcaaggcttgggcattgattgcagggagtaatgtgtatatgaatcatcagctatgcaacataatgctgatgctaagtactaacattgatggagtgttggcatgagctgggcagagtgctccatcctctatgtgtgtattagttcattcttgcactgctataaagaaatacctgagactgggtaatttatttaaaagacacctttaattggctcacagttccacaggctgtacaggaagcatgatgctagcatctgcttggcttctggggaggcctcaggaaacttacaatcatggtggaaggcaaaggggaaggaaagcatctcacatggtgcaaacaggagcaagagagggagcaagggggcaggtgcaaaacacttttcaacaaccagatctcaggagagccaactcaccacacagcatacgtgctaaaccatgcatgagaaatctgtccgcatgatctaatcaccttccaccaggccccacctccaacgttagggattacatttggacatgaaggctgggtgcggtggcacactctgtaatcccagcactttgggaggccgaggcaggtggattgcttgagctcagtcgtttgagaccatcctgcacaatacggtgaaaactcatctctactaaaatacaaaaatgtagccaggcgtggcggcacatacctgtagtcacagctactcaggaggctgaggcaggagaattgcttgaacccgggaggtggaggttgcagtgaggtgagatcgcaccactgtactccagcctgtgtaacagagcgagaccccatttcaaaaaataaataaataaatttgacacgaaatttggtggggacacagattcaaaccatatcaatgtgaattaaatgacatcattcagtcctcaggacaaccctctgaggaagtacttatgccccccggcctttttttttttttttttttttgaggcagagtcttgctccatcaccaggctggcacgatcttggctcactgcaagcttcacctcctgggctcaggtgattctcctgcctcagcctccggagcagctgggactacaggcacgtgccaccatgcccagctaatttttttgtacttttagtagagatggagtttcaccaggccagactggtcttgatctcctgaccttgtgatcctcccacctcgacctcccaaagtgctgagattacaggcgtgagccaccgtgtctggcgtcatgccccgttttatagatgacaaggcatggaatggttaaatgtctttcccaagctcatggagtggtggcggtggaggtgttgtgaatgtgaacccaggaagtccgcctccagagctgcaggcattaatgcaaagctgcactgcctcacgaggtcgctgatgcactctcattccttttcctccagggactcctgcactttgccaggcgtgggccagaatgccactcgtattgtttatcttaatgcttagtgatagtagctacctccagtgcacgccgcattagcctctccaatgagtttctcctttattttaaatgtaaatctagagttcccttaatccccttaatttttagtacgtggctctgagggcagaaacattttcaggagcagcctgggctgagtttttaatgtggcagcagcctcggctggtttcagcatgcaggtgagaaggccgttcatctggaacttgggctacccaacagtgcaagtggggagatcagagcatggaaaatgtttttgtataaacttaggtggaccaaaatgatcatttcaacaacatttcggacttgattttttgtatttatatggcccctttcttcccaagaattgaaagcctcaaactagaacgtggcttttgaacggtgaacattccacaaacatttaatacagagatggctgtggggtgggggctgggggctgggggcctggaaggggagaaggggcaccagaaggagaaatgggaggaaagggcgagtgagatagcaaagagaactcagaaagtaataaagccctgcagtaatcagagggctgaggccaggtccccagtgagcggctgaacacacagtgattcaaacccactccagacctgtgttcttaatcattaccttcacctggagggacagacctggccttgggcaagccacccccactccctggctctgtgaccttggcagctgactggccctctccaagatcagtttcctcatttgtgtaacagtagtaatctccaatttagggggctgtatggatattaaatgagaaaacacacacagatcatttctttagcacaacgtctatctggcacattagcgagagctccggaaatacccatgccagggtcacaagctcggttctggagctggatggccggggtttgattcttaactctgctcctttctagctgtgtaactttaggcaaataatgtaacctccatctgcctttgttttttcctctgtaatagaaggaacaacaacgaacaacattttttttttggcaagattaagtgagatcttccatttgacatgcctggctaattggcagtgcccaacagatagaaactattggtattgtaaggactgcttattgggtacatatgctgtgccatgggaggtggaggtgctgtcatgctgaacccctattaacctcaataggaaaggcaccaggttcaagagctgaagaagacactcagagccaacagatagacatggggttttattaggaggttacatataggggagagagtccagtgatggcgggctggatagtacaactgcccaccttacatacagaaatggtccagtggcagtaggctggacaggatatccacctccctacagtccagtggtggcggtgggctgggcaggaaaaccataaccacctgcaaatgtcatgtggtttatatcacaccttcacttaacaccctccccctaacaacctctacctggcaatcttcatttaactccaaactcaggacctcaatcccctgtttggcctgtgttccacgggacaggcatggggcacagatgtctgttatatataagggacaaatctctgggttggtcactcctggattccccagcccggaccacacattcaggtgcatctcccacacaggatcattctaagggtatgcttacgttaccgctattggggtgtgttcaccctgcaggtgcagagatggcaaccgaggcagctgaggatcagggagtggaataacttgcctagttctggctcttcccatctaatgtggctgcactagatgctgttaggaggaggaggaagcctacttttgttttttacccagtttctgttcaaaggtcgtatttcatggtgcctcatcacagtatgttcttatatgccctggcaaacagaaggtgctcaataaatgctagttcatctggtcccttaatgaatactctggcttcgtcatcttccctaggctttggttaatttggtgccctcttttgccatttctgcaacccttattcattgctgtcaactgctcgttacacagcattgcctgtttcactctgtacaggtgccaggcgtctctcagcttctcctctctttcccatccaactgagcagcaccaataaatagataagaaacctgaaggtctacatcaaatcagcttctattgctgcaaaactcttctagctaacttcattctaaaagctgtctgaaatatatttacttacacccgagaagattcaaaaacattaccgctgaaccccgatgctttgggaacacatggtgtccttggccacttccttgcttgttaccttgtccaacagctgattggcatagtacagatgtagacatcaagtaattctatcgttaaaggattagtcagcctctccctactccccacccacttatctcagtaaggtttagtcaagaagttggaaattaatggggaaggaaggttttgggttatgtgtggatttcatttatccatgctatctcttccctccattagcatggttaattaagagttgtcaatacatctttgttggagtatttgattattttttcaacagggaagattagaatgaagtcttcagatctggcaagtgtcatgggacttgtaaagtaaattgcaggttaagccctcattttgatctctgggatgagagcaagcaccgtttcattgacatgtcatcagctatgatctgagggagcacacagaggtgccctttggggaaagaggggcatcttgcacttgtctcccacattgaaagggtttattgcacagtgagtgtgtgcaagtgaacaaatagcagatgggttagaatggacagaagctagctctgagcacctcctgatttatgctttatttaaaaaaaatcatatgtatgtatatgtgcatacacatacattgttttgtatatatttgtcagatggaggtgtgtgtaaacaaataacagaaatgagttaaaattgacaagttagcttggtaaacatcttgatttataatttattaaaaactacgtgggtatgtatatacatacagacacacacacttcttcaccacctgaacaaaaatcccttttgaatcatccttcttgccttccaaacaagtacactagcaaacacttttcccagatggcaaatgactatgcccgttaggcatttcttttagcatttgtgttgacaatggcctttatttttccttctacttaagggctctcacgttctagaatacatcttaccagcgattaattatgccttgagattgccaggagacgtagacgagcttttattgttttagccactgaatatacctctagataacacaatacatatttacagtgacaagctttgtattatttataggattatagcaaatcatcaaaaaacaacccaaaaagggccacttagaccaacatccttatttctccctcggcttcagcattgaattatgcatgcattacaaatggcaataaggagtaaaggtcggtttagaacaacacagattgcaaaattacaccatttgtttaaacaacattcattattgattattcagcataggggctgatagaaacgcaaacagtggcagtaatatcatctatttacgtaggccctttataaatgtgggaccataccctctgtttagatcggaacaattgttcaaattttccagctctgttttgcaagaaagtaaagatgaatttggcatctacttccttgtgtcttttaatttttgaaagatttttggtattctccctatatcactgaagagagggaattggggttcagatggattaagtaatttacttaaggtcctgcttctaaagttataagtactctttccatcatataacacttagcatgtctgaagccagtaatttattaataatagtaatgataataattataaccatatctaatacatattaactcttattttaccagtccatgcacaaagtgttttgcatgtgcttcgactttcagcctttacagaaaccctgtgaatagacattattatgatgttcgctttatagctgaaactgaggtgcaaaggagttaggtaccctgctcaagatcactgggttagtaagtggcagaactggatgatggaagtcatcactgtgttccagtatctgcagaagtgtcacacttttgtgctttgaccgtcttctcatgacccatgaatgccatgatttcacaaacctgttcaaacagtattggtttaatggttgattcaaatgggtgttccaaagatatcgtaaatatatttaggatattagaaataagatatttaactttactaacataaaccttcaatttagttttaaagagtcttagagcagcataaacaacatgactttcaactaaaatggaatttactaaataaaacccaagagattaattgtaggagctatgtcctggtgacttgggaaagaaaaatgtaaggtggtaagcttacgtacatgctttcggcatacacttcccacctccagcctcgcattcccctggtacaactcaacaggcatttcattttgccttacaaattgagtgcaaccgggaagctcatcgcatagctgcttactcagaaaatctggtgtagtggcttagctagcataacttttgagaggtctctgtgtgatggtcttttttaatgtctttcgtgaagaattcttcttttttttttctgagacaatgagttgttctgtcactcaggctagagtgcagtggcgtgatcatggctcactgcagtcttaacctcccaggctcaagcgatcctcctgcctggtaggtgggactacaggtattcaccaccaagctcggctaaattttttttgaaactatttgtagagattggtggcagggttggagggcaggtctcattatgttgccagggctagtctcgaactcctgggctcaagcaatcctcccacctcggcctcccaaaatgttgggattacaggtgtgagccaccacacccagctgaattcttctcttgatcattaatccccaccccaccccaccccagaaaatccatgttatctttttgcttagaggttcaccacctctgttccatcacttttctttttcttttctttcttgtttttttttttttttttgtttgacacagggcctcactctgtggcccaggctagtatgcaatggagcaatctcagctcactgcaacctctacctcccaggctcaagtgatcctcccacctcagcctcccaagtagctgggaccacagcctcctgagcacccgggtgcatgccactgccaccatgcctggctaatttttatattttttggtagagatggggtttcactctgttgcccaggctggtctcgaactcgcaagttcaagcgatctgcctgcctcatcttcccaaagtgctcggattacaggtgtgaaccaccacatctggccaacttccctttctaagagccctcttggggctctgatatgcacctctcatacctcagccccagtcagggttgttgaaaacccactgtctgcccagaggctgggagcacatcttggtctgcctggtatggagggctgggaggaggattgcaggaactgcttaagaggcctcactttgcaagagcagttcaggatgtgtttccagcacagtttccaacatgtgccacccatggcttcccctttcatgttcctggcctttatgctaagttctcacattgttatttttacaagtcttttccaaggcctctgattttctagaccatttaatgtttgccataacccataagggtataactgtcttggcacattcagatcccccgtccccctgctgtccttctagtcagtttctggcacactatgtttatgagcttacagaacagctcctaggttttcttacttccaaaacagtgggcaagaacagctaccttttagaagcaggaaaaaggaacataatgaataaacctaaaggatttaaaaacttggaagacactaagaaactatattgccgagaaagagaaatgtaaattccgctggataaattagcgtttgcggttacttctctctttgttgcttaagcagaggagaaacagaagtcatagcaaagagagaggtagctgcaaaagctaatttatccaaaagaatttacatttttctctcttggcactatagggggcatgtttactctcctgatgtcttttggggaaggcgaggcacaaaagaagggcatcttcttccttcacacacacaccccacttaggaaaatacgtacacttgagatgccagagacacacccaagtagaacacatcccaagaacagtcaataataataatacccatcatttattgaacatccacaatagccagacatttttctagttcttataaatccatgtactcctcccagtagctttatgaggtcttattattctcattttattgatgaagaacttaaagttcaaagaaaggagtaaatcacgaccaggcacagtggctcgcgcctgtaatctcataatctcagcactttgagaggctgaggtaggtggatcacaaggtaaggggtttgagaccagcctggccaacatggtgaaaccccatctctattaaaaatacataaattagtcgggcatggtggcatgtgcctgtagtcccagctgctcaggaggctgaggcaggagaatcactcgaacccgggaggcagaggttgcagtgagcctagactgcaccattgtactccatcctgggcgacagagcaagactccatctcaaaaaaaaaaaaaaaaaaaaaaaaagtaactcattcaaggctacacatttactccatgaagtgagcacacttcagacttccagtcttgtgtggcctgtctaccacaccatgagacttcatgtctctcctaaatgaggagaaccaaagctggaaattgtcaccccctgtcagcccacagcactggtttctaaacctactggcctctaccgcttcacttctcactgtaatctctctgaccctaccttccagcttctcttgagaacttgactcttaaattcattggtgagaaaggaaatttttgctccaataaactgggtagctcagtccaggagagaaatgtactggactcagacttggaggacagagctttgtgaccctcctaggcaatgtaatgaccctctcctggcctcaattaactgaggccaggagagggtcattagcaaactgtcctttgctaaatgggactaatgggaagaatagtgtctgccaaataaggtggttgaaggattggatgagactgacatttcatttgcatttagtgaatacttgttgaatgactgaatgaatggttgatgtacagaaacatgaacagagagtagagcagaacattggtgaatggtagtagattgcctcagacgcccccctttagaatcacacaagctgtcatctgtgattgcatacctgtagaagtctctatcatttcgtagtctatgtaaatgttgaccaactgagttgttcagtgtacagactgaacaaccatacagggaatccctaatctcctgcactgtgagtcaaagagtcagacaggtctagatgcatttgcttcaggtgaggccaaggcagtctactcttaatggcacattaggctttggacttgaggccgtgtcttttacatttcgcagcaatcagaaggaatggggtcgccccatgaacttcttaaccacatacaggctcgtggcgtggggtcttcatctggctactagattgtttaaagaaggatttttgtgattcttctaggctgacacattgcctgtcatctgttgtttttctaatcttctagtaaacatttggaaagtgaaggtttaggcatgtatgtttctcttatgtaggaaggggaaataaggccatgagattgcatgagttttctttccaagtttgtgcagatctgcacaatgattgaaatatttgcaacctgtagagcagcagggtatttatttggcagcaaacagtattgatggattcggggaatgccatttgacagttacaggctcccgtgaggcggtgcaggctcctccgagccagggatggagctggggattgagtgacacaagactctttgggtatgtctcaaacaatataaatcaccagcaaaatctcactcctacaaggagaacctgcagggagctccgtgggaggcactgctgtttactctcctcattccccactgcaaccacgcaattaaaaccaaggaatggaatctgatgtctaccgcagcggttttttccatctccattccttctgcattgggaggcttaaaaaaaagaaaaattagatcccagattctttattcttttggaaggatttgaaacgattatcactcatgctctgctgctttgaatggaaaagtgatttgataactttcaaaactcttagccttctaagacttagattctggtactatctcatttatgtgacgtgggacaaatagccactctcttgcataggattttcttttctttctagaaacaggaactgagtatgtttccaatatttttttatttctcctaaaaaaatcagagactatatatataaaatctcacaaactttgtttcccagaaaaacaactatatttaaatgcagctcatactgtatgtaagtatgatgtaggaaaatctgttaattgtgtgacaattatgacttctgagctgctcatttattaaaatattctccctataattaaaaatattttatttcggagacatggctccattaattgcacatttcctaatgaagtttgaaggaagatttaaaaatcatattagccacttgtacaaaaacaaaccagtcatatcatagcattaataacaaaaaaattccactgtttatttaacgtaccagcaaattctaccgtatattgtttgctctccgtttggtgggactaaaaagggatttaaaaataggctatatacactgaatgtagtttcactggaagatttaatgccaacatgttcttttttggtattaacatattgcattggtgtgaaaactaaaatgccttcagcgatgatcttttcctttggaaaactagattcccactcggatgctacgaggggtaatctgtgctaagtttatggtgtgtctgccagggctctgctttaaaaaacaaaacaaacccttttggaggccttgacagttccatggaattcctaggaacagcctagaaggtgaatgatgcagcccagttgtttttattctgagtttggcaaaaatgatagagaagaaaatgtacttttatgtgttcgttcgacagttaaagagtattccagattcctccctccaaaaaaaaaaaaaaaaaaaaaaaaaagggcatattccctagccaaggcccacatggcttttctttactttaagtactcctcatattatcttgaccttaaagtttacagggtaaaagaaacatttatggaacagttaagaccagttagaacataacgacttgcctcattatcacactccacaaatctccactttacagagttcacttccctgcctgctttaaacatgtgtttggcctgcaaacagtgttactagtgctcgcatatggaaacagagaacttctcattccttacctcagacgtgccaaaaataagaatctttaagaactcataaagtaatttagcaccacgttaataaaagaagcaccattttgaattagttctgtaagtatgtgtttgagttagaaatagagttttaaaaaactgtctgttcatatagttcatctgcttaataagtaagcagctctttcaaatcaccaagctcaaataaaacaaacaaataatgggacaattggcaaaactctaaaaagtgatacaaaagaccaagggatatttgaaaaatgtttaaagttattagcagagaagacacaatttagaagagagactgtattccattttatttttatttatatttatttttgagacagagtcttgctctgtcacccaggttggagtgcagtggcacaatctcggctgactgcaacctctgcctcccgggttcaagcaattctcctgcctcagtctgccgactagctgggactacaggcacacgccactatgcccagctaatttttgtagagatggagtttcaccatgttggccaggctggttttgaactcctgggctcaagtgatccacccaccttggcttcccaaagtgctgggattacaggcatgagccaccatgttcgaccccatttttataaatgtaaaattaacttaggtttaaactattaatacacaaggttgagaagtatagaagtgggcattctaatatactgtggatgggaagaacaattgattttcatagttctgagatataatttggagatctctatcaaaagttttataaactttttttttacctaggaatttcatatctagaaaaatattgtaaaggaatatttaaagatatatccacaaatttatgtacagtgatgtttatgcttatattatttatagacttttaaaaaacttaaaatatttaacaattgagttattttatgatgatctaaactgcataggataaaatcctatgcagtttacagaaatgtaaactaagtgcttcgttaaatgaatcctagatcccgtgccttctgactgggtgagacctcccagcaggcgttgccagagaacttacacaggagcgtttctgctggaatcagctcgatgcctcttgaggacagagactcccagaggaaggagcaggcagccatccttgctgtgctgcagcctccacaggtgacacctcctggtgtgggagggacccaggtgaacagggtctggagtagacccccagcaaactacagcagtgttactgggaagaggggcctgattgttaaaagagaaacaaacagaaaacaacaacatcactaacaaacaagttcccacaaagaccccatccaaaggtcagcagcctgaaagatcgaagccagataaattcacaaaaatgtaaggctcatttacattacaggctcaggcctgtaatcccagcactttgggaggccaaggcgggcagatcacttgaggccaggagtttgagaccagcctggccaacatggtaaaaccctgtctccactaaaaatacaaaagaaattagctgggcatggtggcaggtgcctgtaatcccacctacttgggaggctgaggcaggagaatcacttgaacctgggaggtggaggttgcagtgagccgagattgcaccactgcactccagcctgggtgacaaagctatactccatctaaaaaaaaaaattagttatctctgccctttgggaggctgaggcaggtggatcacttgaggtcaggagtttgaacctagcctgggcaacatggtgaaaccccgtctgtaccaaacatacaaaaattagctgggtgtggtggcgtgcctgtaatcccagctattggggaggctgaggcaggagaatcactcgaacccgggaggtggaggttgcagtgagccgagatcacaccactgcactccagcttgggaaacagagtaagactccatctcaaaaaaaaaaaaaaaaaaaagttattgattaaaatttaaatataaattacaagtaataatgaaagtatgaaatttttattgattcataaatatttggttttaatcaaatatgatgtgaagctttaagtgaaattattgatattcgaagtttttttttgaatgtttaaatcatttcacattcacattttttaagtaaaatgaaacaacttgacattttagcatagaatgtttatatggtggccaaaaaagcagattggtatcatgctttatgtgtgttcattctagtcctgcacgtgtagaaatgtaagattttaatgtgtggtaaggtagatagatagatagatagatacatacatacatacatacatacatacatataaaattaggtaagaggatacttttaatgtatggtaagctatgattgcaccactgcattctagcctaggcgacagagcaagaccctgtctctaaaaataaataaataaataaataaataaatattttgtaaaaggtatcatagctgtataaaaagaaaagactaaaaagaaagccactcaaattccatttctcttctgcagatttttttttagttttgtatttcatctgtgattgactgtgtatgtatttttgcatatatacctgcaagcatttgtccttttaaccttaggaaaaaaagtctgattgcaactacgtgtttgggaatcagggagactatggaagaacaatctcagatctcagcttgaggctccacttgcaatatcacaatttctaaaacatgttgtatgtgggcccatttgccatgtgtgtgtgtgtgtctgtctatctatctatctatgtatctatctatctatctatatatatatatatatatatatatatatacttataatgtggtgggttctcgaatcacagttgtaattcacatttttctccaccaattctgataacttgcattaagaaattgactgtgtaagttaaattttagatcaataatgcaaattgcaagacctagtacaggccaaggcctcattatatctgagtagggctttaagaaagcaagaaagaatcgcttgaacctgggaagcggaggttgcagtgagttgagagcatgccattgcgctctgctccagcctgggcaaaaagagtgaatgaaactctgtcaaaaaaaaaaaaaaaaaaaaaagaaggaaagagggaaatatacatcctcctatccagggtgaattacaaatagtaccagttggttgtaagtggatttaaaattactttttactgctaatggggcatctgtcttcattcaacaaatatatttcggtctctgttagatacagtgtatctctgttagatagagagcattctgttagatacagagaatctctggtagatataaagtattctgctattctgatcttcctgttagaagatcagatttacagaagtctacatttgctctcaagggaccttcagtctgtttggagcaatctctttattaatttatttattcagtaaattttattcagaaccagctatatggcaaaccctagtccttatgctgaggtttcagagatgataatgggggcagatgcagccattcagttgacttcctgtggacaccagagatgacaggcccctgtccccagcttaccatccagcatataaggcatatatgcccctttccatgaagtataatctaatgagaacagttggagaaggtcaggcaaaggggacaggacaggaactcaggaggaggggatatttagacttacagacctgccctacctaaggtcccacagatggtctgtgatgacagatagcccctggactgctaagactcggatctttaaatataggcccatctgggctgtggggaggtgacagcctgagaaaaagtcattcttagatgcccttactctgttgatcataaaagtaggagctgaaattctcatagcctgagaagctatttgcagcattccctgagggctttgaaacactatcaaacaacaaggagagacaaaacagtttttagccctgctcaactctcatgggcttgccttattttttcagggcatgctctgtctccatcccttggctctgctttccttacattggtcttcttgggcatccgtcttccattccacagtgtagcaagccagaagctgggggaaacatggtgcgtgcctgtaatctcagctactcgagaggctgaggcaggagaatcacttgaacccaggagatggaggttgcagtgagccaagattgcacctctgcacttcagagcgagacttcctctcaaagaaataaatacactgtgtcctctcagcaagaccaggacaacagtgattctctttcctcaaagttccaatcagtgcccagggcttcatgcatattggacagacctgagtcatgaggccatctccgattggtccatccagggccatgtgctcaccccttaattcaggatgtggggtccggctcccctgaagtgcacagagaagaggggttgcccaaaggtgaatggggagaaggggatataagtgcaggacaggtaagaacagcaaatgctcattaacaccatgcagtgatgaaacgcctcttaatcaacccttgctggctgcagttgatttgttacttaccgtgaggttatcatagctttgcagagactttgtgatggggctgtcaacagagagaaagagagagagagaaagaaaagaaagaagtgccaccagtccattttgttccactcaaatgtagatcgtaatttttaggtttgtaattactgatgagaagaatgcctgagccagaacttcccagagatttatctgccacttacctggagtaagtagaaaggatatcagttttccccagtacacctgcctccaatgaagccaactctcaggctctagaagtctctgccttgggatggattcaccagtgtgcttctcaggctggccagtgtggaagcagccttgctgtatttcatcctttaaaaatacagcctgcttgccatctcacgacttttcccttaatgcaacaaagaaatatgtgtttggctgtgaaatctttttttttttttttttttgtttttttgctgtggagcgcaaaatgttcatttatctctggatggtttgtttctggccacctgccctaagtgtatctgaatattgtaacggtgatcacttcttgagtcttggtcattacgaagtgacatttggcatgaatttgctcatcaccacagagggccccagggacccacttgggagaaggtgagttatagcccacaagataacatttctcctggtgactgtcctgaaagcctactttgggccaccacatcagtgtgttgggagatgagttaagaggttttattcttatacatgcggaagaattatgccttcttgagccatgctcaggagatgtcagccttttccattgtctccccgcccccaccgccagccctgcttaaattatcccctctttttaaacaaaatatcctaatcttggaagtggcatatcatgttccttcttttttaagagagaaggagaaattcctgcagatcatcagggactgaggctaactgaagctttggaatggatacagtgctactctcagctgaaagcacaaatcacttccatcacgtatatgagattcctcttgcagcactgcagaggggtgataagcaagagttgatcgatgacagaacacccacccaatttcttgactcattcttcaacgggcagggtctatacatgtggtatggctgcaatgtttgttgataacccctacattcacaaaacgggcgcatgggaacttgtttgctgccttctgccatgtgaggacacagcaagaaagcacatacaggaagtagagatggagccctcattagacgccagatctgctggtgccatgatcttggacttcccagcctctagaactgtaagaaatcagtcagtatctttgtttctttcctttctttttctttttctcctttcctttctttttctttttcccctcccctccccttccctcccctcccctcccttcccttccctttctttctttctttctttttttttttttttttcagacagaatctcactccgtcgtccaggttggagtgcagtggcacgatctcagctcactccaacctctgcctgcctggttcaagtgattctccttcttcagcctcccaagttgctgggattacaggtgcatggcaccatgcctagctaatttttgtatttttggtagaaacggggtttcatcatgtaggccaggctggtcttgaactcctgaccctgaggcccaccttggcctcccaaaatgctggaattacaggcataagccacctcacccagccaagaaattaatttctgttgaatgtatgttgttatagcagcctggatggactaagaatcatgatgaaaagttgggttgctttcatatttagaaatatcttggaacgggcaggcgtggtggcacacgcctgtaatcccagcactttgggaggctgaggcaggtggatcatgaggtcaggagttcgagaccagcctgaccaacatggagaaaccccgtctctactaaaaatacaaaattagccgggcatggtggtgcatgcctgtaatcccagctacttgggaggctgaggcaggagaattgcttgagtctgggaggcggaggttgcagtcagctgagattgtgccgttgcactccagcctgggcaacaagagcgaaactccatgtcaaaaaaaaaaaaaaacaacaaaaaacacgaatatctttttttgtcagctccatgagggcacaaagttgtatcagcttttttttttcacagctgtgtcttcatcctaaaatagtttctagcacagaacaggactcagtaagttatttgtcaagtaaatagactccttaataaattgtctatcctgtatccagtacaatgcttggcctaatatacatccagtttcatttaatcctcaaaacacattgatgaagtgggtgttaatccctattttacagatgtgggaattgaggtgtagagctgttgaagaacttgcccagggttgcagagctctttcacaggggcagagcatgggctgaacaccagacctgtctcacactaaaggtgaaacaatttcccctgcatcaaactgtctctgatatgaagggtctacacactgtggtttgaaggtcagatgtggcctgtcatgtttttgtacagcccgagagctaagaatggtttttacatttgtaattgtttgggggaaaaaaccaatagaataatgttttattacatgtaaaaattgtatgaaattcaaatttcagtgttcataactaaattttaaaaacttttattgaaattccagagagatctgaagtagttttattggaacacagccctacacaccttcatttataagctatctgtggctacttttgcactatgccagcaaagttgagtagttgggatggagactatatggcccataaagcctaaaatactctctgctcctttccagaaagcttggcaacccctactatcatctccacgtctgcctttgttcttcttatttgtcccttccctctgaaggcaggatagcatagggtgaccataagactctctggaactagcctgcttgagtctagtcttggctctgtgctgactacctgtagggatgtaggtgagcttttttatttttctcaacctcagattcctcatcaaatggaagaaataatgagtatccactaccttgggttgtatggaatgaaccaagttaacttagctaaactcatcgcttccaacatcgcctcctatgtaataagtgcttgataaatgcaagttctattcttctattctctctctctctctctctctctctctctctctctctgtctccctctctccccctctctctcatagtgatatggtttggctgtgtccccatccaaatctcaacttgaattgcatctcccagaattcccatgtgttgtgggagggacccaaggtgaggtaactgaatcatgggccccagtctttcccatgctattctcatgatagtgaataagtctcacaagatctgatgggtttatcagagggttttgcttttgcttcttcctcattttctcttgccaccagcatgtaagaagtgcctttgcctcctgccatgattctgaggcctcctcagccatgtggaactgtaagtccaattaaatctctttttcttccatgtcttgggtatgtctttttcaacagtgtgaaaatgaactaatacacatagacacatacacacatgtacccacacacacgtaatttttgtatctaagaaaggggagaaatactttttagttgttctttctgcttcatttatgtgtggagtgcttaatgtggtcacacggatattaattgcatgttttcttgttttataattaagaaataaaaatgaatcactctgacttttcgcttcattttctgcatttgcacaatttggatattttattttgtagtctattaaaatgtgaaagtcagtgtaaagtgtcagtagctttcatgagtgttcttaaaggaaggccatctgattggaatgcattgtatctgtccttccctcttgctggggtcagcccaggactcgaggggaatgagcccctgaggaaggctcagtccttggcagcgaaatccaggcatggaaaccaagcctgagacatgagctgcaggacatctgacactgtcttttaagagacctgcctgtgaggtcctcatcctgctccctacactgcttcagatccacttgtccacttgtagtgagggatagtatctgttccacctgattgattgattgattgattgattgattgtgaggcagggtctcactctcattgcccaggctcatctctgcctgccgggttcaagtgattctccttcttcagcctcccaggagtgccatggtgcaatctcaagtcactgcagccttgactttccaggctcaagtgatcctcccacctcagcctcctgagtagctgggactataggtgcgtgcccccacgcctggctaagtttttgtacttttagtagagacagggttttgccatgttgcccaggctcatctcgaaccccttgactcaagcgatctgcctgccttgtcatcccaaagtgctaggattacaggcgtgagccgccgtgtctggcttgctccacgattttcctctatgaattccacctttcccatggtgggaccaaggctggaagtacttcacaaaggctccatttgaaaagtggctacaaataaaagggaaaatatagtattccttaaaaaaaaagtagcattctatttttccccattggtaagtagtacaaatttgagaaagtgtaaatttgaattccttaataatcagatctctgcaatgtgttttgcttttatcatcctgggttgccatcttggccaagtgtagattattctgctcagggtagccatactgagatcctggtgtgcacaggaaaagagctaacctttgtggatgaaattgtagagtcactacctgcatttgctgtagctcttacaattattttatttttggaagacatcgagagcatggtccaaagctgcataggttgcaagtgggtagaggcagaatttctctccaggcctggtggattctaaagctgtttactcttcacccaccatttcctaggtctggtttcttggttaaatacgtggaagagtggatggacagaaagacagattgatcagttctccacaggcttccccaaactggccaggtagaaataagctaagcaaataaatgacttccccattttataattttctgcaagtcacataagccttcatgttgtttatttcttggttttagatttttttaattataaaagaacattattatacattatttgaataattttttaaaattatagagctgtctaaaggaggcattaaaaaaaccctttctattccttcatctaattctatccctctgaggcaaccatgattagtattttgtacttcttgtacatcctccttcatgttaatatagatgtacacatatataagattttgttctcattttctgaaataagtggacacatactccaccatccccaggtagtgtacagtgtgtgccctttcaggctagtatgtacagctttaaatcattcctttacagagctgtgtaatattccacaacccagaggagcagcttgaagccagctaaagtatgtatatccaagtggaattaagagcttcatgcgtagtttcttgattttgattaagaatctttcttaatagatatgtcagacgtgactttatgctgcaagacatagcataggtagaaatttttatgtcacaggtgggcctaattaaccttgattaatgttctgcaaacccggatagactggagactcagaaagggacgcaaaagctagtctggttcccatgttagtccctgctctgtgagcagctgccacacagtcatgctgatggctcctgcagcagccattctggtttgactgtgctcgtgctgccctgtgacatattgtttaacacagtgagttatgacacagggagcgaaatcaagacttcagccaccgatttaacaaactggtgactcggagatcagcagtccggcattgccatcctcatcaaaagctctatctttatctaaaatttattagccaacttcaaacctgtttgccagctcactaatggaagccttttgaatcaatttgctcctctaatttaaacagcatttcaatgtatattgtcgaagcagaaaggagttgcagcttctggccagtagaattaattatttattatccttttcataaatactttccgaggccgacataactgaaaattgctcaggctgtttgaaaacacacacacacagttttccagtggctaatttgaaaaatgtcaccgtattagttttcatttacatctgtcaggaaacatatctatacataaggaagttttttttttttttttttactttcaccaggtatttttttgtggagtatgcatttaattcacatttacaaattggtttctgtttttaactaaagatactttttcagcagaaatgatgtgtatgatgtcatatctaacttttgatctcactggtatttgatgttaagcctcaaaatcatcaaattttttttacggcactgaaaaaaatacataaatctgcttgattggttcatagaaaaagacccctgtgattaaggtaatgctagtttttgcattttctcctagctgtcattggttggacacagtgatcctcgggtctcttgtgttttcacatgtcttgggaacagaagtgctggcagctttggtttcaggccatctttccaaggaacgttgtctagcaaagaaacttgcaaggtacagatagtgtctccctcaggagcagaggacaggatggctttctttccagtataataaagacagtgcctccttccaggacaacggtttggcagatttgcttgataaaggttggggtttctaagcttggggctcctcagccatgactgaaacgtactatgagcacggcatctaccgggctgttccacatcctccctgtgggactaggggccagggcaatgggaatcagtgcagaaataaagctcatgctgtttgctctgccatgagtaacgaagtcctctgtatctgatcctgggtctcctgttttctgctagcttcctcaaaacttggtagctaactcattaacttacaaggaagagggtgaacgtgtagacccttcacagtttgaaaaatcacctgatcaataactgagattatgaaaaggtaggaatgaaccaattatggcccaaaggctaactccagccagtagccttttatttatgacccgttaaaaaaaacaaaaatgaacaaaaaatccaaagaaggctgtgtgccagagacgatacgtggcccgaagatgaaggtacttaactatctggcccttcacagagaaaatgtgtcaaccctttcctgtttgcgttcaggtcaaatagttgcattgaaaggcctcatcttacaaatgaatcaatatttagtggtttgaaaatatgttgtttaatttggggcgattcaatatcaaattaagatttttaggtttatttatcgatctttagaattacatcaacattaagctaattactttaaattgtgtttttaagtaaccaagaatacatctgtggacgctgttctgtgccatcttgagtcacgtttttaaaacaattacctttgatgatttcgtatgttatcccattcacagatggtttttttcgtccacctgagtttcaaatctgttgtagtcctggaaattttgcttaggttgaaggaatgagtgcgtgtatcttgtcaaaggaaatcacaagcccatgtaaactcgctcttgcttccgtcacctcgtgctttgaaacataaccacagtgtgctgaggtttcacattgttacatcctacaagcgtgcttacctgcatcaccttgctgggctgtttcagcattggaatatcactgggaatctcaagttcccaggagccaaccacgagagcttcacagctcagaattttcaagatgtggatgtaggcagggagcctatgtagtaattcaagtaagcatctcttcttcttgttttccttataggatgatagaaggtcagtgcttgttcaccccagtgaggtggagcctctgaggtgggaggttttctctcatccttgagtttatctttacttcctggtcattatgcaagttaatttttctagcagtgaaaacagtcacatgggactctgcccagcgagggcgttgggaggcctggcggagaagcagttgtagcatcgtccagccttctctacctaacaagggaatatgtgaggtagggtaggacattttggtagcagtcacacagcccaaagagcatggtgaatttaattagtctgccacacctgtatggccttacgttttccgggataacttaacaagcattgtgtgcagccaggtcaggcagatggaggttctaatccaggctgcacacctcatcagccaggagactacagataagtcagccaaacttttggagtaacaagtagctcatctgtaaaacgtggatgttccaatttatgtatagccgcataatacattaccccaaaacttagaggcttaaaacaacaaccattttgttttatcttgtgatttctgtaagttggggctcagtggagtgactcttctgccccttgtggtgttgactggggtcagtcagtggtgctatgctggaggatgaattggactggcacttcagctggtccaggatggtcacccatgggtctggcactttcacgaggatgactgggatgcttggctcagctgagggactcttacccagagccctacacatggcctttcctgcatggcagatatagggccatcagatttcttacatggtggctcagggctcccagaggattccaaaagaaagtaacaggaagctgccagtttcttatggcctggcttaggggttggcacagcatgactgctgtggactaagcagttacaaaacccactcagattcaaggggagcagacatacacctcactttcttctggtagaagtgacaaagaatttgcagccatctttattccaccacagcaggtaataatagcatctccctcattacctatagaataactccaaactttctgatgattaagtgagatatcatgtaaagtaccaagcaccttggataggcaatgggaaatgttcacaacgttcccatttttacctataacagcagtagcaataatgctaatagtaatgatactagtaataaaatcaggataatgctgtttttaattcaccacactgtatgccatttgcttaaaatcagaaaggactcatcggtaaggagtagggtggtagtatcattttggtctgcctttcacccccacaagacaacatccttaacagcagctatgttgaaggtttaggagtgcttgtcattagggtctcatttccaaaatctgggacataataatagatggttactgattacagggatttttgtttgtttatttgtttgtttgtttcttcttgataatctctttcattcatcattccttcatttccactcttctaattctgggcattatatctttgtcagagatagagtcttttagctgtttcttcacctcccaaatccttctcaagtctgttctccgcctgctgtgccttcctatagtgtagctccaattgccttcatccttagaagacctttaatgatatcctatgccaaacttcctagcctccacctgtaccctgaattggccctagcctagttgtccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcactcaataaacatttattaaatccaagccatggggatccataggaggaatttagagcagagttgtcgaatggtcagatttgcctttcagaagaccgttctggcagccatgtgagaaaggagggtggggagacctgctgggaaacaactctagtcacccaggcacgaaatgatgagcccttgagcaaaagtgattgcagtgagtacagggaggaagaggaaacattttgatagatacttggtaaaatcaacaagatttggccaacagctctgaaggggatgacaggcgtggtgaatggagaaggaaggacagaaggctagtttgggacttctggcttggacagtgtattgtgtagtggaaccatcgctgaagataggaggagtccttttcagtcatactgaattcatgacgcctgtggggcacccaagtggaagtcatccattggcacctggatttagatctggcactcaggagggatggacaggatagacattgaccagacacaattatattggcatatttggactggagaacccagcatctgacttaaagagtctgcttctcttcaaaattgcttaggtgttttcaaactacaaacaaatacactcccaaaacctcaatagattctcccagtataccctatattttggccaaactggaatcacatcctggtctccccaaacactgcttgctttttgttcctttcttgctcttccttctgattgcaatgaactccccatttccagtccccatcctccaatcccttcatgtccagctcctgctcatcctttgaaacccactggattttaagattccatctgacaagaatgatcactgttccttccagttcttcaagcactttttctgtttttgatgggatttatcacttgaaaatgcatattatagtaatttctgaattcatcctgattctcctactggtttctaaactcttcaggttagaattcctgttggatatccctctggcccgaaattcctgaatgagttaagcaggacacctagaactatgcagaggtaataccttccttgacctgtcccttttctgggtcagtttgcccttcatgatttcggcaggagtgtgtctccttccattctggtgaacacatccaatgttcaatgttgctcatcagggtaagagttctaagtccctatgtcttagagacaggggttatctagctttgtcttctgcattggcttcaggcttcacatccttcctggacatgttcaatgctgctttcgtttcttgggcgagggccctagaatcaccttagacaccttgctctagacatggccccatcgtggtattcccttttgagaagacaaagattttaaaaattctttctcccttaatgcctcatgaatgcccaagcagcacttcatggaagtacactgagtctctactgcttgcagggattaaacataacattctcaacagtggtaagagagcctttcccttctctttggctcgttttcagtttttattaatttcctgtgcttctggttcatgaatcccaagtcatgatgtgaatcagttcagttcagcaagcactgagctcccatgatataacaggtttttttcttttccgagctgtggcccatgcagagtttactgagacttggctcttgcctttatgctttaaggatcctaaagagaagatgtaattataagatctaaaacgtggaggggggtggtgaattcagcctgcaggcatgtgtttgctgcccccacccccacatcctctttttttaaagttcgcataaaaacctggattcttggtttctcttaaaaaactggaaggtctggcacctttgctcccacatttcccgggcgcagcccttgactcaccctgtacggtggccgccccagttggatgatggggcttgtgcccaccgggtcagctcacaccaaccagcccctattaatttatacctggcccgctttccaaattgacattacctggctggtccgtacgcatcccctgcagtaactggctttctggaggtatgtgctgaggatctctttggcttctgcatctcaaaggatgagtgatttagccaggtggagaggttggggcggtatcctgaatgaaagaatagcacagacaaaagtagtgagttgaaaacagaacagcatggcaggctcccagtaatcccatgagtcacgtgttctgcccacatggaatggatggtggagaagggaggagggaggaggttgggccagattaagcagattgtccccattggtccatttttaaatcttccttttggtatttgtcccttaaggcaacactttcagtctcagaaaaaatccagtaaagggcaaaccagtttgggtgaatttctttgtttttgcagcatgtctggtcccaaagtgggacctggagtccttccgacgaggaagtgcagcctcttgtcgaggagtgcactgggaggggaggctggacttctgggctctgctctgcctctaatctgctgcccagcatcagccttagcccagacccccaaacttcctgggcttcattctgctttgcattcatctcaaagttaagccttctggctggcaggggtttctgagacagactgacagtattagcgtgctgcagtttcatgatggcaagaaggaggttaccaaagccgttttcatacaccttaactcatgagtggtagtgagtggccccaggtgggaagcacaggtgatttggagctggctaacctccttcctttggctcttactctcaccagctcttagacttggggtaggttagttagctcctcccagcctcagtttccctgtttgtcaaatggggtcatagagggtgagaatcagagtttatgcagggcatagcactagtgtaatgctgggcagagagtgagcatccagcaagtggttttgacaatgataataattataacccaagcgacacatacaatttaatcaggcactgtgtgtccacagcgatgtcaaggaacaatgcacaaagcagagtttttccagtctcctgatgtttgagccctgcgcgagccccactcttctcccttttctcataactgctgtgagcaacctcaaatccttctggaagtaggttggttatgaattatgaataattaaagaaataaactctggctctgcagctgaaattgggatcgcatggagaaaatagaaagtccagtgtttgtagctgtgatctctcagttgcttgcatgaattgtgctttaagattgtaaaattttagcccattaaaaataaaatctgttgctttccacccacacctggcaatttggtgagggacgggggctaggatatttactgtctgaaagttttagggaggcttttatgaactgggccatctctccttgtccccatttttctttgcatctccgaactctcattaatttttcacaggcttgtgatggatagtttttatttattcacgtctgagattccgttgtgtgaaaaggactcattttataacattacatattcatggcttgggatggatgggataaggaacttattattaatgtgtcactgtgggaaacttactctagttcatttgcgaaccttgttaaattcggtgtggtcagcagacccggtgaagttttggatacattctcttaacagagggcaaagagtttgctgttgcttttccttgattcagtaaaacaagtttaaatcttatttaaatcgtttgaagtagcaatttgaaaggggaggaaaaaaagggggatggcagagattaagtagagagagaagctccgattttcttgttgaatagccgtgtttcctcagcattctgtagatttttggccaggtttgtgtaagggatgaacgactctctataaaatgatgtcaggatcctttctttcctgcccattgccatttctagcattctctccttgagggaagttgcagttttctccctctgtgtattcatccttctgacctgtgctccggattccagggagttctcaatttggagctcataccgacatcacagaattccttgcctgggacaaatagagggaatattaacatagcatcttgtaaatcaaagctgggcagggggtgggggagggcacagtggggaacctggcccaatctgcttcagtgtgagcttggtaagaaggaagcatatgttgcatttagttctctgcaaagacaggcgctgctctctggcagggacagcgtgtagggtttgcatgatttgtggggccgtttcatgtttgcacggtttggcttggcttgggactcggccagtggtcactgcagtttaacagattccccccgggtgtgaaggaaagcgagataaatgcaggaaaaaggatacattttgaaatctggaaattttacataacaggcatcagatttgaagaatgtccaaaatattacgaatcatagcacaacctttgctaacaccgtggaaatttttgaacatggaatttgttaatgctgacttggcccaccatggggttaaaaaaagtgaatttctttttgataaccaaggtgatgatcttatgaagttgatgatggggtgtgaacggtgtgagtgggggacaaagcaatgaaatatcccttaaaatgcatcctctgatgatgtttccataatgccaaacatttgtttctctccaggatctcattggcggtttgctggtattatattgccatttatattggaaaggcaggcagtgcgaaaactgtagtctattaagagtttgtgagtgtgtgtatgtgtatacagtgaaataatatctagtgtaatgtgaagtgacagtcaaaattacagcttttctcttgccgcaagggtacttctctgccaagtatagtaatattgttgtagcagtgttcaaggttgtcagcaattctggcttactctgcagagagccataatagtgtgtggaaggaaggagcttcctgtcaggggaaatactataattttgatatatatttgttggtgccaaactgcaattaaataggaggtgttggaagaaggttttatttaaccagcttgaatttgttaattaattagcaaaaacttatctttggaatgcttcaagaaacagttctatgttgttctcataacttaattttacacaactgtcttttgtttgtatcttacagaaaacaaaataccaccctccgccagaaaagtgcagaataaaaattttccactagcaaaagaaggaaaaaataaaagatcttgaatagtctcatcaattacatcttcttttgtgggtatttcctggtcttttcatgttttgacttctatctcggtgatctgacagacatgtacgatttgcaacaacatctattatatgatttaatttatacctttatcagtttgcagttatgctttacgactcttcaggtgactaaagaaaaagagggtgttttaaagtgtgtgtgtttgtgtgtgcgtgtacgtgtatacatgtgtttttctgtgtacataagtgtgtgtgttttaaattgtttgaaaaacactagtccatctctattgtattatctgagggatgctagctcgttacttgggatagtaacaagtttcttggtgacaactcctcctcccattgtcaaggaagactgaggatgtcaccagagttcgctgtcaatggctattcagatgaaaaataccttctttttgaataagtagaaaaaccatgggggattgaaatagcaataatatattaaaagctccaaggcagttatgtgtgaagaaataaagaacagaacagagagattgtgttgttttaaaaagggctatttaagagtcttgaaaagagtgtgtgtgtgtagggggacacctccctctcatattaagtattttgcaaattaaatgagtttcattctcctataaaatatgagtctaatcacattttatatgattgtaaaatgtgtctacttttgtctctatctttcatggaaaaaagaaatattcccaaagtatattataaaaaataattaataagcaacttttcatcattattttctgaggttaattattaccctaagaaatcaatttcaatttcttcagtttgaaagactcatttgtgatggggtgtttccaaaaagagagttagttaaatgctatatggaagccttcattccctaaagaaaatgcctctgctgctggcagtgatttatccagagctgtctcacccatttatgccccatgccaggagaatgtatggaaaatgtaatagagctattagaatccagtgtagtagattggtaatagtaaggaacaacagttgtcttcacattgttaaaataaaagtgagataccctttaatcttcgcaaagggaaataactcttctgctaaccctcctgcccaacctgagatgaagtatcaggggatgcagtatggatgtattttcctgacgattggtccttctgtcctgggacccaggtgtgagtgcatagggaaaagggaggagaaatttaatcctgtaactatctccttatggaaaacaggaaaccacagatgaatcaaatgaatccgtttcccctctttctgatcctctgcaaaagtcatcaaaatcactctgttctcaccaggcaactggagtttcgtcagctgagtctagagtgttccaggcagttacagctaatcatggcaggctctacccaactgggggaacaatttagctgttgtgggatttccctttaaattaaatatgttcttcaggtacagttttttaaaaccagtttttctcccccacttttaacctactttatcgtccattgctgggcctagaattgcatgtccattggcatggctgacgttatatataaatatttggaattgtagttgtaatgatagatattatatatatttcacatgttttaagattaacatattaacagtttgtgatattcaacaaagaatgcaataacttctgcgaaacaggtaagagaaacaaccagtcacttgatctggatattgagacgttacctgtaggatatgtattaggctgttcttgcactgctgtaaagaaatgcttgagactgggtaatttataagaaaagaggtttaattggctcacagttttgtaagtggtacaggaagcatagcggcttctgcttctggggaggcctcaggaaacttacaatcatggcagaaggcaaagagagagcagcaggtgacatggtgacagtgggaagtgacagagcgtggggtgggggtgggaggtgccccacttttaacccttttcctgtttaggaaaaaaaaagcgcagctcactgccagcgctcatttaattttacataaacatgctctttgaagctgaagcaaatgtgaccgattttcaaagtgataataaaatataaaaacagttcttggaaatatttctgaacagaactaacatcagaatcatctgaatcatcagaattgtgtattttggaaaaatcggattcatcaaatgaatcttcagccaacaactgttcgagaattatgttaacatcacatgcaggaatgctacattttctcggatttgacattttcagtgatggagaactattatattttgtaaatggaaataccactactaaaaacagaaggctataaatagaacgatatccttcgtttccaaagtcgatatgctagagtgatgtgaaaaaaataataaaagcgagatatttcatggcaaagcgatctcagggtaaacactgcacaccagtaagtattcttggggcaaatgggaaaagggttaaaatgaccagatctccagagatctcactcactatggtgaagacagcgccaagccatgagggctccgccccagtgattcaaatacctcccattacggacatgtttcaacatgagatttgggcggggacaaatatccaaactatatcaggatcccagcagactgggtgggtggaggttcagggatatctgggaaggactaagaatagctttttcttttagtagatcaggagtttcctcttacacacaaaaagctccaaatttaaactagcttaagaggaaagggtcattactggctgacaaaatgcgaagttttgtgcaagagtcagcaaagtttctctgtgatgggatatttaataaatattttggggccttgtagtgtttgttgccaactactcaactctgccctcatagtgcgaaaacaggcataaacgacatgtaaaggagcaggcatggctgcgagaaactttatttatggatactggaatttgaatttcatatacattttcatgtgtcacaaaatattattctttcccccccgcccccaaccatttaaaaatgtgaagcatttttagcctgtgtgctgtataagaacacagccgtgtttggcccagcggttatagtttgccaacccctgcttagagtctagctttattcagagcttaaatatgtcatcgaggtcccctctttatttaatcccttagttttgatgatcttttatgggttatattcttcaaagggaaaattctctccaaatggggctgccactggcagacgagcactgtcccatcttggcttgttcccccagtgacaagaagctgttttccccactacccttggcccaaaagccacagggagaaccaggattggcctagttttaggcagacacctatccctgaatcagtcatgtccccggatgatgcggttctctgcagcctgggcagtcaaggctggagataattctctgcttctccacggagtctgagaggccccgttccctaatggtaaaatgaggtccaattttgcaaaaggaggcacctggggaaacattctggacacacaaatctatagcttctaccgtcaatctgctatgatccttttatggttctgacgttgcaattttatttttgcatgtttctagagacatcaggaggggatcttttcgggatgtggcttcaaaaaggagcctgttggatggtctcttactagtggtcagcaaagaacagttcttttgtaaattgcactgcattaagagcattcctgtttccatctcattgatacctgccttgcgttctgttacctggaagcacaggtcaaggtagtcttcttgttccactgatttgatgggggtcaggatgctttcagaaaggaagtgagaagagtggcttagaacagggaaaatgtggccgggcgcagtggctcacgcctgtaatctcagcactttgggaggcctaggtgcgcagattacaaggtcaggagattgaggccaggctggccaatgtgatgtgagaccccatgtctactaaaaatacaaaaaattagccgggagtggtggtgttcgcctgtagtcccagttactcaggaggctgagccaggagaatcgcttgaacctcggaggtggaggttgcagtgagccgagatcgtgccgttgcactccagcctgagtgacaagagcaacactccatctcaaaaaaaaaaaaaaaaaaaaaaggacagggaaaatgtccaggaaggatgtggcttagctgaagatcagcttcagcttgatcccacgggaagctctggagggtgaattgtacagcagagttggtcctgactgagaccagggcctggctgacctatggcagtcagcgatgagccagtgtctgctggggaagagggcggcgtggacatagcctctcaagtggggcaggaaggggtagctgtgagatactagctaattcttacagcttctgggttcaccagcccggcaggagaatctgggttgaggaggcaacatgacaacgtgcctaccttcaccagagagactgctgtcaaaaatcactccatccatgcaaggaggaacgatgcagacacagaaattctctgctgtgagggccagcactgtagtatttactgacctgctccccactccacacctccaagtgcaggtgtacagactgacatcaaacctttcatcccgccctcggcctcatacctgctttccactctgtgacctatttacttcgatggagtcattttcaaataacttttgtttagtgaaactcaaggcttttcaggatgctgtgctaatgtcttccttttttaattgagtaaatatattatacacagctgggtaggttgtttccttgctggccttactgctacaatttgaaaacggatacagttttctttaactcacataggatgaatgtggcatttattcctggtttcctgtggctctcctcctttagaaaacgtatttacatggacgtttttgaagcacttcttaagacatcgaaaaattaaaaaagaaaaaaaaaaagaagaaaaatctcttttccctcccccaaacaatggttacatagtgacaacagtgggttgagctaaattcagctacgtcaaggaagagcaataaaaggagatggattgttctctaagcttcactttattggatattgtaattgacatatagttgtcatttataatcatctgtccattcctgtgaggtgggagcagtaaagttaattgtggcagctcatttgcattaatctcacctctgaagggtacagtaacccattaatatcacgtcatgatgaattatcacaaataacattgaacatattgattaatgatctctgagatttgtatctcgttaaaacattttgttagctctttaaacttttaagccaacaaccattgcgtgtaggaggggtttagagatcatctgagaggtggtggtgggtggtggtgtactttgtagggtcactggtttaaggggttggacaacccgttcccatctgattttcctcttcttcgggagccaagtactttttgttggtaacttccgtctactttttgcaggatagtggtttcttcaaaacagtggcttctttgattgtaaggtggctccgattctcaaatggaatgattttcttaagatttttaaaaattaccccttcaacaccttaagtgctggctttctgaacctcttgcccacctaggcatgcctgctactttgaagtggcaagagttatctttgtctattacatcagcattcctaaacttacatgttaacataaacatggagctcagaggaaatgtgttgtttgagatgaaccatcgtttcaaatgtcacttacttcttgttttataaagtatcattactcttttcttggacacagtctcatctttgaggtgtttgcagattttatctcctgtggacatttctacaaaatcaatcaacaaacttgagcagagaaatcatcatactagccacacacactctgcaggcattaataaaataatagtaaattctctttaaccaagtcctttgcagaatttcctggtagaagtttaaatgcaatagatgcagtaaagaaaagggttggcttaagagttgacttacaaagcttggtcctaacagctttttcctttatctgtttcaagagtcatacgatatttgatctttcaaacttacgtatttcttccattatgtttagtattagtttcgttttctcaagatacatatttaacaactagcaaaatgttggaagcggtctcctctgctgtctatttagggaaaatggaactgatctttctgaaataggcatgcatgtaatgatgatgtcattaatgcttggctagctggtggacttaaacccagagggcacttctgaaaaggggcaaagtgcatctgcttctgctttgtttatagactgtcagccttggatctgtcactccctcagaagggaaggattgaggccaggcaaggtggctcacatctataatcccagaactttgggaggcgaggtgggaggatcacttgaggccaggagttcgagactaccctgggcaacacagtgagaccctgtctctactaaaaaaagagaaaacaaaattaaccgggctgggtggcacccacctgtagtcctttggaggactacttgggaggctgaggcaggaggatcacttgagcccagaagttcaacattatagtgagccactgtactccagctgggtaacagagtgagaccctgtctctgaaaaataaaaactaaaaaaaaaattaagttagaagggagggattacgaccctcatgtgtatcaagaaacaagctccatgaagccccataggatggctcagcaccagaacgaggtctgactgttaagcaaagtcaagtgcatgatggctgaacattgctgggggaagattttgcaattatgcattgtttgtgcctttagccagtaggtaaggacagtggtaccattctgacggactctcggatgcttggttttatggagggatcttaaaacagtaatcggcccatatgtgcagcaacctttgcgcctaaatagctgaggacaaagtaggttgcttacttcaagagcccttccctttctcttctttgtcaggcctgtaatgttcctcacccactgagtatttaatatctgtgttttcacatcaaagaacaagctttctgtctcccaggatagtatcttgtaaagccagcctctttattacttcaccagttttaaggctttattacttgcgacctaaagcctgctagtgaattatgcatgttagaactcacagcaccgtctctgcccactcttttgccacctttttgggggtccaaaaagtacaaggcgagatcgacgtgtgttcattcccatccatggtattaatccttattcatttaaaaaaatctgctaacggaaatatttccattcagctcattaatcaattgtgattttcattcccttgttttgtaaaagctgttgcaataaatacttttttcacaaggcgaaaatccaagagatggatgcagccagcgtaattaattgcacccagttacaggagatcagcaagtttgtgagattcacatgctgctgtaccatatggttgcccagtgggcgaaaaatttgattaatgttttgaagtagatttttttcagcaaatattgcagccccagatgaggtgggggttgtcccccccttttactttctagtattgttagacttagctgaaggaaacaatcctctgatttaaagcttaataatactgtgattcagtgaaaacttaacatgcgataaaaattacatttctctcatctcttgtggatacagaaaaataatacatgatgtcttcgtttgtaattaaggaaaatgtgatcgttggattctaaaacttgattcttgattttttttttcccctaagaaatggaactgtggttttcactgatgcacttttggtatgatttataagtagtatatttgggcagactcttcatactcaaagcagtaaaaaataaaataaaataaaatacaatgaatccacaaacagcttcttcttcattatgtaccctatacctattagagcatcataaaatataactatatgagtatcatagaaaagttaaagctgtctctactctgttatgctaagatatattagtttcataaccactcaatatattcatagttaatttatcctttattttaaaaaaatgtcctgcagattttaaaatcaattttatagtttcttttctgtttttagttagaaagttcattttatcttagcagctccttgtcatactgggcacccattctcttaggatgctgcccttctgacttttttctccaatacctgggagggaattagccatttggtaatacaacgggacaagcttatggtaggtctgacctcagcattcagaaaaacaatgtgaaatttgtaatatgtgtcagaactggcaatcaacgccataaggacaataaaataaaatacatttctccactttagtaaatgaggcttcatgcttcctatggcataacttttttgttgttgttgttttttcttttctttgaaacggttttaaatttctaattgcctaagcaatctatgacactccttcaatcttaatgtctgttgaaatgaactagcatctcaagcagttggagcatcatctttaactagacatcaacctggttttgaatcctttgagttttggcaaatagaaaattcatccagggccacaaaaaatatctataattttgacccagttgtagtctagagagatacttagttcaaaaagaattgtgttatcgtcatcaagcaaaacaacagtatatgctatcatctctgagatgtcacacgattattgctttttttttccttttaaattttttctttgtgtctaaagcagtttaagagctctaagtgtgctctgttttctgatggcttaacaagggactggctcaatcaaaatagagaaggaaaggacggagaccaggccaaaacggccatctcctctgattttcgattcatgatataaatttttaaacaaaaaagttacagtgtttttggtactttcactaggcttctaattttttttcctaaacttaaaaaaatttttttaagatcaattatgtaataattagccacaaaggcacaagaactgtttcagtagtggcctgttttaatgttccattctgaagaaactggtacagcctttctttcctgagtttgagctgaaactctctctttcccttttatcaggtcgctcaaaacagatttttagagtgaagcagttttagggacaacatttaggagaaacatttccctaagattccctaacatttttttctttaatttagccatttctaatgaatattttttaactgtgcaatttaagtaatgatttttttaatgcctgctaccttcaagacacttcgtgtggtcacctccaattatagactaggtttttaaatgaaaaacggaaacacttttaaatttttatttaatatggccggtgaaacatgaacaatatatgatcagttggcaggagacagtgtgatgaattatttatgagtttacttttttttttttttttgctttaacagcacatacatatatgaaattcattaccaagtgataggacgggtaacccagaggttctgatgagggccaggacctcatggtcataaaagtaacattagacctattcctagtaatttgatctaggttggcctgatttttgttgtggtggcagtggtggctgtggttgtcaatttaatggaatgtatttggaaagagcaagcttcttcccaatgcagtgttttccctgcaaaggagaagaaatatatttcttgcctctctttccttagtcctgtgtgcttccccttgatttcaccaggacaattttataccaatcccttgtattttagaagagcctgatacatttgcaaggtctctctttatattcctgaattttgcatccctagacatcatcctttttgagagagaaaattccgagtgtcagttttcctttatcggaacctccttttatttgaactaaccacaatgggtcataatttataggcccagtcagcgcatcattgctcagatagagtcatttacctacaagtatccatcagttaggtgggggctgctagattttttaagtggaaaaaaatccaaacaggttcaggaagaagaagaaaaaatcatcctgggggcagaagaacaacaacaaaaaattttccttggggccttccaatttgagattgttgagtgttgccaagcaaaactaacacgcagtgggaaggttctgcttttctcacaaattctcggttaacacaaggcgtgccaacagctggtagagcgagagtcagggtgccaggctgaaatggagtggaaggcagccctggctggaagtcttgctgggaacctggagcgctgggaggtaaaactttacttggtgctggcagcgtcactatgccagtctgtttcttcccgagcttcaggccatgctgatgttcaagttgaataaatgagagctaatgattttttaaggcgtttttagtgaattgccgtgggaatgctaagttggcaagaataaaacctaggcgaggagagttgatttttgatgacccaaagaaggcatgtcctagagtggtttagtagagctcgaatagtctaagattgttccacatcaggaaaagtgtacagttatcagaattacttactaatgaaaaaaaggggaaaaaaagattattaggctgcagggtagtgggaaggaacagggtagcaactctacagtgacttggtctgagaaaccctgtaacttggatccagccagggaagtacttttcccaacaatcggttccgctgtcctgctgtgaccagtaacaggggaaaaaaataaaactcccctaaaggtaaatgattcacctcatgaacgaagggaagaataagagacctaagtttatatacacagattccaattgtaaaatcaaacctattttgttttctaaataaacaatatttgaaaatacaacattgcagtcttgttttcttttatactggctaggatggtctggtcctttagaggaggtcctgaataaaataatatgggctgtagagagaaacgccgtttgcttgataggtgtttttgtaaaggttttactggcctacagtgtcagtacattgcaaatttaagaatgttcactgacatttttagtagccacttaaaaaatttttctaagcaatgatgtcattgtattttacttataatcagaagtacatcagcccgtgaatttagttaaaggtttttaatgtcacttttattacatttttactgtgcattcatgtgcacacacacacttttaagcatttttgatttatatatccctctgcatattttgtgccttgtgatgtgtttaacgaatgacagtgtctttagtgcattgctacttggggtttctacactggaagtgtaatccgaggccttggaattggtcaaacaaaactcacttggcaacatttacttagagagcactctgcgagcactctgcgagcggacatgtcgatatcagctccctcctcgttcccccccccaccccccatcccatgtttatttgtaattaaagttaagatgcttgagaatggctttaccattaatctagaaacatagagttgtttcctggtgaatgatgtatgacagttttctttgtgcttcctctgaatagagagtagtttttgtggcattgttacagagaacagctttcctgtagggctcacaggctcaactgtttcaaactcctgttgttcggtaaatctgtcagaagggtctgcaagggaccgtatttatgaagagagtgtagagtggtcagtctaaaaagctccttagtgtagtactttgaattttaaattacacacataattcaaaggtaatgtaacttgccgtgtcggactttagtccattccgttaaatggagaaaaatgactgacgtgaagaatgacttattgattcttggtgggaaaatgacttctgtaatatgggaagtatggtaaaaggaatagcttaattatttagggagcacttttcaaaatgtgcttttacagcagtacaaattgtacgtatacaaatggtatgactaggttctttttttaaaaattctttcataggagaaagttatgagaaggcttatattatttcgttgctaaggcaaagtttaattttgcttaaattcctgtaagactaactaagaaaggtaggaggagtgatgagcagtttcttaaccctttaagaaatatgacttgttctaattgccttttcttatttacattatacttaggctggtgttaggatgccgtggctgccaagtttacacagtgcactttctctctctctttcttcttttggtttatgatgtttttcagtagtgtcatggaactcacttaatctgatttcatcaagtaaatatatgggaagttgagatgacatatttttatctgacatttgaagaaatattcataaaatagcagataaaatatttattttggccttttcattctgatctctcttttgactcgatgtgtattctttgcttaaggaccacagcctaatgttattttgactgcatttcacagtgttggcggcctttcagataaacagcatatttgtggttaattggctgaacatgttctataattataattatattaaaaccttaatgttcttgaacgtttgcccgcgaaggccactcacgtgaactaagttatgtttctgtcgttataactgagctggctggcggctgccattcagcaatccaggcaggactgggaacctgggaaaactgcagaggtttcttattatttcggtctgaaaccgctgtttggatagttttagaagttgaccatgaaaattgccttctggttgtaacttggatccccaggtttcaatctgtgggctaacgtttcttgggattttcagaaaggattggcttggctttttatcaaagttacacaacggctgtaaaaaataaataaaaaaaaagcaaaattagcactttatcaagtttggggcatatttccaaggccaccagggagcagggaaagtcaccaaaagaccgctccttgaaaccaggcaagaagccatctttgcagtgagctgagaggtctgatggccgccagctgagggagggaattccccttttgtgccttcgggattgatagagaagcccagtggacttagcatctgggaatcccagattgatcttttctggatattgggtcaaccataagatggtacctttccctgtgtaacaaagtcagattctgtgaaacacctgttttttgtatggcttatgagatgaggatgatttttaccttttttttttttttttttcccttgagacagtgtcattctattgtccaggctggagtgcagtggtgcaatctcagctcattaacctcaggtttttttacagaaaaagtttgccaccctctgatctacatgatgtccttcagtttctgtctctcaccagactgatggtgccatgagggcaggggcaactcctatcctaaggcgtggcccatagtaaggggtattggttagaagaatgaaagattgaatacgtcaaagtgatgagtacagagctgtctgtcattttcttatctttggcctaacaactgaacacattttatgaaatttgcaaatctgtttccaaacatgtttgaatggatttttatggtcttttaattaacccaataaaaatggtaacaacacagcaattttaagaaaataacagagccaagtattttttatagctatgcatgcaatccacattacacccacatgcagtatttctatggtccaaataagtatctgtcggacttagaatatttaaattaggatttagttgaaagattatgttctatatcttttttttttaaaaaaaaggaagaaaaataaagctcttcctaaatttatttacatgttggagcaattctggcactgctaaataaggcaggaaattccattaagtttaaatgtgctgcccttaccctaaagtgtttggagggcttcgtagaagagccaaatagattcacacagatcttatttgtagagctgaatgtgcacttcattaaaatactttgtaaggtattcaaggatgggctaggagggtgaggattccaaatcagaatcttcaagccagtgatccaggccaaaggtattctgccagagtgtgaggaaatttcacagcctcatggagacacctcccctccccacccttgttgaacagactctggaaaagtcaccatttcttgttggtcctttgctcttggagcattcttggcctgacctgtcaaccactttagcctccaaggtatctgagcctttctttcgcctctctacttagatcatattcttcctggattttggaatcaggctgggacacaagccacctcctcctccattctagctgtgtggctccaggcaagtggccacacctctttgagccactagttaactcagctgccaaacagggattatacatttacctcttggtgttgcaagaattaacaaggaggatatttgtaaatctccctgggagctggatggtgcttaataagcaggcattaagggttgattatctttgcactctctcctgccagattttgtaactgagtccaggcatctttagaaacagaaatggtccctgctcttctgtatcccctgggataacctagcatcatttcgctgggttacacatcctctcttctctcctgtatgtcgtccctctttcttacggtggttctaagctctatggatcacttgtcttctcctctgagcgggaactgggcaattggaggttctttcccctcccgtgctggtgggagaattgtttagtaggtcataaagtggaatctccatttcagtctgatccggtcaattctggtaggacttcatccaagcacaaagaaacctttgttttcattcaagacttccctaaaaggtggctgggtgcggtgcctcaggcctgtaatcccagcactttgagaggccgaggctggcagatcacgaggtcaggagttccagaccagactggccaacatggtgaaaccctgtctctactaaaaatacaaaaattagccaggtgtgttgtcacgtgactttaatcccagctgctcaggaggctgaggcaggagaattgcttgaaccctggtaggcagaggttgcagtgagccgatgtcatatcactgcactctagcctgggcgacagagtgagactctgtctcagaaaaaaaaaaaaaaaaaaaaaaaaaaaaaaaaggctttcctgaaaggtgattcacaggcctcttcggatcccttcgtgtttagcaatttggatttccacacagccttgctgtgccttctgcccatttgtcctctgctgctggtccctgggtgggacagctcccctttctccttgtctgggttgctcagatagagccataaggattctccctgcctcaagagctgacttccttccacgagttcctaaccacctgtccagttgattcttctctggacctgccttgacatctctgtgccaagcccagtgccggggttgcagatgcagaggcactggtgcatatttcttgagttgaagagcttgcaactgatgagccccttccactcagaaaaatgttgttcctggtcttgccactgcctggaacccaccaacacctcctctttccaatattgctggcttctacttgttctataagagccatgttctacaagttctgtattgtgtgtgagtccctctcaacaaaacaatttccctagtcatctcttatttatactccttgatgcagatttccattttactcttacctcattctatcataattatctatttgtgtgtgtatgtatgtccccactaggctgtgaggtctgtaaaaggatagtctaaatacagctatctattgcaaatcttataatgtgactccatgatgagatagttggatatagccttatgttcccagcaggaaggaagaaaggaaaggagggagggaggtaagggtgagagagagacaagaaaggaaaggaggaaggaaggatgggaaggagggaagaagagagtttggtcaacatttgttgattgtgaatgaacaaactaatgaacactaaatgaacaaatgaatgaatgaatggacaaatgaatgaatgtatgagtgggtcaagaacaagattcggccccaaggagatacgcgactttctactttgttttctatttggatttcacacaaaggctctaaggtctcctggtaggccatgctcagaagtctgggttgtcccctgcccaggacaggctcaccctggcctgtgtcctaggtattgtggggccgctgtaggaggatggtggttaaatcttggaggaaatccaggagtctcatgtccccttggcttctgtcagaaccagtacctctcatttattttgaggtcttggctgaagatgtatcatctacaaccctgcagatcagatgtgttagagcagagagagtggcgaggattaatctagactgaaatgtgctaatcaagctgtctcagatgccattttctggatagggaggaacagcagttggcgagtttaagagcaatatggaggaaccactggggattctatgcatgatcttaggggaagtagcattattatctccaacactggctgtttacattatcagaataagaatggttctccaaggccaggtgtggtggctcacgcctgtaatcctagcacttttggaggatgaggtgggtggatcacctgaagtcaggagttcaagaccagcctggccaacatggtgaaaccctgtctctactaaaatacaaaaattagccggacatgatggcaagtgcctgtaatctcagctactcaggaggctgagatgggagaatcgcttgaacccaggagatggtggttgcagtgagccaagatcgcaccactggactccggcctgggtggctgagaaagactcagtcttaaaaaacaaacaaacaaacaaacaaacaaacaaacaaaaacttgtctccaaatgagcagacaccagaatctcatggagggatttttcgaacacgtagcacagggcttcgcccccagcatttttattttcgaacttctggagtgcagcccaaagatctgcatttctagcaagttcccagatgatgttgatgatgatgcctgtttgggtatcacattagatgaagggctttgctaatttcagctgcagagtattgactcatggggtaggattcctgccatctgcagcttctttgggtcatcactagggtagaatcttattttctgagtatgaaaagcatcaaagttattttagtaaaatgcttttgctgtcattgctttaaaactagctcttcgaagtgggaaaaccaaaagttttattgaagcaatttgttgtaaatatgagttctgtatcacatttgggaaatttgtaaagccttactttgaatgtctttttcttcactctatctgtattgtttggtgctttctatataaatttataaattggatgtaccgccacagatgtcggttttctggtaataatacttttttacattaaaaaaaactcctgaaatgaaaatgtaacttagtcttattattgtaatctccccttgcctttttgcatggatcatttgtttgtgaactggttatttcaggaagggctcaaaggtaatttcatggtttatagcatttatattggcgccttcgatgagcaaaacatattgttttctaatacatgaaaccaggaattcatatatatatgtatatatattattattattattttcattttctaaaattacatgtagtacatgtatatcaacttcaagacattgagaacaaccatgtacagaaattatactctgtacacaggggaaatatgaaagttttgtaatgcaaaaaaataaaaaaaaatcaacatttgcaagcttatgagatgattttatttttaatgaatccaaatggtagcagggagctgctgttgtgtttgtgcattgtacagcaattcatatctaaaaataaagtaacatatggctttgttattatttagtttaggaattgatgcacctaaaggagttttgagagctctgggtctcgttcggttgttgtacatggcaaccaaataagagtagctggagcagagactttctcttcttcagattattaagatttgagcaattcattttttttggatggtgtttattaaagtcaagaaatcttttgcttatttgctaatgattctctcccctttctcttcttatatttttgaaggctgaattggtaaaattatctggcccaataaaaatatgtcctgggttggaaaagagcacaagtttctttttctagccctggagtgaggtggctctctggcctctgggttcgtttggtatcctggggagtcattgacacccacacactcctagtcacaagacctttccctcccatccagattgtgtttattttacggctctcgcacggagcatgcagctgtgtaaacctgagaatggtttctgcacagctttgatctttgcatggatcaacagttgcccttagtccctgaaccctgttccatggccccatatttcttggatttttccattttctagtaattatggcatcatgtagggagccttccaacagcatcccccacagctttgggtggagaatttggaaaaaatgccttaagtctgccatttgtagaaccatattaagtagtgatttccatttgatgccaaaaaaatatgccatttagtttcttcctaagaggcaatctgacaatttcgagtagactgctggagtctgacaaatttgaatgtattatggactgaataaatgtttattgaacaaatgccatttttttaactcttaaaatgttcagttcttccaccaaacatagatgacacaactgttggagacggagcaccggactgatgcagtgtagcattattttgtaatctacgaactgggagcctatggagacctatgcatggtggaatacaaaagtcatgacctgtctttatatcctagtatgggcaataaaaccctccctttaatagccttaaacatggtacaaggaaactgtgcaggagttccagggaaggtgccatttttccatatggagttgatatggtctgactgtgtgtccccacccaaatctcatcttgaattctaattgtaatccccatgtgctagggggagggacctcgtgggaggtgattgaatcatggagaccgttcccccgtgctgtgagtgagttctcatgagatctgatggttttgtgcggggcttttccccactttgctctgtacttctctgtttcttctccttcttgccaccaggtgaggaaggacatatttgcttctccttccatcatgaatgtaagttttctgaggcctctgcagccctgtagaactgtgaatcaattaaacctctttcctttataaaccacccagtcttgggtatttcttcttagcagcatgagaagggactaatacaggggtgatcacaaacagcctgcagactgggccatctttcttaggcaggatctcgagctaggagatgagaagagctctataggcaaaaagaatgacttggaaggccacatatggcagagtagctaagactttggggtttccagtttcagatagacatgggtttgtatcctggctctgcccctcaatgcctgtgtgatcctgggtagtttgcttaatccttatgagtcccggttttctcctgtaaattgggattaataatagtcacagctagctgggtgcagtggctcacacctgtaatccccgcagtttgggaggccgaggcgggcagatcacctgaggtcaggagttcgagaccagcctgaccaacatggagaaaccttgcctctactaaaaatataaaatttgccacgcttagtggcacatgcctgtaattccagctacttaggaggctgaggcaggagaatcgcttaaacctgggaggcggaggttgtggtgagccaagatcgcaccattgcactccagcctgggcaacaagagcgaaactctgtctcaaaaaaaaaaaaaaaaaattatgtccttctagattgtgaggattaagcaagaccatgcatttacattgtttaacactgtccctgagacatagtaaggcctcagtaactgttagctctcttattgctaccggacaagtgttcttattttcccttttcttcttcttccttttcctgttccttgcccttcctctttcgaagaaagtttacgccaaaaaggatgagctgggttgcagccagcattctggtttcacaggagcctaggagatacatggagaatattctgaggctaggttaaatagtttgtctccagtgtgggtgttagtcatattcttatcagtatctgaagaacccagaagactgactctcagaacggaaaactcttggctagaggattccgaaagctagcgtgaagtggaggctattactcagtgggtgccgtaacatgtctgtgtcacctggcacctttttattctctaatctcaggagtgagtgcttcctcctgccgtgcctggccacttctcaccttcagagtctttggtatgcataaattcttcatcacttcagtagagtgaaccctgattacctacatttattaatgaaaacaaccaagaatagttgagcccaaaagtacaaatcaatgtgctgaatcagtttatgatgtctccctaatttctgcacatctgttgagctgtgatttcaaattccattccatttcttttcttttcttttcttttttttttttttggagacagtgtcttgctctgtcacccagcctggagtgcagtggcgagattggcaagatcgtagctcactgcagcctccacttcctaagctcaagtgatcctcccacctcagcctcccaagtagctgggactacaaggttgtgccaccatgcccgcctaattttttgtatatttagtagagatggggttttgccatgttgcccaggctgttctcgaactcctgggctcaagtgttgtgccctgtttggcctcccaaagtgctgggattacaggtgtcagttaccgcactggcctggaaatcctatttcttgtcaagcaggacatcaaagttgagatctaagaatttggactaaaatttggggcaggttgtttccactactgtgtattgagagatggcagggaccatcttgccgagtccaagagattgtgaagtctaaaaggcttggccgcagtgttggttcatctgtaacagctgcctacaagggaatctttgagaaatacagattgctgcatcttataagaaggacagtgcttaaaacagaaagaattgagtagaaattaagacatagcttgatttttttccaacagaatcatgaagtctgttcaattttctttttaaaaagtaatttaatcttctagaagatatctacgtttattcaataatttcctaaggtagtcttcaaaacctaggagcctaggagatacatggagaatattctgaggctaggttaaatagtttgtctccaatatgggtgttagtcatattgtcatccgtatctgaagaacccagaagagtgaccctcggaaaggaaaattcttggctagaggattccgaaagctagcgtgaagtggaggccgttactcagtgggtgccataacatgtctgtgtcacctgccacctttttattctctaatctcaggagtgagtgattcctcctgccatgcctgtcctccctccctccctccttccctctcccctctcccttctcccctcttctctttcccctgtctccttctctccctcccttccctctcttcctttcgcatctgacatctccaaatagtttttcatgcaatggcattactaatggcttgactttttcgggaaatgattcattactttatgatttcaattcagtaaccattttcagctatgccataaatttaaatcctttaccatcaagataacgtttttttctcctgtcactgaaatattatgattggaaactatttttaaaagttgactctgtttgggacagctcttagggatttgtcctttataccagcatataacttgtaggttgtcagtgtctccaggggccatatgttcaccacctagactcaacagttgctaatgttttgccatgttttgtcagttcatctatctgtccatctctttgtccatccatccaactacccacttacccatccatccatacatttatccatccatctacccacccatccatccatccatccatccatgcatccatccatccatccatcatccatccatgcatgtaagttgcagacatcaacaaactttacccttaaggactttggctggcatctcctaaaactaaaggcattgctgtacgtaatcacaactatcatcattatcatgtctatgaaattggtaataatttgctaacataaaataatacctagtccataacaagatttactgaattattcacaaattgtcttttatagctttttgttttcaatcaggctgtaaagttcacacattacatttggtattgtatcttattagtctgtttattaaagagtttttttcagggatcagggttagagggaaggctcctttctggatactgtgtatactactaattttctttatcggctaccaaggttttctttatttttttcatacttttctttcattgaggaaacttattgttttgtacattttgttgtacctttatgaatctggttttgacttctggcccagctaagaagctggtttcctttggtgaaacatgggagaagagggaggaaaaatctgttaattagaattgtgggcgtgcactctgtttatctctaacagaataggcttcccacggctctgagctggaaaggaagattcaagtctcaggttaaaaaacaaaccctccaagacctcagggctgtttgcctgtgattagagtctaagaaagactgagaattggaaatcaggactgtctctggtcactgatggttcaactacagcacagatgcactgggtaacagacacaccgccaggcctcaggattacgttacctagggttaggactgagcctttcttccaccttcttggggttggagggcaggaatttaacatatcttagatcacagagtaaggcctcttctacccataagtttggtttatacatcaaagtaacattctaaaattagatgagggtgttttttttttttttctttttgagacagggtctcactctgttgcccaggctggagtgcgatggcacaatctcagctgattgtaacctccacctcccgggttcaagcgattctcctgcctcagcctctctagcagctgggactacaggcgcctgccaccatgcccggctaacttttgtatttttagtagagaaggggtatcgccatgttggccaggctggtctcgaactcctgacctcaggtgatctgcctgccttggcctcccaaagtgctggggttacagatgtgagccactgtgcccggccttagatgaggtttgtagatgtgtttttcatattcccaaagccatgaaatttgacaggtaaatatatcagttataaaagttttaggattaattatcaactaactcccagaagttgcctcagcctctctttttcagccttgtcttgccccagcccagagacaagccacagctataggttttatttctgaaggagaaaactcagtggaccattccactgcctcaggagatattgcctacctgcagacatgttttgtcttatccacacatgatgtaaaaacaaaataaaaatgctgagagaaatgccaattcagaggtttcatataaaaatatagctttcccattagacttgaaaattggaagaggaggtaacaattggccagtgctgagtagagggcatgtggtctctactttgccacaatctccaccataccttattgtctcccttctcagtcgaagcagctttacacactcctgctacttgccaagacactgtacacatttaagtttgctacctgttacttggcatatctcttggttcctaagagttttaggtattatgcaatttgccagctccctcagcccctttcctggctccaaacctttggctttggtttgatgttactgggttgctgcaggaaatttccctgtggacctcactactttatcaactgtaatggtcttgttgaagacaaggcttagaacatcatcagacccagagcctttctcagaggacctgggagaactctccatatggattttcatttgggaagatagatgctcttattggaacagctggttttccctttaaaacagggagtccagcagcttctaggatgcttagaatcagaattgttgctcactttttaaggtatagagtatttgtcttattcttaactacattttatatctttgcccttttttcccctactttaaataaaatctatctctaatttatgttacttaagcaatgacaaattctttttctgatagacaaagtaaagtataaataaataagacatccaagtaataatcagaagtattttttatgttggtctcattgtggtctttttaatcccaggcctgatgcgctttaggtaccagccttggttgaagaggagcttgaacagcctacacagacatgaaacttgagcaactgagctcatggacgttgcttttaatcaggatccagaactagggagttgagtgagcttggatttgagctccacttttcaaattttcaccacctgtgctctttcgtttttgttttttgtttttgtttgttggttggttttttgtttttttgagatggtgtttcgctctcgttgcccagtctggagtgcaatggcacaatctcggctcactgcaacctccacctcccggtttcaagcgattctcatgcctcagactcctgagtagctgggattacaggcatgcgccaccatgcccagctaattgtgtatttttagtagagacgggatttctgcatgttggtcaggctggcctcaaactcccgacctgagatgattcacttggccttggcctcccaaagtgctgggattacaggtgtgagccaccgtgcccggccagacccgtgctctttctcccaccactgccctgtgccaaccaccacccccactcctattctggaaagagccaagccgtcagctattgcttttgaatctatacgcaattctagcagcttcttttagagcccttttaaattagcatgaaatagttttactagccctgaggtttcagccaaggagctttaaaggagccagccctttgtttacttatttttcctcttctgaacatttggaaacatagcttcggtgctccttctccaagaaacctgagtcatgacctccccaaagtgtttccttcccgtggcctcttctcccgatcagctgtttgttatctgagggattcgttaataaccaggacatctgattctcatcattactcatcctctgctcactctcctttctaatgcataggcctttagccttttactttctacctttttgaatgctatacttttttgtaaaattttaattaggttaatgcattgacattgttcaacattcaaacgatggaaagggtgagtgtggaggtttggtttccccactttttccagccatgctgttgccttctgcagaggcttctagaattttcagatgaatgagaatcctttcagaaatagtctctgcaaactccagcacacccatagtgctagggtgggtcttagtaaaatgtctgcagggtaagcacactgttttgcactccacacaattcacttcacaatatttcatagagactttttcatattaatatataaagagatatatacgcgtgctgcttcacgataatccattgcagagctggtctgtaatttattcaagcattctttgttgatggatgttagggttgtatccattattttgctattatgaacaacaccataatgggcaaccttgtacacatttcctgtcaacatgtatcactgaatggaaaggatctattcctagaaaggatccattcctagaagaggaattctgtacaatatggccaactttctctctgttgaggttgaaccatttgacacatttcgctagcattgggaaaatccccattttcctcactatccatttttcttcctctctttccttcctcttttcccttcttcctctttttttttcttttctttccttccctttttccttttctttccttctttccttgccatttaaaacatactgataacttggcagcacagggcagtgattaaactcaggcactcaccccaccctacctgggaatctgaattctgtcttttctgctgctgtggattctcagtccccaagttgtgtaaatcaaagcttctcctgccacactagtgtgtattaggccaggacttcatagtgtgattcaaatcaccaactgaatttttttttcctttccttcccctttctgggggactacgtttttcatggagaccggggccctccagctgctgtgatgatcctcccttgccagggaggtgctgttaatagcaaatgccaagtgagctggtgttctgtccctccggcctccttgctcacaatagccaggaggaaaaagccatgtaacctctggatgagtcccttggccatttagaagtgaaatgaacatccaagaagaagcatagacaatgtggaggaagaactcttccaaatgatggcagggatatttggaatctttccccctgagttccctctggaagttaaagcccagatcccgtgaactgattaaaaagccccagaccattcccgttccagtcatcttgaaactgagcaagaccgtgtcatccatggagcttgaacataggagcactttaaaaaaaaaaagaatgaaaagcccctttcttgttttggtaatgatttaatgacagaaagtcacccacccaccacttgggtaccacgcagcccacattaaacaattagcccttgacagtggatagttcaagttagtttgaaatgagaaattgccggtgacctgaaacccatcattattaaccttgtggcacaacattgccataaccagtagccaactctcattttttctttttcttttttttggttggaagaaaggctcattgaggaaagttggctcagttcttttttgagtgaagtggtcagaccaccaagaattactttcctttgattgggaacaggttctaatacagatgtcctttacatgggcaatccacttttctcattgattccacaatcaattcgagctgtgtttatatatagacacctgcccacagagaccatgtggagaagcatttgcgtctcgctgcctgtcttccaaaggatttgccttctagtaattcatgtttttatagcttaactacatttatagtgaacgggtggcttcttcatccaaagaaagaacaaatgacaaaaagaaaaattttgatgatttgggaaccgcatttatggaataataacattcatgatacctctggataatgacaataattacagtatacgattctagaagggtgagtctagctgttcccagtgtgtttccatgggttgttatgtgttactggtcaggcgatcagggatttgctgaagattttctttcccatgtggcagtagatatttcagaaccctgcatcatggtgtccacagaagtccccagagttgtatgagagttcatctgggcacctttcccaaaggcaggccccctgtgcagcttcaactattcactctatttataatgttgttcctggatattgggcttgcttccacttgtggccaggagaggatatttcttactccagatcaaagagttgagacattgccttcccacaattcccagtgagcccaactccttaccacaattcccaccccatgccttccccaaattcctgatgagccctatgccttcccacaattccctgtgaattttgctccttcccacaaccccagtgagccccactctgtcccataattccctgtaaatctcactccttcccacaatccccactgagtcccattccttcccacaattccctgtaaatctcactccttcccacaatccccactgagccccactccttcccacaattcccagtgaaccccacttgtgtagtgtgtctgtgagtagtctgcccactctccttatgacaggtttccagtattatctgtttcataacccatttccaaccttctgggttttttccttcaacgtttcctgtgacagttctccattatatctttgttagataatagttagcaacccattaataacttccaactttttgagcctctaccatatcttgttttcactgggatttctacaccgtggctactttgtgggacctgacttatcaagaacttaagcagcatctgttagaaaaggtattttttttatgaagtaagtagggaactaactacctgttcactgctgcccgttcattgctagcacaatgccaagtgtcaaataaatgtttcttgaacaagtgaatagagtacgcttctaggcttctggaaacggtgaatgttgctttatgtggcaaaaagggactttggagatgtgatcaagttcaggatcttgaaatggggagatgaacctgaattaccgaagtgggccctaagtacaattataagtgttcttatgagagggaggcagaggggactgtgactacgaaagaggaggaaacagggagaagaggtgaagcaggtgtgaggcaacaatctggtggcttctagcccctgaaagaggtgagaaatggattatcatttggaggattcagaaggaaccagctgtgctgacaccttgatttttttaacccagtgaggttgattttgggcttttgacgtccagaatgataagagaataaatgtgttgttttaagacctaagatcatggttatttgttagagcagtgatcagaaactcatacaagtatgaatgctaagagtaaaggcacctgcctcccacatactggacccttaatattccttttcatgggaggttttgcagattgctgccctccttgctctccttactcttctccttttactgaaaagatatttactagatgtctagcatgttaaagactgtaccttaaaaaaaaatcacactctaatttagcacagtttcaattgtggttaagcaccatgccattcacacttcagaaccaagctcagatccatgtgtgacactctggaatgtggcagctgatggaggaagggggctgaagttgaatctgcagtagttgagttaaccttcccatggtgcctgcactagcagggactggactgagaccccagctttcccagtcaggccttcatttttctctcatggtgagagctttggaaataggcagtgcagtgtgggagtccttcccctagcatgttagtggccagcaccatgccacacagccacccagagctgcaagagagtctgcagaggtgattgccccttgctaggtgagtgtaaaccaaaaataaattctaagctccccaagcaactgaatggatccctgcctctgggccaaggggattccgaaataaacctgaaaaactagttcaggcagtgatgggaagagggggttggatatgactcattatacccttctttttttggaattcagtcacaactgaacagcattagcattaaaacagatcctaaggctgacaaaacagactctttatagcaataagataccaaatttcaaccctactctagtataggatcactttgcagatagcaggcatggaaagaaatcaaattattttaccccaaaatatatttctctggtatatttcgaaatggccctgcaaagctgtttcttgtctacattctgtagagaacatccttccctttccaggtcttttcctgatccaggagagattcactaggagtctggcacctttttagttttgataagagatatttaccatttattctctctgaggcctatttcctggaggcttcatctgcatcataagaaccttggtctttttgtggacttatcttaacccagatagtcctttctactgatgccaggtgtttagctaataacacttttaaccaattgccaatcagaagatccttgaatctacctgatacggtttggccgcatcgccacccaaaatcagacagtcctatctgttgatctcgggtgtttagctaataactcctttaaccaatttccaatcacagaatgcttgaatccatgtgatatggtttggctacatccccacccaaaatcagtcctttctattgatctcaggtgtttagttaataactcttgtaaccaattaccaatctgaaaatccttgaatccacctgatatggtttggctgcatccccaccccaaatctcatcttgaattgtaatccccacaatcccgacatgtcaagggagagaccaggtggatgtaattgaatcatatactcccgatagtgagttctcacgtgatccgatggttataaataagtgtttggtagtttctctgcgttcattctgcttcctgccgctttgtgaacctggtgctttgcttccactctgccctgattataagtttcttgaggcctccccagccatgctgaactgtgagtaaattaaacatcttgcctttataaattacccagtttcaggcagttcttggtagcaatgtgagaatgggctaatataccacgtatgacttggaagccctcatccccatcactttgagttgtccttcctttatggaccaaaccaatgtactccttacatatattgatagaagtgtgcctgtaacttttttcccctaaagtgtataaaatcaaggtgtaacccagccaccttgggcacacgttcccaggaccccttgagactgtcttaggctttgttcactcttgtttgggtcgggaataaacttctttaaatattttagagtttcactctttcaatcaacgtacgtgactacccagaattaaactggaatgctgttaataagagaaatgaaaggatgatgggagatgtgcacccagcagtgtctgtcttgtggtcctgaagtctaactctaatcctggctccactacctggaccatgacaggttgtttaattgttctagttagagtgttctcctatgtaaatagggataataattggatgtatggcaggatttgggggaggattaaattaggttatatgcgtgaagttcgtagagccagggtctgggcattaatacgcatttagttactgtcgctcctgtgatctgcacaattattgtcattatcttcccttcctcctccttccccctccttccccctctctttttccttttctttctatcatcatccatagctctcttgccccattgttttaaacccatctgtttttgttgctggtaactgtatccaaaagtaatacagaattttccgtaagaacatttattgtgtttccttctacccacgaattttcttatgctacacacacaacccactgaaatttcacctctattgtatgtggcttttctagaaacgtgtgcttctgggctttgtctcacacctcctggccagtgtttggcatgtgctcacacatgcacgcacacacagcctgcactatgtttgttgactgaatgaattaatatttcacagaataacaaacacatgctgattatactccttgggaagctaatttgttttcagctctgagagcaaggccaaatcaccagattgatgcctttggctgtgtatctaaaggacgtgccattgcagctaagtggacctgaatgtacagtaagacttagtggtcaccagaatgcatgccaccccggtgcttctgcatgcaaagggtgcgggccatgtgccagtcacagtggaaaaggcatgcttcgtgtcagcacatttggcatctctctgggatcggggatttataccccaaaaccttgctctagagatttggcttccattagcaagggtaaggcttgtaagaaaggagttttactcacctttgcttgctctcacagctgtgtcagcccattttcatctcttttcaatgttttaagccctgagagaacccagttcaattcccagcaagaaatgagcctctgtaacgcagccccagacccaccttcgagggtaggggcacccttgttgtcacgatgtacaggagccaggcttggcatcggagtggatgcttgggaagccccagagaaatagacgagtgagtgcaagagccagctgcctgcgtggcttagaggaagatttcaaacacctagtgcactgaaagtctgacttaatttgtgatttgtgaatagtctcccagaagctatggggtacagatgtgggacttgtgaaaaataccagacatcctgtgggttaaagaaaaagaaaggggggcggtgggtgaagtgtgagcaatttctggcagctttgtgggcatttattatgtctaggtggcacagtgtggttggactggttggtttcctatcagttgcattccctgtatgtcttcagccaatttttttggtaatccaaggcctgatgtatataaacaaattcctttcttgatcatctaagcaatgaacacttaacagagtcaagcttggagaattcagttcctaccacaaggtccggaatggaggatttataactgggagacagaaggtatgctgaaaggtactcaaactgtcacttccttcacccccaggagcactgaagcagacactgattcctctgcagttgttgggcttttgagctacttccctcctggggagatgcgtgttaactgtttaatgactggcaatgccgtaacagtgagcaagcaatgtgaccttacaaatacatgtgcagaaatgcagatgagtgggcctaaagaatccagactcaacttacttctagtggtaatggctgtaggagagatggggagtaggagaagaaaagccaaaggcagactttagtctggtttataatgctttaatatttttttgaaggaagaaaaatgttcattacttaacgtaataattatttttaaaaagcagcctggcgggggggtattcatttttctgtggctgccataacaaagttcttcaaacttagtgtcttgagacaagacatttattttcttaaagttctggaggtcagaggtctgacacaggcctccctgggctaaaatccaggtgtcttcagagctgtgttcttttggatactgtagaggagaatacatttcctggccttttccacgttacagagactgcccatgttcctcgatccatggctccttttcggtcaccttccagccagcaacattgggctgactccttcaatggccatgtctctggttctttgtcttttgcctcctcctcttacttttaaggacccttgtgatttcattggtctcagctggatagctatcaagggtcactttaaggtcagctgactagcaaacctaattctatctgcaaccttaattcatataacctggcgtagtctcgattttattttaattttttaattgaattcagctttacagtatcttttgtagggggtaattttagcttctttctccgttgaaaacttcaagtaaggaaacacttatattgctagtgagtggccagctggagttgtaggtctaattctttttttttttttaagacggagttgtgctcttgtcacctaggctggagtgcaatggcatgatttctgctcactgcaacctccacctcctgtgttcaagcagttctgcctcagcctcctgagtagctgggattacaggtgcctgccaccatgcccagctaacttttgaatttttagtagagatggggtttcaccacgttggctaggctggtgtcgaactcctgacctgaggtgatccacctaccttggcctcccaaagtgctgagattacaggcatgagccactgtgcctggctggttgtaggcctaattctagcaatctcagcaactgtaggatttctctgcattggaggaagcaagactgaaggtcgtctggctttatggacaatgtgcttagaagttcatgccataccttaggtccagtcttgtgactgaaccaaccagacaggcctaggctctgccctaagtggtcagcctccgaggtggtagcacgcagggcctcacttcccactgcctctgtctatgggcatgtgctgtgtgccattctctccccttatcagtgggttcccagctgcctggtgtacaggagggttaagtagatacctgttgagtgattgtgaatgttttcattcacgggggcagatttgtgtcctactaacaccagacatgtcctgttttcagattacttctttttcaacatctgagtacctataacatctaaagaataacaggaaaatccacctgggtggccaaagtcaatgtaatgggcagaaagggcatgtggtagacttggaaatcagacatcttagactccaacacagggctcttccacttgctagccatggaacctcagactgggatccttgacttccttatctataaaatatggcttataactcaccctgtattatagatctgctgggaacatgatagaacgtctgaacagtgctggcttatagcaagtgttcagagatgtgtttcgttgtttttcttttttctttttttgagatggagtttcactcttgttgcccaggctggagtacagtggtacgatcttagctcaccacaagctctgcctcccgtttaaagcaattctcctgccttggcccctggagtagctgagattacaggcatgtgccaccacacccagctaatttttgtgtttttagtagagacggggtttctccatgttggtcaggctggcctcaaactcctgacctcaggtgatctgcctgccttggcctcccaaggtgttgggattacgggcatgagccactgcgtcaggcctattgtttttcctacgtaccgtgattgcttgctttcttctctgtcgatgtccctgccatctaaatgctgagtccccttgtctacattttgaggctcttctattatggaagagggctagagaggccatcagaatttggtttcactagcctttgatccttcctgtttaaggagctcagcatttagcttcacttccctgtcattcatcagaattcattctcagattggaattgtccagtcttagagtgatttttgtccccagtgacacttcccttatatccgtgctgacacaggttcaggagaccaggtcgagtcgaaatcctggctgttccgctttctaacaagctgcttcatctttctgtgcctcacacatctataaaatggagctgggcatctgtctccttcagttatggtgagaattaaaataaaaaacacaaagcacttctaagaaagtacaggagaggccgggcacgatggctgacgcctggaatcccagcactttgggaggcagaggctggcagatcacgaggtcaggagatggagaccatcctggctaacacagtgaaaccccgtctctactaaaaatacaaaaaaaattagccaggcatggtggtgggcctgtagtctcagctactcgggaggctgaggcaggagaatggtgtgaacccaggacgcagaggttgcagtgagccgagatcgagccactgcactccagcctgagcaacagagtgagactctgtctcaaaaaaaaaaaaaaaaaagtacaggacatacgtaggacccctgaacatttatccccctgctgccagtacgttacagcaaccaccaagtccacctctatcaggatggtgccaatttgtggggtttttttttttttttgagtcggagttttgctcttgtcgcccaggctggagtgtaatggcgtgatactggctcactgcaacctctacctcctgggttcaagcgattcttctgcctcagccccctgagtagctgggactacaggcacaccccaccctgcaggggttttttttttttgttttttttttttttttttttctgtattttcagtagagacagggtttcttcatgttggcctggttggtctcaatgtcctgaccttaggcaagccacccgccttggcctcccaaagtgctgggattacaggcatgagccatcacgcctggtgaatggtgtcattttgatgtactgagccatctcagtttttccagcaaccttccctcacctttgtggtcagctagaaggtcagttaacacatgggatgggaattcttgccaatgtccttcgtaaaagaagaacttctccttcactcacatgtcctgatacttcctcagcatttcattctagcctttctgtctccatccaccatctatcaatcatctatcatctagctatctatcgatttctcttttttggctttaattttgtcactttttcttctgtctgctatagaaatagcaaattttcttatgtaagaaaactctgaacgcgaggccaaagtagaattttccctgaaacagctaccttttccttgaaattgttctatatctaaaatcactaggtgaggagtaatagaaatgtagacatgagaagtgaaactgttttttttccttgtaaaagcttcattgtgccctttagaggataactctgtagtttgatatgataaaaataattatatgattatgctgagtgaggtggctcaagcctgtaatcccagcacttggggaggccaaggccggcggatcacttgaggttaggagttcgagaccagcccggccaacatggtgagacccccatctctgctacagatataaaaattggctgggcatggtggggtgcagctgtaatcccagctgctcaggaggctgaggcaggcgaatcgcttgaacccgggaagcagaggttgtagtgagctgagatcatgccactgtactccagcctgggtgacagagcaagactgtctcaaaaaagaataaaaatgaataaaaattatgtgattagagaggggaaaacaatcatttcttgtgcgctaatgccactcagcaggtgcttacactgtctggttcatccttacaatgactccatgttatcgccattttcagatgggtaactcaggtagaaatatgattccattagtttaaaaaaaaatacatagaagataagaaaaatcaccaaaaattcccagccacagtagatgtatctgtatttaactactctcctcgtgttgaatatttatcaggtttctcgttttcttttgtttttgttgtaagtggcactgcaggccagttgcggtcactcaaacctgtaatcccagcactttgggaggctgaggtgggcggatcacttgaggtcaggagtttaagattagcctggcccacatggtgaaaccctgtctctactgaaaataaaaaaaaaatcaggcatgttagcatgcacctgtggtcccagctacttgggaggctgggtcaggagaatcgccttgaacctgggaggtggaggttgcattcagtcgagaccatgctagtgtactccagtctgggcaacagagccacatctccaaaaaggtggcactgcagcaaacagcatccacatgtgtgcacagaatattgttctgttgtgtacctcagatggctttgttaggttagattccctgaagtggaatggccagggaatttaaaaagggttttgctcttgtcacctgggctggggtgcaatggcgtgatcttggctcactgcaacctccgacccccctgggttcaagcgattctcctgcctcaggctcctgagtagctgggattacaggtgcctgccactatgcctgggtaattttggtatttttaatagagatgtggttttgcggtgttggccaggctgttctaaaactcctggcctcaggtgttctgcccgtctcggcctcccaaagtgctgggattataggcctgagccacggtgcctggccaagtctgttttttaaatctggaaaatgggacttgttaacttctgtattgtcttttctgctgctttatccaactttgcaatctataagcttctgttactggaaaatggtgatggtaaagtaattgctttcttatgttccatcacagagggtagactgctagctctagtatttttcaatgctgctttttaagtgatagatgtataccattcagtaccaaccctgcaccctgggacatgcctccttgctgaaactaccatttatctttgtgaattcattattcgtttttccaacaaacttttattgaacatctaataagacctggacatttggctgaatgctggaagtgcaaagatgaaggaaagttgctttttggaaggatattagaatccaaaggtgaagcctgcacagtaagtaggccagtggtgggataagggatccattggcccaggaaattggagggacttggagaaggaccatctcacccgtccaaagaatggaggagtaagggaaggcttctggaaagaagttgtgttgaggctgtgtttggaaaggtgaataggagttaggccagtgaggaatggggtgaacaactgcaggaacttgagtgatactttggggtgaattctctctctctctctgtctgtctctctctgtctctgtttctgtctctctcactcacattttaggtaaagcagtgtttcttccccaggggtgattgtgtttgttacagtgtgatggagactggatactgcatctagcagatagatgctgtcaatcatcctacaatgtgcaggaccgtgcccacacaaagaatgacccgtccccaaatgtcaacagtattcaggctgagaaaccatgtactaaggcacaggacaagcatcgggttggataatggcagagaaaagtaccttacctccttccagaacctgagagtgtgtgactgtgagtgtgtgtgtgtgtgcacacacttgcgtaaagtgagaaaaatctggtgttttttcgaagtctgcctcgtttaggctctggactcctgctctctgttgactctgtccagagagtaagcgactcagcaggtgtgcctccccatgggcccccttcacggtgtcctcaccttgatttattagagcattttattcccccaacagtgtttatgacatccaaggacttggtggaaccatgaggaaatgagagtggacagtgagactactatcattcattttcactccccgtaaacatcttctgtttctgttttagaagacattgctaatcccctcatgcactggctttgcgaatttctttttcagcctgggtttgaaagcaaagtggtagtgactttttcctgatagctgctgaaaaggttccacagtatttggaccgctgcctgcttctaccctggagcacaaaagatccaggcgtagaaattggttctaacaatatccttttagagaacaccaaggggatgtgagtcactttccctttgatttaaaggcactgcgtccctcaaattcagagttagagggtgacatgtagttgatctttacttcccgggggcagaggaccataattaaatggctgtggaaacccagaagcagcctacagaaactcttaggagccctccgtctgggaggaatttttttttttttttttggtatatctgtgtttacagttctagaaaagtgttggttttgagggcaatggagacaggaatgaggagaaaatgtataaaggagaggttgctgtgagccgagattgcgtcactgcacttcagcctgggcgacaagagcgcaattctgtcaaaaataatattattctgttgtttcctaattgttgatttgtggtccatatatttggttccttaactaaattggagttcttaaaacaaatgttaagaacacaacatttaggcacacagtacttggattccagtagctttggataaattaataaaatccttccattttctcagttgtagaatgggaatagtacccaccttataggcttgctgtggggagtaagtgggataataaatgttaagtgcttttagctgtactgtacatacataatttctgtaagtactggctattttaaaaattattttaacactattctgatataggaagttaaaaaatagcacagaggggatccctgtgatttttactcacttttctacaagcatgactccttatataactacagtacaggatccaaaccaggaaacatgcctgggtacaatgtgagtgtataattccaggtaggtaaaataatggcccttattaggatgtctgcgtcctaatccgcggaaactatggatatgctttgttacatggaagaggaaaattaagattgcagatgaaattcaagttactgatcctgcgaagttaaaatcaggagattacccagggttatctggttgggcacagtgtaattgccaggattcctaaaagggggagagagagtcggatgagtcaggcagtgagatggcagcatgagaaggacaccgccacacattgctggctttgaaaatggagggaggcgggcatgagccacagaaagtaggcagcctctagaaggtggaaaaggcaatgagatggattctaccgtagagctaccagaagggaacacaccttgctgatgtcgttttactattttcttatttatttttgagacagggttttgctctcgcccaagctggagtgcagtggcgctatcatggctcactgcgatcctcccacctcaacctcctaagtagctgggactacagtgtgtaccatcacgcccggctaacttttttgtatttttagtagaggtggggtttcatcatgttgcccaggctggtctcaaacccctgggctcaagcggtcctccctccttggcctcccaatctgctgagattacaggaccctgctgatgtcttaatcttagccccttcagatcccagttggtcttctgactccagagctataaaagaataaatgtgtgttatttcaagccgtgaatttcttattaatgtgtcacatagcaatggaaaaataaacgttctatgccatttttatcacatgcgtaggttcatttaaccaccgccactactaaaatacaggactgttccatctgcaccgaggtctctctgtgctaccccttgaagtcacacttgccaccctccgcccttagcctttctttcagcctgtgaggaagcaaaacttttactcttcaggcatcacctcacgcgtcttttctgcctgggaggcactttttccagttttcctggcgaaatagtcatcttttaagttctctgacaacccctctctgagcatctaatcccaatcagaattccctcctaatgtaaactctcattatatcttttaactttatttcttagcacttatcatgctgtatggataatggtatatttgggtgagagtatttgtttctctttctccctaagtaggctggaaactgcatgagggcaaaaacttagctttactcaatgttttctcagcttcatgtacgtgactgtatacagagtctgagccgagaaaaccttccttgcatgtacgagcaaatgagagtattcaaggtacagaactgaaattttctctgggtttttaagtggaagagtacacaagcattataagcaattttacctgcatttactcaacagacttttgttttttatccccttcggtgtaggttgtcatactaaattggttcagattctgtatctgggggtagttagacttctgtgaactccaagtagacggttgaacatgactgaacttgcacagtggacacattgtgcatttgtttttaagtccctagctgtttccagaaatagtttggttaattcatactgataaaataaatccccgtaagagcattattccccaaagtgggcttcctttgccaaacctaattatctggagaaggtattgaagaagtcaacttacctcttggccaaatgctttctagaattattcaaccaaagacagcaggctgcacctaggggaagccaaacatctggatgaagaatgaaatatccagatgttttcaagtatctggatgtttctaaccatctgtttctcttggttattgacaaatgatccagctgttttgcagaagatggtataccttgcctaacagaagagagaagtaacattcttagaaaactttgacatcatctcatctgtactaacacaggatttctgtctttaattgaagccatgacttgatcacaaaaatgaaaatagcttcatgtgtttctgaagctgttgtcttgctttgggcgccagactgcacaggattttaggttaattgtcttgtttacaattagagtctgcattgtttgtagcttgattctatttataatgtactcacaccttaaccaatagcctcacagatggcatatgagaatactcatactcagtgctgctaaaaacagcctgctgcctgaacaccagagtgtcttttaaagcgtagaaaagttgggtacataaaatttctgttgcaaaaaggaatgtataggccttaattgaaaatgtatctttctggaacaggagttttagaagctgagtaccacccactcccttgctccacaattctcttttgtttaaggcaacacgtaggttcttagttttttaaatatatatatatacgtatatatatacgtatatatatgcgtatatatatacgtatatatgcgtatatatatacgtatatatgcgtatatatatacgtatatatgcgtatatatatacgtatatatacgtatatatatatgtgtgtatatatatatataaaaatatatttaaataatgttaaggctagagtagaatgacatcatgggaaggcttattgaaacttggagtggattcgtagtctgccacgagaatccttgtctgatgtttgtgggtgtgtaggactgaatttgaagtccttaaatggatgtcctaacagtgaataaagacgtggggcttgaatttatgtattatcttattactctgtcattttcttgagtggtacaccagagtgcatggaaaagtaaatgattggaagccgcgtggtagttaagggtgatgatgtaggagtgagaacacaggcttggtgcctggcgtcagcacacacatcacaggccctccctgtcagtggctgtcgtctgttagtgtttccagcacagctctaaagagcgacgcttggaggctggggagagggggatggagaggcatatgattctgttgacatttagtgacatgcgctcttcccaaccaaacagatgcaaatggattttagttgtgagtggttgtttaacacctgcataagtgacagacctgcagagacaggttgtggatggaacgcaaattcaaatcagtgcatgagaacagcagctaaagtggacagacccaaatgttttgcctaaatatttggctcctagttgtacaaaaagccaaatggtttcaatttcatcctatataaaccagatgattgtgtatttacttctcacttgccctgccagggggatggttggtggggggaagacaaggacaaacaattcgaaagagcaaatgagccaaaatccatctggattttgttaatgctgattatatagtttcttctgttgtttttaatgtcttccaagccttctgtgtattagccagcattaaggggaaaaaatgacattttgactttgactccctttgtaatgtaatgcattgttatgtatttctgaagtttttcttaaggaaatagtatatgataataatgactagcactcactgagtgttcgtgatcgccaggatcaggccaaaggttttcacgcttgtgcctttttaaacttctcaacaacccagtgagatagatgttattagcccaatttaaggatggggaaagtggggattcacagatgaagtaacttgcccctagcatcgtacagtcagtgagtgtgagaggtacaattcaaacccaggtagacctgaattaaatcttctgaagcaactcttcatcaccaggtgtggctacctccaatgattactttgtttttatgattatcaacaaagttactctgtggagcaggggcaggcaaacattttctgtaagggagagacagtattttatgctttgcagtacagtcttttgcaactgttccactttgtcaccacagcacaggagcagccatggacgctacgtaagaaaatgagtatgggagtgtttcaattaaaattatgtatggacatggaaacttgaactttttatgattttcatgatcacaacttactctgatctctttcaaccatttaaaaatatgaaaaccattcttagtttacaagccctacaaacactggcattgggttaggtttggatgatgggccattgcactccagcctgggtgacagaatgagactctgtctcaaaaagaagaaaataaaacaggcgttccttacctacagcctgctatgatttggggttcttgtatttttttttgtttgtttgtttgagacggagtcttgctctgttgcccaggctggagtacagtggcacgatctcagctcactacatctctgcctcccgggttcacgccattctcctgcctcagcctcctgagtaggtgggactacaggcccccgccaccatgcccggctaatttttttatttttagtagaaacggggtttcaccatgttagccaggatggtctcgatctcctgacctcatgatctgtcagcctcagcctcctaaagtgctgggattacaggcgtgagccactgcgcccggccggggatcttgtattaatagtagggagacagtaagcaagcaaggctcagttaatgataaattgttatcaggagacccagcagtttctgctttttctaccctcctctttgagctctatttaaactaataggttactgggtttgaacatgccatgcagtgggaagaggcgggaaccccactgagctgtcctctaagtgaatcatgcccactatttggttgtgaggctgtggactttacttttcacgcatggcattgaaagaacagggaagggtggattccccatctcctcttcctctttggaatcaggaaaacatgtttctattctaaatgttctttgataaataagattgcatgttcctggctcctgtaacatatattttctttttcctttgtccggcatacttgactaattgtagagctttttgagcctaaaactggataggaacccagtgcatgcactcttaaggactcagaggcctgctcaaggttaagtgcagtatggtctgaataataagcatagatgcccctttactgagcagcagctgggtgctgggcactgtgctaggcatttttggatgcattttcctcctccaacttcactttcccctatgagattatttcctctgtgttagagacaagaaaaatcaatttacaggtagtttaagtgacttgttcaaggctacagtaagcttgaagtggcaaggatgggatttgaacgtctgtctgcttgattccaagaccgtggcctttgtcattcaggtcatgctgctttcctcaaggcaaggaactgaggttttctgttggcagtgaggtggtggcttcttgtttccctggtcttagatactgctcaactcacagttgaaatgtagaagtgaaaagtcagacagcagcaggtgttgctgggaatgtggagaagttggaaccctcacacaccattggtggggatgtaaaatggtacagctaacttggaaaacagtcggcggttcctccaatagtcaagagttcccatatgacctagcaattccactcctaggtacgtatcaaagagaaatgaaaacatggaccaagacttgtacatgaatgttaatagctgcattgttcttaatagccaataggtggaaaaaaccctaatgtccatcaatggacaaatggataaatatgttgtggtaaatgcgtgtaatggaatattccattttatattcataaaaatggacaaagtcctgaggcattctataatgtgagtgaacctggtaaacatgaggctaagtgaaagaagttagttacaaaagtccacatatggtgagattccgttctgtgatatgtccagaacagagaaatttagagatagaaaatagatgagtgatgactcagggctgggggagttgggggtgggcgggataggaggggtagaggtgaaggtgatgaaaatgttttgcaattgtctgtgttggttgcacaactctaaatgtactaaaaatcattgaattatacaattttaaatgggtgaatcgtatggtatgtcaattatatctcaataaagctgttaaaaaatctgaaagtgtcaattaatctttgctcccagagaaaaccactcagggcccgagctgctcatgggcacaaaaacccattcctcagattccttggccatgctggaagcctggcttgtgtgagagcctcaagtctctgtaacagcctgggagtgttggtcccgtcacagggctgtggcagcctttaaagctagaaggcactgctcagaggaactggttcctttgaatccttttccgtcaccatgcaaatgtttacaagctctaatcaggagaaatgaaaaatcacatgtctaattttaaatatgttgcctctgatcacaggtgttgttaaaacagctcttttatgactttataaatactcagatttattttgaagcaatgtttcattattcctatactatgattaaatattgagactattgcttttccaattgttctattgcagtatttaatgagtgcaattaaatggaaaaattgcctttttaactggtgatagtccattagtgtctctgtctcttcaggaaagaaaagaagtgaattattagaatgacaaatgaggcaaagttaccaccgtgatggagaggtgcgatttccctccacataatcttcagttagtgatctctgtaagagaatgtttttcaaaaggctaatagagaagtaatgagatcagaaggaggtcaacccggccttctccgtttggcagcttgattaatttatttctccttcttggagattgctgcaaggggcttttgtcaccctgtgtttttcatgggactgtaacctgagtgactgctgatatattagccttgcaggcaaggaagcaagtccgttgccctggaatggaaggcataggagttaagggtttgtttgcttttgcaacttgaacacactcattgggagctttggataatgacaacaatgatgatgattttaagagttaatcaaattaaaggctatgaaatgatgcccactgtggatcctgtgcctggtgctcagcacatacaacatcatttcattttcacagcccttgtgacatgatagggctcttttgcagatgaggaaatgcaggctcagagttatctagcattgtacccttaagcagaagggggaggtaggagtgaatctctgtctgcctctaaactcttgagctcccctccagaagtccagggctcttagaaactttgtactcaaccattaaattgttgccattgtgctgaggagcaaggaaactgggatcacacagctagatcacagtgggggaacctgaattatggggatgctcacaaaagggcaaaacacaacggttgctgtcatttgatgctttatgttaagtgtgcatatgctcagttgcagaaacctaaattgctaaattgcaaggctgtatatgatatgccaatttggcatattctgtctttttatattctgccacccctatcatacttaggaaaatgccaggttgtaatcattcactgggagaaacaaggggttgaacgttgttatcgcgcaaaggaagctgggcctagtaaaggaatgtaaatactaaaatgccagcatcactgttacttactgtgtttctctggatgtattacttaacctctctggctttatttctgcctgccctccccccgccccccccccccgcaatgcctcaatctgtggcagagttgttacattattgaaaaagaacataaagcatattttctggcatacagcatatgtttaatttataatttttgtttttatcattaaaagcaacagattgctgtattcttgcctgccactgacatggacttaattgtttcatttagacatttaagtgggcaatacacttaaaatgcagatataactttaattgtcaaaacatgcttattttaggaaatgtgtttctccagtaaagctcagtatctggggctttttcggttgtattctatatgaatcttgaatactgaagtttctcaccatggagatgacaaacacataaaatgtttactttgcaaactgaatttctcttgctgctttttctgaagttccccagaggctcatcatcatcaataccatcaattaatagtcatccttggcttcctcgatcctcagcactgcgctgggcactgccccccaggagcatccatgcacctcaaatcctgaccttgtgactttcaagtccctaagtgaccccacactgaagaatctggtgaaggccatccaagcccagagttcatttaagtggcagcgatgggaccaaattataggccaggtctgtcttatgaaagatgataaatggatgtgtcatatcgggaaagaaatcactctgtcatcatatgacaggctggcttgatttctttgcaccagtgtccctaaaagttgggatgggggtgtgaagcgtgccagctttcaaagccagttgtcactccattttgtgctgtacctccccagttatgaatctggggcatcttcactggactctccaagccccagtaccctcagtgtggaaggagaaagcatgacccactgggcaggacacagaaggcttctgtgagaatgaagctctatcatgcttgtagaacatggagcgctcagcaaatacaaatcacagcccatctcctccaatcatttggggtattaggattcccttcactccaactcccactggaaaacctctttgccatgacacagagattccacaatcttctatttttatttaaaaatttttttaaagagtgatctttggttttctcagtagatgctttcctctgaatagcaagcatatagatagtcttctccttcagacccccgaccatggctatattatttagtctacagtggttctttgtacaaagtgcttctgcaaagctcttagagcacccagagctggctttggaaagcaagacattaggaatgagctagcctgaatgagtcctgatttttttttttttttttttttttttttgagatgatcttcttctgttgcccaggctggagtacagttgtacaatcttggctcatggcaacctcaaacttctgggctcaagccagccgcccatctcagctacttagtagcttggattatgggtttgtaccaccttgcctggctaatttgtatttttagtagagatgacattttgccatgttggccaggctggtcttgaactcctggcctcatgtgattgccccaacctcagcctcccaaagtgttgggattataggtgtgagcctctgtacctgagttctgatttcttaaatttcacagtcccttacctgtaactcaaattcccgaaccttcaaaaaacaacaagtggcagcaaaacttgatttggaattgtcgtggtcttgtttataatcgtcatttttcttgtcatgtgatttgatgtttgggtatatgttaacacctcactagggatatttcatagcatatgattgatgtaagtcgtaaaaaatttagaatccttcaacacatacttggattttagatgaagaatcatagatttttatttctgtggctttggatgagctgtttaattttcatttcaagttgctggtaagatgatgatgataatagagataatcctgtaagaatgctgcaaagggttagtactttattcttgcaacaagtatttattgtaggcctgtattcaaaggagaataagataaataagatcgaatgtggaaattagatgaatccggagttagtgcaatgaaagttactaagagagaacagaaatactcttgataatgctgatgtgactggacttttgacaagcagtctgggacttctgctgaaaagtgctcttgaagccaagcaaaatcatttccacaccctcagcacctccagtttttcctggccttggtctcagggtggttgaccttttgccgatgtgtttttcttttttcttttcttttgttttcttttcttttctcttctcttcttttcttttctaacagtcttgctctgtcttccaggctggagtgcagtggtgcgatctcagctcactgcagcctctgccccctgggttgaagcgattctcctgcctcagcctcccgagtacctgggactacaggctcccatcaccatgacaggctgattttcttttttttcgtaggacgaggtttcagcatgttcgccaggctggtcttggattcctgatctcacatgattcaccaaccttggcctcccaaagtgctgggattacaggtgtgagctaccgcacccagcctgctgatatatttttaattatcataagaaacagttaaagtgaaattgcaaccccatggtatcggtggactgaacgtttggttctcatttccttgagatggtagtttcctcctctggctacttttgtccagccagttctcctctgtgggcatttggggaagggctctctgatagaaatatgaaatgatgagggatgcaaaaaacgtggtttgtttcttagaacaacctccaccacgaaggttccagacagagtgaaatttctgtatttgctgaccctgtcgccagtagcctggaataaacagcaaaaatagttcttgaggcttcgtggcaaatgtgacctacctttgtagttcttgggtaggtgtgtgactgtggcctatgaggccaagttgcaaggtctttggatgaactttgtggcatctggcaatgtccccagtgcaacctatgtaaaatatagcagtttcctgcacacgcttaagggaagaaaccgttgtggggaagcgtgctctgttattcttgccaatgtagccaacatatacatggggaggtctgttttatgttttatgtttgatggttttttctttttctttcttttttttttttttgagacagggccttgctttgtcaccctggctcaagtgcagtggtagaatcatagctcactgcagcctcaaactctttggctccagtgattctcccacctcaacctcccaagtagctgggactacaggcgtgtaccaccatgaccagctaatcttttagtttttgtagagacaagttcttgctatgttgcccacagtaacatagtaagtctcaaattcctggcctcaagcgatcctccagccttgtcctcccaaagtactggattacaggcatgagtcactgcctggtgctttctttttgtctttttctaataaccattgctatagatggttgtccttaacgcgtaaatgtttaaaatacctaaatgcctaaacgtttgaaaacattccttaaaaattgaagttatagcatactaacaagtgttcatttttataattgctgatttaacttaataaaaaccaataactataaatatccttaatgccactgaattgttcacttaaagtggttaaaatgataaattttgttacgtatattttaccacaaattaaagaaaattaatatttccaacaagccaaagctctatgtaaatgtcctaaattaatgtgtttaaagagaaaatttcaccagtgataattttttttttttttcccctgagaaagtcttgctctgttgccaggctatagtgcactggcgtgatctcagctcactacaatctctgcctcctgggttcaagcaattctcctgcctcagcctcccgagtaggtgagactacaggcgcatgccaccaccgccagctaatttttgtatttttagtggagacgaggtttcaccgtgttggccgggatgctctcgatcttttgacctcgtgatccgcccgccttggcctcccatagtgctgggattataggcgtgaaccaccgtgcccggcagggagtaacatttctatgcaactatatgtgggtgtatttttctgaacatgtcagtgaagtttaaatattcatctcacttctttcagtcaccctcaaaggggaatttaatttacgacttcatttgtactttcaaacttcctcctggaaacagaagaaaataaaattagatttttgtaagctgagatgatatgcatgttcttattttcaatacagttagtctctccactttatttttaaacacaacctcataatacaaataatctagtcttttctggagcagtctatttattcagacaggtggaagttgatgctaaagattggcgttaaattgagtaaaccattcatgtagtaaataagataatttgtttctgccccccaaaagattaaaatatagatttttttcaaagtctgtttttttaacacctacggtccctgaatatgttcgattgaggtttgtgtctgtaatttggaacggctttttgttgcaactaaaatattcatttgcagaaattatcactgagggtgttagcttcttcatgcttgcgtttcttgcatttgttactaaataaaatatttagaagtcacgtcgattttcaaaatgatagttaaggatgaaggtaatattggcatatttatttttatctgtgtaatttttgcaacttataaccccttcaggtccaaatgaaacaggcaaccaggtaataaaccaattacattctaatacagattacttcatgacagtgtcttattttccagtttatatgtaggtgagattctttggagaccgtcttcgtaatatagctagtttttgtccattcattttgctttgacttccttgtataggtacaaaggtgtaagtaggagagtctaccaggcagcacacagacgtggccctgtaaccacccttgtgtaaaatcagagtaatcctccctatccttgcttatttcactgggttcatgggtgatgactgtaaatgacacaggagacagggaaagagttttgttatcctgatacacacattcttaaatgcctctagctgtgtagacattggtttgtccatattaatagtattttacgaagtgccagttgtgtgcctgctttgtggcatatgcattggcattcattgctttatttaattcttccaacaacgtgtcagatgtctgttcaaattattcccccctttacagacacagaaactaagatttagagaggttatgcaatgtgccaacagggagaagttggagctggaatttgaaccaggctagctgactccaaagctgtgtcctcaagcagtacatcagagccgaggaaggtcaagtttggaacgccatttagctgctctcagggagtctgattactgtttctctgttgaggctcagctcaagccttccctgggccatgaaagacaacttaggtttgggtgtcctgtgtttgtaccttgttttgtgcccacctacatcctgggttatgtctttccccaccccaagccttttttgccatctctttttcccagaaagactggaaacttgcctaaagagacagaatcccagatcccagatggatctactattttagaatctctgcttccgcatttctaaaatccttcccagagaattatttgactagttaaagcttaagaaacaccccagtggattatgagtgccttctagccaagaatgggtatttcctctgtgcaatctgagggcacgggacactcctccagcggagtagcctgtgatttgtatgggctgcatgaattcctgcactaacaaggtaaaagaaggatgttaaagaaaacccgagatcttttgggtacatgctataaggtgaaaggcttattccatttgctcaagaacaaacatccatttgtccaccccaagtatttatatagttcaattaagcgggcaggtaaactgattttttgggtggttaatgatctgatgattttcctctctgtcattgtgattggatatgataatctgagagttgcccaaattagtgcctttactgtagttataataatgtcatgatgactgaggatcactgagtgtgccttttgctctgttaagtgtgcattcagaactttactaacatgggttccacaggaaatattagccccattttgcaaatgaagaggctgaggctcagaaatttaaaattgcttcatgtcgcacagttcagtgtaaagttgcaatgcaaactaagatgtttccgttgcttataatcttaactataataatcataaaccatgttctgttgctcagaacccttgtacttataatataaaacaatctttttaaccaagattcttcgcttgggtattctgagtagcatggaagagcattatacttttttttttttttttttttttttgagacagagtctagctctgtcacccaggcctggagtgcagtggtgtgatctcggcacactgcaaccttcgcctcccaggttcaggcgattctcctgcctcagcctcctgggtagctgggactacaggagcatactcccacacccaggtaatttttcatttttggtagagacggcgtttcaccgtgttggccaggcttgtctcaacccctgagctcaggtgatccgcctgccttggcctgccaaagtgctgggattacagacatgagccaccaaacctggtcaattttctatggtgtgtgttacattttttaaaattttattttaatgtttatatagaaaaagttgccttatcaaccattataatcatggtatttagtgagtgtaatctgttctgatgtaatacttagtttaactggtaaaaaatattttgacagaatttaagattagttctttttgctttgtccgtcaatgtgaaataatcagtatatcatatttatagaattctgctaaaacatgcatatatacataaacagatattcatcttaattgatgttaattgagatataggagtacttcattaagtctccagaatacatacttcataagcaggaggcatatatgtttgtatatatgtatgtacatagacttgatacacatgaaataaaatttcaaatggttcctctgttcagcaaacgtgacccaaagttttggcttatttggcgttttgttttcttgaagacatacttgaattttaaatagttaatccatttaagaagtttcatttaaggtactgttaaaaagaaaaaacacagaacaacacagtgagagcagaaaaggtatcatctcctccccctcttcttctcttttagaaaccttgcgtgatccactgatggtaaatatttcatgtactttgcatatcagcctgagttccttttgtgaagtcaggtaaatggaatgtaaatcccctcgtcctccagacagtaaaacggcattatttgatgttacatcgcataaagatgcagatttgattccccctttactcacactataaaaacaaagtttttaaagtggttagccatacctggaaatgtaaatgcattcgcctaatgtaatgccaaagaaaaattaagacaaatgataccacatcgctgccacaaactgcggctcgtacaaaattcactttagttattatgctgtgaatacgggctctcaccctcctccgtgaatgcacaatttatgttgaatgcaacatgaatcattttaatagaccaagcaaaaagtccccaaagtcgattttcaaattatgaaccttggaacagaatataacaacagcgaacaacaaatagttcagactttactctgagctatgagtgaaccattaaagatacagcaagcactttcggtgaggtgttacacaattcatagcctaatggcaaaaatatcagaaatggggtattttttaatgctgtttttccagccatcattctgttcaattattttcacatttgtgtaatcaagatattcccaaacagaacatagagttgtgtattgttgggaactaattatatgtattataaatccaagaattaatttaaatgacccagtttccacagagaaaaagccacattgtttttaaatagctaactaaacaaaatgctaacccatatgggagaaatttccaaagaattaaaaccacccaccaggaaaatgggaaagtctcccctccacacacacacacacgcacacacacacacacacacacacatacacacacacacacacacacacaaaatcaccaaatcacacctgaacaagaggaagaaaattaaactcattgaggagataccatctttttttaaaaaaaaaaaaaaggcagcaaaatgtgagatgggcgtttattatgagatacacgaagacagagaccagaggttccccaagtagcccctggacctgcagtgtcagcatcacctggtagcttgttagacatagaaattcttgggctttattccacacataatgaatcagaagcttgtggggtggggcctgcagtctgaggtttattttttctaaaactttaagttccagggtacatgtgtaagatgtgcaagtttgttacataggtaatcatctgccacggtggtttgctgcagagatcaacttatcacctggatatgaagcccagcgtccattagctgttgttgctgatgctcttcccaccacctgcaagccccagtgtgtgttatccgcctccaccgtgtgtccatgtgttctcatcatgcagctcccacttataaacgagagcatgcagtgtttggttttcagtttctgcataagtttgcctaggataacggcttccagctccatccatgtccctgcagaggacatgatctctttcctttttatgattatataatattccatggtatatatgtaccatattttcttcatcctatcatttatgagcatttggagtgattccgtgtccttgctattgtgaaataccatttgacccagcaatcccattactgggtatgtaaccaaaggaatagaaatgattgtattataaaggtacatgcacatgtatgttgactgcagcagttttcacagtagaaaagacatggaattcacccaatccgaattttaacaagtcttccatgtgattctgagacagactcatgttcgtgtggttctggctctgcagaactgaggtgggccccaaaacttgcgtttctaaaaggtactagctgagcatgatgactcacatttgtaatcccaccactttgtgaggccgaggcgggtggatcgcttgaggccaggagtttgagaccagccttgccaacatggtgaaactccatctctactaaaaatataaaaatttgccgggtgtagtggtgcacacctgtagtcccagctatttggaaggctggggcaggagaatcgcttgaacctgggaggcagatgttgcagtgagccgagatcaggccactgcactccaacctgggtgacagagccagagtctgtctcaaaaaacgaaaaacaaaaaaaaccaaaagactaaatgtataaaaggtacccaggtgatgttgatgctacttgtcttggccaatgaaatgaaaagcctacaggccaggcatggtggctcatgcctgtgatccacaactttgggaggctgaggcaggcagatcacctgaagtcaagaattcaaaaccagcctgaccaacatggtgaaaccccatccctactaaaaatacaaaaataacaccaaaaaaaaaaaaaaaaaccacaacaaattagccaggtgtggtgatgtggcctatagtcccagctatttgggaggctgaggcaggagaatctcttgaatccaggaggtgaacgttgcagtgagccaagatctcaccactgcactctagcctgaacttcagagagagactatgtctcaaaaaaaaaaaaaaaaaaaagcctacagttgacaggcagataacagagggagcaaaggagtcttgtggaagacaatagggagtgttgaggacctgtcaaacaacacagtccccatctgtactttgggaggtaaggacttcttagttccagctgcctgttgccatgggggaacatagacccagagctgccatcttttctaatttttttaaaaattagaggctaaaagttttggcttataaaaatggtatttcctgagtttttacaattatagtattaagatattcctaggtttttgtttgttttcgagacgaagtttcgctctcatttcccaggatggagtgcagtggtgcaatctcctccgcctcccagtttaagccattctcctgcctcagcctcctgagtagctgggattacaggcgcccgccaccatgcccggctaattttttgtattttttagtacagacggggtttcagcatgttggccaggctggtctcaaactcctgacctcacgtgatccacccgccttggcctcctaaagggttgggattacaggtgtcagctagtgcacctgaccctaggataatcttaattttaagtagctggtaactcataaatttttaaacactctgcagttcaaagaaaacatgtttgtggtaggtagccagtttataacctgtgtaagactgtgttattagcaaatccctcaatgtgttgaccaagagtgggtaggaatcctgcagacagaatcttttgaaggtggtttgtttttttattcctttataagtacagttgtagatttacaaagtaattgagtatatagtacataaggtcttgtgtacccaccgatcgcaattgagcatatagtacatgctgtcctgtgtacccactgatccctggtcctgcccctggtatgagggtattaacatcttgcattagtgtggcacatttgctacaattaataaaccaatatcgatacattattaactagtctatagtttacatgaggggctgctgcttgtgttgtacattctataggtttgttcaatgcataatgacaggtgtctgtcatttcattatggagtgaaaccattccaatttcatacagcgtagtttcacgcctctaaaagtcccctgaaagtgttattaaaagtactatctggccatgtcctcatttccccagcaaagtccttctgagaatttaggcgctttaggctagaggatctcagtgctcagaatgaaatatccctgtactccaagatgcctccagcaattataattgaatcttgaagctagagtttcttggctatcctatttcccttttgtttccaccatgaagaagtggagagccgtgtgacctcagtggtagagctgatgtagaagcgccctctctgttcctggcagtgcctgtcctgctaacctcgtgtctcttgctggggtcttcatcagtaagagacctcacaagatgctttatcaggtcacttggcaaccaagctgatgaggatagcagtttcttttgttcttttaaaacatatataaaattatttttatcaaacatgacagatcaaaagccttctggaaaggagagatggtaactaatttaggcagtgtcttttgctttcacatggtgtacccagtactattaatatgaatttatcacatggaaacaaacttttaaaaaaattaattttgtgaattaaataaagcagcatgcaaatttactatcgtattcagcaaccaaaattttatcacttgcctgatactgcctagtgagcaggtggaaatgtagacaccaacaccctcatggattcccagctgctgagagtttgaatagtatgtgaagtctgtagagacaaaattgttgttttccccagttgtaaagtgtgcaatattatccttgcaaaattgtctgtttattttttttgcccttttgggggacaaaatgtctttatgttaaattgttttattattgttatctttatggagttaagggcacataaaatattcttacagagagaaattctgtagtttccacaagtaaccagagaattgttcaaggcagagaattattttttcaatgcctattttctcctgaattttctgacggagttagagataggaaaataccataatctgctataaattcagttgaaaaatagaaatagtgagaaatccaggttgtgctctgtcgtaatttaagcctaatatgtgattgtctacatgtttacaagttaccgcctttttatttcttctctttttctgttttcttcttccatttttatgttttgctatgccattcattcattctattcttttcatttctttttctttttgtaaaaattgtacagagtttaaagttagtcaggtatgtctattaaatttttacgtaaaaagttaaagcagccctcagcatcaacttcttcttcatttctaactcatttagtgaattcagttggtctttatatatgtagctttaagtaattgcatgtaaactgttacttcttcattttctagtcttagatattatctgtaggtttttcaataagaaggaaatttagcttccttctactttggtgccccatgatgatgtgcatcttttttatttctgcatcatatccatatagtgatatcatgtataatgatgtttaagaagacagttttttttgtttaaattgttataaataagtaagtgtatgcaccactatgccatgtagcatatcaagattatttttctttcctgcaccttattttttccctggagttaatactcatctttttttagaaatttgctgagtttgtgatgtacctatcattcaacctcaaactttcatgtgattgtctaaatctcagttccttttattagaaaaaaaaaaaaaaacaactcccctggagcctttgtaccttctgcagtttggggttgttgtcctttttgcttggtgcacaggaatacttggtgatgttctttttaaaactgccctcacattgtatcctggaaagttcatttacctgtacccggagttggaacttctcttccacatcttttcctgtattggtttggttattgttttgtgggagcatgtcttgtagtagctttctgaaaaaggatgatagaatatgtgtgtgtgtctgtgtgtgtgtatttcaggtttcaaaatgtttctgttccatcctcattttattcattgttagggatagaattacagatttaaaatcaattttgcttcagagttttaaattctattttgtggctttctgtgttgttctcgggaagtacaaacccttgtgaccgctgttctctttcatttctatctgcttctctcttgggagtacaatgggaggcatatcatcaaccccttgctgctatccaaataggagactgttccctttcaagagaattttaggtattcagatcctagacctcccagatggcctcataagtatttttatcctctatttatctttgtctttgtgttactttcagggatagttcttctagtctttccatggatttggtgggggggggggggacgtttctatttcctttatgtttgataacattctattcttgtttcatggatgatgttactcttttaactctctgatgttaatgataattgttttaatttttcttttctgtttagtttctatcttctcaaaattgttttcatttcttttggtaattgtgtttgatgatagtctttttttttttttgagatggagtcttactgtgtcacctaggctggagtgcagtggtgtgatcctgcctaactgcaacctccacctcccaggttcaagtgactgtcctgccttagcctcccaagtcgctgggactacatgtgcgtgtcaccaagccgaactaatttatttttattttttgtatttttagtagagatgaagtgtttaccctgttggccaggctggtcatgaactcctgacctcaggtgatctgcccatctcagcctcccaatgtgctaggattacaggcatgaaccaccacacctagcctcttgataaagtctttccccaaatgttctgatctgtggatgtctgtttctatctaagtagaattcaaagttactgctgccaactcttagcacatggccacggccagttaactgtggactcctctgaaggatgatctggctggactattttttgggaaaaccactgtgtttgaatgtttgcatgtgtcctgttggcagaacaaatatcccacagaaggatcttcttatcttctgcttggggaaggtgtagctctgactgctagagttctagagccaagtgagggggagagttctgagtctctgcattcagtaggtaaacatttacaaagtctgtgttttcagtatcatgccactgttctcacctgtttatgttctcttctgataataaacttctgtcatttttctggagttatgaaatgatggtatcctgctgggctgagtggggagggattctcaagctgtacatagctgacacacaggtttctaaaaggttgtctttcaaccccattttcagaagtaccaggttccacattttctgagcctttgctggctctctgataggaattgtgttacttctcagctgtccccatggctagcttaagactcagctctcttaagtcacttcctagttgtccatctgctttccagcatccaactgtaatttttttttttttaagagaaatgaagtctcattttgtttcccaggctggtctcactgtaattcctgggctcaagttacctctcaccttggcctcccaaactgctgggattataggcatgaatcgctgtgcctggcctcaactttaaatttttatattgaataatctttgatttgtattgtcatgttgttttatagcagttactgctgttttagtgtgatttgggatgaaaattttaaaaaatcaatatgtataatccaccatctttgttccttttatttttatgttactcattcttttaagcttgtcttagacgtgagtattatgttttattttgctgggagaacaatttgggaaaatttgagcagcaaaccataagtttcttggtgtctgtgtacttggagctctgaatcactattgtcactgagggagtggacaggaagtgatgctgagataagtctagatgggataggtgggcaacatgcaggagaaacctcctgggaaaggtgagcaagagcacacaggtgagacatagcatcgagtgtggaaacctccatgggtggcaggtcagtgttgctgagggatgtggacatgtctgaggccaaatagatgagtccctattgggttttgcctctccacaatctagaggaatatttatggaaggttaacagggcatggtggtgcacacctgtaattctagcacattgggaggctgaggtgagaggattgcttgtcttacaggagttgaagactagccttggcaacatagcaagacctcatctctacttggaaaaaaaaaattagctgggcatggtggtgctcacctatagtaccaggtacttcggaggctgaggcagcagaatggcttgagcctgggagatcaaggctacagtgagctgcaattgtgccactgcactctaatttaggcagcagaatgagactatgtctcaagaaaatgttcaagaagaaatacaaactattgaaaaaggaaggctgaatgctttatcagaaaactgtatttggaggggacctttctggggtcttttagtcagggtacataagtgtcagctgctacgacaaacaacttgcaacgtctcattatcttcatacaacaaacgctgatttgttcctttcattacatatccagtgtgagttggctggaaggtccaccctacacaaccactcgtgaaggcagacttgaaggggactccactgtcttggagctacactctaaaacaaatagcctccaaagtcaaggactctgtaacaggatgaagcagcattttttatgggcaggtttgcacgtggcatttgttgcttccatcaacattccactggcgagagtgagtccctggcccctatgtaattatgagggaggctgagatgtgagaagcacatgggtgttgggagagcactaaaggtctctagcccagaagcatgacttccagccaagtgagacagggaagcccagaaaaatgtgtcacagaacttatggcatcagaatctgattcccaggcatgctttccaccatatgcatagacatttgcaccccagggatagcaccattactcccaaaaattgcaggtttgaaagggtacctaaaaacaagccaccagattgtcccattccactatcattctgccatcaacaccgaggtgtcggagtagcaggagagccacatatttcttagtgaggggacccagaatgatcccttttgtgctagaggatctgagttcatttcatgaaactgaagcatcttcttggagatataagctcaccttgggataggcccttgcagatgacaataaaggtattttggcacataaaaaaactgctcagcacaccttgtatttgtatttcctttgacgtgaaccatggccatccagtaggccacgcaacattcccactgccatgttggcttgtttttcttttgttttcttgtcaacataagcctcatgagacaacagcaggatgcaagattgtacaatgacaccatgactctgctttctgggtgtcctctgtgggctctcagcagtgtccccgatgtggagggtcttcttattctgtgtgtgtgccctctgctgttgaaagttgcctgtcacccatgatgctgtgctgattgagcaaactaatccataacccaccgccacgttcctcgcctacttgcttctaggcacattaaacggtcagtgcacaggtcctcatttttctcatgcttccatttccatattctcaatcaatcactgatggccagctgtcaacaggcaccatttttggtgggacctgaagatgtatatcccttgttttcagattcctcgcctctcatcatgtaaggtgatgctctgagctgggtcttaaagcttctgggcacagccccccttgagtcttcattatggcaaatctagtgcaggtgctgagaggcggtaactctttaaagggacaggatatggaaacgtggcttcatggacagtattttagtatatttctgtaaatagcacatgtgctagatagcagatttgtgtatggatatgcacccggctagggacctctttaatggtcattcatttgggagatgacctttggttcctaaactggtggacataccaaggactaaaggagtgacttgctctcagttctttgtcattcagctgctttaatattaatatgacacccgttttgggcttgaaaagttttccttctgctgagaaatgatgatggtgacaatgatgacaatgacgatgacccttggttggagcaatgtagtctaaatgtggttgcatcatcttctttcttcctttgccttcctcccttgctctttttctgcccctcatgccggctccttcctcccacatcaccccacatttttttttctttctcctcaccatcaagaaatgttccagaatgccattattcttcgtcaccacggtcaggtatatcatcctaagggcagagggtgaaggtgcgtaattagtgtttcaccagactgagcatcatcctcgggcaggtgcaggggagaatggctggtatttatgagtgaatggcagcgttttgacaggatgatgaataaatatgctgggcccagaggactccaggtgataagcatttctttgtggtctggtaagtgatagcacccattgcttaatttctctaaaatctgcatttgtcaattttgtatttttttatttgaaaggtatttgcttaaataaataggccatataaatctagctcccaatgtccattttcaaatgatttccagcaaggaagatggaattaccacgaggaacctgttctcttatgtttctgcttagatggctgggtctataccagggtttatttaaatgaacacaggaaatgccattcacctttaccatgaatgggaatctttgcctgtgactctatcgtgtgaattagcagagcttggctattattcccctacttcggtagatactggctgtacagaagggaaccccagtttcaatgagtacctatgtgctgggcacttagctggtttttacacacatacttcatttgaagggaaggaattgactgaaaagaattctccattccaacttcccaagtcagttgccatttggccctgataaagctgtactttctcacttgttccttatttaaaatagagaaaagtgcatcaagctcttgttaatctgtcaggccttcctaagatgtctgaagaagttagtttggtgaacatgggcttcagggtcagactgcttgtgttccattcttgatcctatcacttccttgctgcgggaactctggaaagtcacttaacctctctgagcaagcttccatttttccaggtgaaaacgggagtttagcctagtccccacttgataagatggttgtggaaagtattgtgcgtcatggacctaaagtacctaggagattgtcctggatgtcgttttctcataaagttgactatggctattggtggtactagtatgactgtcaagtcgatcaggtggctgaggagcagtacatgggggtatacagagtgcaggcctcagaactgcagaacatctgcacaatctccagcaagctaacctctctggacatcgtattcctcatctataaaagggagacttcaatcttatttaatggcaaaagtcacaattacttttgtaccaacgtaatagaattaagtaaaataaggctagacatgctggctcatacctttaatcccagcactttgcgaggccaaggtgggcagattacttgagcccaggtgttggagaccagcctgagcaccatggcaaaaccccatcgctaccaaaaaaaaaaaaaaaaaaaaaaaaaaaaaaaaaaaattttagtcgggtgtaatggcacacctgtagtcccatctactcgggaggctgaggtgggaagtttgaacctgggaagtcaaggctacagtgagctgtgatcctgtctctacacctcagtctgggtggcagagcaagaccctgtctcaaaaaaaaaaaaaaaaaaaaaaaagtaaaataaagcatgggaagtcccttatacagtttgtgatatgggtacacactcagtgaaatggccattaatactgctgttcttaactctgaaagcagagtgggccatttgaatgctcactttgatattttttaaaggaaaaatttgaggcattgacacatgccttttgcttacttgcttggattggtttgatcaactttgttgcggtctaatttatgtaaaataaattgcatccatttaaatatacaattcaatgagttttgacagatgcacatgcccatgaaaccaacacgaaaataaaaaaaatagaacatttacatcacctcaaaaagatttcaaatgccacttctgtggtgtatgactctgagtccagacagcctcagctccaggaaaaccctggtctgttttctgtcactattgatgaatttgcattttctagaattttagataagtgaagttttctagtacttgttctgcatctggtttctttcattccacataattaccttgggatgtacccatactgctgcctgtatcagtggcttactcattgtcattggtgagtagtactccattgtgtggagaaatcacattgttttaaaaatacctaattacctgctgatagacatttgggttcttcccagtttttagctgttgtaaatggatactaatgtgaacgaagccaccgtgaatattgatgcactagtctttgtgtggacatatatctgttttatcttgggggataatactctggagtggaatgggcagggtggtccgtatagggctatgtataactttttaagaggttggcaaatacttccctaaagtggtcatcccattttacattcttgccaacagtgtttaaggatccacttcctctacatccttaataatacttgatattattggtcttctaaattttctgtttgggtacatagtggtattttgttgtatatttttttttaattgtgaaatatgtgagtatgatgagtaatgattttgaacatgaaaactatgcttattgctcatatctatgttattttattatttactttttttgagatggagtctcgctctgttgcccagtctggagagcagtggtgtgatcttggtttactgcaacctctgcctactgggttcaagcgattttcctgcctcagtctcttgagtagctggtgttacagaagcctgctaccatgcctggctaatttttgtgttgttttatttttattttatttttttagcagagacagggtttcaccatgttgaccaggctggtttcaactcctgacctcaggtgatctgcctgcctcggcctcccaaagtgctgggattacaggtgtgagccacagcgcccggtggtcatatctctttcttgcgtttttgtgggggttggggtaataggtttattgagatataattcatataccacacagtttcatttttagtgtattgacaggtgtgcagtcatcgtcacaatcaagccatagcttcttttaaactttgtcttccttctctttctaattatctccttcccccgccccctccattctctttccatcctttaaatgtcagtgtcccccacaattctgttgttgaccctttctccctctggccaatgctccttcccctgtagatcatacccattcccaagatttcagtcatcaaatccattccaatatgactcctgtatccatatgtctagttccaagtatctgtccatggtgttggtcccaggttattcgcacctcatatgtctttggcacagcactcttgacagctcataaagtcacgctgttacccccacaatgtccccccacatatcattgctatccctcctcgacacccacacctcttgcatgttcctgagcttcttaggcgtgttgcatcttcctgaccttcccagtccgaagcccaaggagatacttgataaatattcgtctaataaataaatgaacttgtgttctccatattccttgaaaatatgcttcacttttatctttttaagaaattaattgcattactatcttattaaaggtcaagaaaaataattcatatcactcactattcatgagactgctaaatagttgccctggcaatttctgattataattttagaaatatttctaacctctggccttttttcttatctctacttaaagcttttctggaaggaattcattttccactttccttaatgttccttaaatgttgtacatatcttaaaagtggattcctcataaaacaatatggactatggtcttattctgtttaacggtatgaaggctcgcctgaaaggccaagagtaagattcttttaaaatcatgcccaagttttaaaggaatataaaactttctctttaaaaatatacctttctgcttccatcccctaacccacaaagctcaagtctagtttaattcaaacttggaaatagttcttttattattgctccctgcaatgggaacagagctgaggctcctaaggtctagagtcaacatgaaaatacctttgcttctgggccatagctgtgtttcttcttaacaaggcagaagcccagaagagacttcatgtactgtgactgtaataaagagggttgtaagtagagaagctggaatttgaaaggttacgtacaagtcaagctgcctctgtaatgtcacttatatccaggaaagagtggcaaagaaccatcccagcagatagcttgagggtgggaagggggataggttgttgataatatggaataggagaaaaaagatcatagagccaaagagctcgatacatatactgatgcggtgtttattttattttagttttttgagacagggtctctgtcgctcaggctggattgagtgcagtgaatcttggctcactgtagcttttgcctcttgagctcaggcaatcctcctgcctcagccccaccagtagctgggactagaggcacatgccactacacccagttaattactacattttctgtagagacgggctttccccatgttgcccaggctggtctctaactcctgagctcaagagatccacccgcctctgcctcccaaagtgctaggattacaggtgtcagccacagtgccatgccctgatgtgatgcttaaattcagaaattgggaaggagggtcaggtagctataagcaaaatacaagagaaatataagagaaagaaagacttgtatctgttgttagtgagtttttgtggtggtgatacattaatggaggcaacagagggtcagaaatcagggtggaaaatagcccagcagaggggaaaagaggaagtctgaacgagggccacattgcagatagaggccggtgtactggtctgctcaggctgccataacaaaataccacaggctggataacttgaacaacaaaaatacattttctcatagttgtggagcctagaattccaaggtcaaggttccggcacagttgatgtcttctgaggtctacctcgtctgcttgcagacagccgccttcccaccgtgttctcacgtgacctagccgctgtgtgcacgcatccctggtttcttttcctgtgttcagatgtcctcttctttgaaggacaccactcagattgcaataggacctgccctgatagcctcattttttacataatcacctctttataggccgtacctccaaatacagtcacattctgaggtagtacgggttaggtcttcagcatatgaattttggggaaacagaatccagctaacaacagttggggatgaggctataacgaataccactgcctaatgtttgcacggggatatcatgcttttcagagaccatctgcatccttatctcacttaatccttgccccaccctttagaagaagccaggaggaggtcctagtcagctgatgtgagattacatggccctgactgtcttgcctggtgctgcaggccaccttcacagccttgccataccttttcccgtttatccatggattggtatgagccctaatggtgcacccttccgacaatccttcatccttcccagacgtttcatcagccaggtgaaatttgcaattgtttcagtgattgaaattatgcttggagtgcaggtgtcaccgatgaaacagcaatgccttgcggtgacaaattcagtgtagaaataattttagcaagcccagtgattggaaaacaatgactcaactttgagctatattgattttgtatttctgggctcagcttttgactcagtctcattccccagaaataatccctgttaacatttcggtttgtgttatggaagtgttctctcttctatgaattacctaatgcccataccatacatatgcctgcatttgtacactcttaagccaaataacatcgtactgtgtattattctctagtagcctgctttttattgaacttaatgataaatggcaaacatttgaccatgtcacttaagtttcttaccgtgatctccaacagctaggcaatattctgtcatatgggtttaccatacttttctcaatccacaatctcatcagagtcccaatagttgcctgatatgtctccatcagttgtgaggtatgtttcaagtgatttattactagaaattcttagcgagctgaagtttgtaaattttctcaagctactttattgatatataacacagatacataaactttgcccattcaaaatgtacaattcagtgctttcagtatattcagagagttttgcagctgtcaccacagtcaagtttagaatattttcattttcccaaaaagaaacccttgactggcatccttttccccacttccttttctctccactcccaacctctctcccagctccaggtaaccactcatctactttctgtctctatatagatttgcctattctagacttttcatataaataaatcagatactgtgtggccctttgtgtctcgatccttacacttagcatcatgttttcaagggtcattcatgttgtagcatgtatcagtacttctttttttagggctgagtaatattccatttacggatatgccacatttcatctatgcattcagttcacggacatgtaggttgtttccacattttggctattgtgcataatgcttccaggtacacttgtctacacatttttgtgtggatataggtttaccttttttggggtatgctcctaagagtgcaatttctggatcacgtggaactccttgtttaaccttttgaggagccaccagattgttctccacagcagccacacccatctacattctaaccagcagtgtaggaaggttccgatttctccatatcttcaccagcactcgctgtcatttttctttttagtcttgtcattttattgggtatgaagcggtattgcattgtgattttgatttggattttcttgatggcttaggatattgaacatctcttcatatgattattggatggatgatttttttcagcggttatcaggtcacacctgtaatcatgcccacctcattttcttacagtgcagtgtgtgcttttaggcacataccaagagcttacagagatccttctggttcagaggaaagattcacatccccaacaaacactgctccccgattacaatatagagaggctaaattatagtccatatcacttttcctttaaatccctttacttttttgtgctacaagagtttcagaataataattccgcagaaaaaagtactgattgtccagcagttgtgtcaggtagaaaactgggatgcccgactgcattggtttagccagaactatggccatgaaaccttgcctggcccccagggatggggtgaggggggatatcatatacgctttaggtggggcagaggggtggtctgcccctgtgcaggcaggaatgttcaggaagcaggctgcctctgtttctactctaaatatttaacattcacggatggcatggatcctgactaagcggagcagatgctggctctatattgcacatagctcctgaatatcagccctgcgtggctatgcatgtgttttttgttagtttttgagacagagtctcggtctcttgcccaggctggaatgcagtggcacgatgttggctcactgcaaaccctgcctcccaggttcaagcgattctcctctcccagcctcccgagtctctgggattacagacgtgtatcaccaggcccagctaatttttatatttttactcgagacgtagtttcaccatgttggccaggctggtctcaaactcgtgaccttaggtgatatgcgcccctcagcctcccaaagtgctgggattataggcatgagccaccacgcccagcagtatgtttgtttttcttcaaacctagatcaagagtcaaacactcaaatgtttggtgggagcagttgatgatccagagctttggagtcagcgagacagtagagagtggtggagatggtggcgcacaagagggtcagtgccccatctcaaggaacagctgcacctcggcctatgcgattgtgaaaatgtgagcatatgcaggccagaccttggcttctctgtcttcatttttcacaggagccagaagtttggatgtgcaatgtgaaatctcacaaattaaacatgttacataactgtattttgtttcctatctctgctgtaataaattttctcaatgttagtgacttagaaccacacaaaagttacactttacagttttggaggtcagtggtccaaaataggtctcagtgggctaaaatcgatgtgtcagcaggacaccatttctttctgtaggttctagaagagaacccacttccttgctgtttccagcttccagggactgcccaaatcctttggctcatggccccttcctctatcttcaaagccagggatggctgctcaagtccttctcaaactgccctgttcctggttctctctcttctgcttctgcttttaaggaaccttgtaacttcagggagtctaccctgataatctgggataatctgcctgtttgaaggtcagccaattagcaatcttaatgccatctacaaccttaattaccatttgctatgtaacatatttatagatatcagggattagttcatgaacatattggggtagagggcattccacatacagcagtacctataatgtatatgcttcttaaagaatgcatgagtcttaaatttattttatgtccttggagtgtatagcagagttagatagatccttctggattggcggttgattgaatattggctgtacaaagaaactggataggagtatagagaaaagatcaatcatagcactagcttatagtttattttattctttaatgattttttaaaaatatttctctcacttacttgaaaagcagtcttagaaattaactggaatgggtaatttattcgtctttcttcttttgtaaaataatggcagtttgtaactcagatttttgtatgaggaataaataaaatactgtctgttttcctttgatctttctatttgtggtccagccagccagctaactatgcattcctttttctgccttttcatcataacacctatcttagcaactcttcattgctgctttgcaaagaggatttgagattgtttatgtaggggcccgtgtataatacctcaagagaaaaagacacagatgaggctattaggattaagggaaaatcaagtaaatcgagaggtaaagcactgtgcagaaatattggccagaagctatgaacagatgccacagctgggctgaagagttacctgtgagccttccaggggtgtaagccaagagaaagacagttcaccaaatctatcgattaatagaaatcatccagcagcagtgccactgtaagatgttcaatacgtagcacctttctgtcccttctcctctagccagttgggacaggattagcaagccaaagactttctgaaataatccttagctatattcttggtattcaccaaggaatttaccaatatgcaaagacttggggataattagtattatctttgccattacctgcagtaatattatgaagattagagatgtaactctgtcctgaagaactgcagtctgtggctcaccttggagaagaacttaagaacttattgaagtgagcaggctcacctgcctttgctcagagccacatcacctgcaggcaggatctgcaaggtcagcagttagcgtcaagttgcacagcctgggcttgggtggcgttcgctttacccttgcccttgatgtggtgccgagttgtcaggattctcgtaaaattcctgggtgatggcttcttctgttctctttatttccttaagtgaacatctgtctaattgttcacctccatcgctttcgtgctttcctcatgctttctctctttccagacaataaactttattttcttcataagaattcagtctacgcaagggtattaggcagcttgtttgcaccttttaattcctggatgttttccagaaaggctgtttgcagtagttccagtgggttcatctgtgaatcaggaaagacaatgcagctttgtgttttggtttttatcagttaccttctgtttgtaaacatctgtttggaaacgtttgctggtgcccaccccagcacccccccacccctgccagaaataaagggattaatctctttttgcttggcatagggagaagacagtgtctgctgatgtgcttaacttttttttttttttggtcaggtgtgtaggtatgtgactgaaacccatagactttgcacatattgtcaaatgactttccagagggactcaggcactttatttaattaatgccaatgaagcccgttaatccgctcattactgcagtttaattttgatgctggtttttgatgatgtattgaaaacttgtataaactggcaattacaactggaaaacatttctagtttagaagagacccttatttttcatatgcttagaaatatccagcaagccacttttaaaggctttttatcacattttattcttaagctttctgaattccttattatattttgcctgataaatagttggattttgttttttggttcaatgtaagaatattcttaaactaggtaaactgttttgtttgtcattatgttctctcattctgttaaattttgttttctatttttcatgtttttgggtttttctagatggcctgtctttaacacttcttgatatttttgattaaattttcatatatcatcaaaaacagagatgacagccaggggtggtggtgcatgcctataatcccaacacttttggaggccaaggtgaggagaccacctgaggtcaggaattcaagactactgggcaacatggtgaagctctgtctatcctaaaaatgcaaaaattagccgggagtggtggtgcatgtctgtagtcacagctacttgggaggctgaggcaggcgaactgcttgaacctgggaggtggaggttgcagtgagctgagatggagccactgcactccagcctgggtcacagagggagactctgtctcaaaagaaaagaaaagtagagaggatagtataatgaggttcctgtctgccagtcactctatagtaactattaggaaacccctttttttctctgaagtcattgctcctgtgtgtgtgtgtgtctgtatataaaaaaaaagtatgtatacatatacgtatatgtatgtgtatagataaaaatgcgtgtatggtgctgggcgcagtggctcacgcctgtaatcccagcactttgggaggctgaggcgggcgaatcacgaggtcaggagatcgagaccatcctggctaacacggtgaaaccgtgtctctactaaaagtacaaaaaattagcctggcgtggtggcgggcacctgtagtcccagctactcgggaggctgagaccgaagaattacttgatgaaacatggcagacaacgtagaccagcagcaaactaccaacactgtggaggatcccctggatcttaggctcagcccagaggagcgaatttgtgtgaaaatgagaaacgaccgagagcttcgaggcagattacatacttatgatcaacatttaaatatgatcttgggagacgtggaagaaactgtgactactatagaaattgatgaggaaacatatgaagagacatatgaatcaacaaaacagaatattccagtgttctttctccggggagatggcattttcctggttgcccctccactgagagttggctgaaacaaagaatttgtcctgtacggaaaacaggagactttgtacagtggcctctctaaatgtgcaagatattcaaaagagaaacccgcatacatttggatattaagaaataattctggggattcttccactcctgaaatgagttgatttgcagataattcacaacttcttaagctaaatggtattttcgtttttctcaagctcttccaataaatatgaccaccaagatttttttttcctaaaaaaaaaaaaaaaaaaaaaagaagaatcgattgaacccgggaggtggaggttgcagtgagccaaggtcatgccactgcactccagcttgggcgacagagcgagactctgtctcaaaataaataaataaaaatgcatatatgtatatttgtgtgaatcatatacacatatataaaatatatgtatcatatacatatatatcacatttctttttctagtgtgtgtgtaccttgatttatgtctcacatattcaaaatactcaacttgtttaaaataagagcacaacctatttaagtagtaaagattcaaagccttcttctaaaatgcttaactttcctgtggatttgtggacccgtgggaaaatctcagtccccaggcaggaaggaaggagatatgacacatctctagtttgttgtaagtcgcctaccctagacctcatctccagtgctctgaatgtggagaggtaggtgcagggcagtgggacagagaggtgcactttgaaagactatcacatggaaacaaaagttccggctgggcacggtggctcacgcctgtaatccaagcactttgggaggccaaggcgagtggatcacgaggtcagcagttgaagaccagcctggccagcatggtgaaaccccgtctctactaaaaatagaaaaaattagccgggcatagtggcatgagcctgtaatcccagcgactcgggaggctgaggcaggagaatttcttgaacctgggaggtggaggttgaagtgagctgagatggcaccattgcactccagcctggcagacagagtgagactccatctcaaaaaacaaacaaaaaaaagttccaatacacaatatgttatatgagatcttcacccaatcaaggattaaatggccaattcctaaatgatgcctacctttttatggccatgtatacctttgcctcagtactactggcatttgctgacatccatttatcaagatacagggatggatttctagaaggcccaggcaggggtgctggccaggagacaccaggcatagaccttcctttctcagagccttcgtggcccctagtttgaatctttgagtcactgcagtaaagttcctgatgtttgagagtactccttatgaagggagtcatatgagttgctagctgggttctctggatggtggtgtcatgccaacatgggagccactagcacaaagaacatgctaggttctgttgagacctgactttgggaatagcataggtacttacctttctcagcaccacacaaacacactccagaatgcaaaggaacctgcactgtgccatcttgcttctccctgcatagccacttctctttccagtggtgtttgtattttggttcattcaatcaatgaatgattgattgaatcaaccacttggtcccttcaatctgtaaccttcctgcaacactgtctttgtgatgttatcataaccttgatttttgagggatagaattgggcataatcagagaaaacgtggtctgggacacatttgtgggctattctatgctaaacatttccatatcattaatgttcaacacagctttgtggtgttggagataggattatcattgttaggatggttattatcaatactagctgtgattattgatcacttccacatgccaggcacagtgctgggtgctacatatttattacctaatttatagcttgctgcactcttgctgggtatgtgtaattattcccatttcacccgatccctgggagtttggtgaattaatcacccagcatccaaatagctaaccagtagcagagctgggattcaaactcagttaggctgacttctgtgcctgttttcttgcctaagcggtggacgcattgagtaggagaaggccagttattcctctttgtcactgatacaactggggacctgttgccggagatgtggagctgtgcattagggctgggtagaacacacataatgaaccatatgcacgagaactttttcatctttctgcatacacttggaactagttctttgtttttgtaaaagcatcatgcactaggtaaaatgtttaataacacagagaaatctaattgtcaagtatcttctcaacacacattaatcaacaattctcctatcgaaagataacctcttgtatttacaaaaaaaagaagaaaaagtgctgtcatcagtaaattcattcatgtatgttatacactcacatacaaaacgtatctatttgattaaattagaactctgctaatgaattactttccttgattgcacagtaataaagtcaatgttgtaaatataataattatagccaagtgcagtggcttacacctgtaatcccggcactttgggaggctgaggtgggcagatcacttgaggtcaggagtttgagaccagcctggccaacatggtgaaaccctgtctctactaaaaatacaaaaattagctgggtgtggtggcacatgcctgtaatcccagctactcaggaagctgaggactgagaatcgcttgaacctgggaagtggagtttgcagtgagccgagatagttctactgcactccagcctgagcaacagagcaagactccgtgtcaaaaaataaataatatgtgtgtgtgtgtgtgtgtgtgtatgtacatgaattatatacaaatgagggaaaatatacaaatgagttgaatatatacaaatgagggaaaaattgttccttgtgtcaggaacaattactgtgaattttgtgtagctctttctgactttttaaaattcaaatatatttcataaagttgaaatcacactgtggtcttttttttttttttttttaaccagacatatagtggccatgtttctatgtcaatacatactgtttggcagtacagttgtactgacttgacattatagcttcataacttagtaaattaatcccttattgctgggcacagattctgttttccattttttcagtcatgagcaacgttgctggtttacctgggctaaataagaagtttaaatgcaaatagataatgcttgagaaagcttcttcccatatatactctttctgtagcagtgtctgagtgtctgtaccttcctataccttcaccatatcatgtatttgtcattttatagtgagttgtattacttgctaggtgagctggtatctcctctgataacacaaagaaggcctgggtttgcttggcaatttgttccaatattcttttcagttttaaataagttttgaacaaaaagttttagcattttacataaaaacctctaaagctctcaggctaattagtaatgtagcatatacaaattaagtttttttctgctgtgcttaattcttattaacacactaatcatgagagcccccaaattgctgtaaggagcacatttagaaaacatataaaggatcgatagttggtacttaagaaatcgttgaaacaccttttcttttttaatctatcttagagctgaaagataaaaagacttaaaatgagttagaatatgagtttttcagcatcttatagcttatgagttaaagcaagatttaaaaaatacatttaacatactaaatatttcaaaagctacagagataccgtaacatttaaaaaaataaattttcattgtggaaatcaactgccacaaaaacacaaccttttacgagacaacgtgatgtgcatgagaagccctgatgttgagaagctcataattcggtgtgagaaacacacaaggcatgatgccattcccatctgggatgaacagggaagacttcctgggagaggtgactatggacttaattttgttttgacacagcaaaaacatgaggaatgaattttgtgacttggaagattgttagttttctgtggagggaacaacactcatcttgcaaatttgccttcactattcaatcattagaaaataattttaaatgagcttagcagttctcagaattttggatttcaggaaacaaactttttaaaaacaaaacaaaaaggaggataccaatttaagcttgtcaaaaagattttcccccaaaagaaaaacacattaaaaacaacgacaaaaatcaacaaaaactaacactattcccccatcaacaatcaatattactttctaaaagcaagggcgttttgacaccagatattgtgaggacatccacctgctctaagggacagccatttcactggtgttctgtcaatttttattttgaactaattttagactcacatagaagttggagaagtaggctgggcacagtggctcatgcctgtaatcccagcactttgggaggccgaagcgggctgatcccttgaggccaggagttcaagaccagcctggtcaaatagtgaaatcctgtctctactaaaaatacaaaaattagcctggcatggcagcgcacacctgtaatcccagatacttgggaggctgagacatgagaatcacttgaagctgggagctggaggctgcagtgagccaagcggagtgccactgcactccagtctgggcgacagagtgagactctgtctcaaaaaaaaaaaaaagttgcagaaatagcaatatttcacagtacctctactttcttgtaattttagcagtttacctaatcatggtataataatcaaaactagaaaatagacaatggtgctaaatattaactatacttgttactcaaatttcaccactaaagcagtgtcatctttttattccaggatctagtccaggatgccacattatatttaattgttgtatctccttggtgcctttagtgctttttttttttgagacacggtctcactctgtcacccaggctggagcacagtggtacgatcatgggttactgcagcctccacctcctaggctcaagcgatcctcccacctcagtctcctgagtatctgggactatacgcatgcaccaccatgcctggctaatttttgcatttgttttatcaaggcagggtttcatcatgttgcacaggctggttttgagctcctgggctcaagaaatctgcttacctcggcttcccaaagtgctgggattacaggcatgagccactgcacctggcttggagcattcagtctttgatagttgcttacttatttccttctttctgatcttgagaccttgatttgtccagtattttctcatcattagctgagtgtaagcattttttggcaagaacattataaaaatgatgtggtgtctttcttagtatattatctcaggtagaacataatgttgatctgtctcatccctggtaatgttaaccttgatcacttggttaaggtgatgtctgctgagtttttccaatgtaatgttattaatttttcctttgaaattcataattatttgaagggagatgttttgagatgatgctggcagccccgttttccttaaactttcacatgctgactttctattgttggatcttgcctgcagcagtgtttaccatgatgcttggctagtggtgactatgtatttcccttactctttttatagtcagtaattggaattcttctgaagaaagagctatcccttctcccccatttctttcttttcttttctttttgttgagacaaagtttcactcctgtcgcccaggctggagtgtaatggtgcgatatcggctccctgcaacctctgcctcctgtgttcaggcgattctcccgtctcagcctcccaaggagctgggattacaggtccatgccaccatgcccagctaatttttatatttttagtagagatggggtttcaccactttgaccaggctggtctcaaactcctcttctctggtgatcctcccacctcggactcccaaagtgctgggattacaggtgtgagctacagcgcctggcccctcccccgtttatttctgattcaattactttatattagcgtagattcacaggtatttcctttttttttttttgatttattaatacctccatttattctgttgctgaaaccattccagctttttctggttggcttctatgaaggacgctattttaatggggtgatttttttcttctcactacattcttcctcactccccactttttatgtccggtggccataggctggtgagaacttgattttgaacagttgaaggtctgctgttagggacgtgctaatctagggaattgtactgaactcgtgggagcatgttagtatcagatgtgtgccttgtccgtcttgcttgtaggaagaacaagagacgagacacagcaaggtgatgatgggtatgtgaagcaggataaagaaaaaaacaggacaggcattacaggcttaagcctgtaatcccagcactttggaaggccaatgcgggtggatcacctgatgataggagttcaagaccagcctcaccaacatggtgaaaccctatccctattaaaaatacaaaaattaacaggcgtggtggcaggcatctgttgttccaggtactcgggaggctgaggcagcagaattgcctgaactcgggaggtggaggtagcagtgagctgagatggcaccactgcactccagcctgggcaatggagcaagactctatctaccccccaccctgcaaaaaaagaaaagaaaggaaaaaaaatcctggtgcttgtaggagaggcatttatttcttttaggactggacggggcttggagggtttccaggaaacagcctcaacctaaaaatagtagacacagttcatgaagaacttactatgtgtccagtagataaatataccacaagcattatcttctttaatcatctcacaatcttatgaaggagatactagtattttgcttgcaaagatgagggaagtgagtttccgaagttgctaaatgcgtaaaggaggtggtggtgtcagaatgttatcctgctcagatggttgcatgggacagtgtccagaggaaggcctctgattccttccccagcattaggcaatattcaagtcttcagttccatgtgtaggggagaagactttccttctgctccctaatgacagtggtacccacacccgtattccaccataaaatcttttttattcagtattaggaaaaaagaaacatctttccgtccagtggtcactgtgtgtgtatgtgtttgtgtgtgtgtgtgtgtatgtgtctgtgtgttcaccgtgctgtgtgaattgtggctttaaatgtattcctgtcaattccatatatttttaaaatgttgcttttagagtatgtgcaagtttggggcatttttgagggcttttttttttgacggggtcttaatatgtcacccaggctgcagtgcagtggcgcgatgacagcccactccagccccaaactcccaagctccagtgattttcctttctcagaccccaaagtagctgggaccacaggtgcacaccaccacttccagctgattatttaaaaaaaaattttgtagtgacagtgtcttgctgtgtttcccaggctgtccttgaactcctgggctcaactgatcttcccagcttggcctcccaaagtgctgggaatacaggtgtgagccactgtcccaggccagttttaactcagaatgatttcataagaaatccacatctgagagtcccagaaggtaagatattcccctttcttctaaatatacttgaccaccaccattcaggttcttctattaaccttcctatatttgccaaccctcaacctgttagaaacaagaaatgggactctggagtagatgttagcaacatcatgagctcaaacccctccagcttacagcggagacagtgaggtcctgtaggatgaggttggagagcaggaacttgcccgaggtcatgtgcagagttcgaggcagggcctggatgggaagcccagcatggagaccccaggccgtctctccgccatcttgttgtgatgcttccggaagaatgcctgtcactcttgctgacatccgactgaccaagtgggcaagaggaattcttcaaaacaatttaataaatgcttacattttctcttggccccgtgccacatccccccactcagtcttgttttcaaggttgaaggttccttcagagctagtgaccttgcccttcctggcctgtggatgtcgctctctatccgtaaccctcctttccagcgaccctgtttgcagcaaagactataattttattttgggtttggatatactgattacattttagcttctggtatattttcttacctgtcacagccattaaatttattttaatagttactctactctcctgatagccactaaagggggaattggatattgtctatcaattggttggtctctgaactaaggctgtatctaattacaaggcattgtatcggttctgatttattaaccatttacttggctttggagaaggcagcatttttagtagtactgttgagcctgcatgtagcttttccaggagggcagggtgcccggaatatctgatcttacagttattactttgtgtcatatataattttgttttctccctgcaacaaataaatctttgggactccggaagaaaaaaaaatgggaaagaaaaaaaaaatttgtggttacagtataataaaaataaactgtttgtcgtgactgcagctgacatttatcagcctgtttgtgggtgctctttctctataatacagaacataatttgtcactttgtaaatacattccagtctaaatccctgccagcatctgttagtgtttgaaggattaatgtgctaccctgtgtatgtctgcacttccagggaacagtgtagcatctgattacagatcgtgggagagcaggagggaacaaggtgttttctgtgctttttcctacatgcagtcgttttggcctttttctgatttttcttgtctttatcccattctgtctaggtacctggaatttcattctttacaaagatgttcctggtccccaacctttcttctgtctgtgatagtcacagctgaagtcatagtattttctgtgtactatgggttgagctgtgggtaattctttggggccggttagacttgggttcaaattctttctccaactagtttatgagcttaagttatgtgatttccatttcttcacttgcaaaatgaagatgctaatacctacttcttgaagatgctgaggttgagggaagaaataaatgttaatgcaaagtgcccagtttagtgcctgccaagagtaactggtgggtctgtgtcaccttctgacattatcagtgtgattgtctccaacgcatccatggaagtgaaaccgctggaggaagctaatgccgtgagccagctgttggttatgtttttgttttgtttttcttttttacttgctggatagtgggttctgtttattgagaaatatttacatccgtctaaatcaggtgcttgctagggttcttggcacacagagcatcccaccaataaactgtggttcccaacaaggcttgcaactgaatctgggcaacaatgaacatgacttcaataatgacaaaaagattcagattcctgctggaaggtccatatgtgctgtccccagtaggattctggaattccctgaatcatagtgttgcttgtaattctttccacattatgaagtggctctatagactgcctaccaccttgtatctactgctgtcgtttagattaggaacagattgccagatgtggaagaaatagcctcattagtaacttttctgtaagcaatctccttatttcttgttttttgttcttttgttttttgtgtgtgcttctgcgtgcccctcctctatggctccccccaccaaatttctgtgtcttcatttgcaactctcttttctccagtaaagaggaaagtgtatagttctcctttccttacagaaacattattttgttattgttgttttggtttgggtttctgaagtataaatgcatatgaactggacagaagtattatgcccatgtgccaggtggccaagatggggcttgtgatttgaagcttcttttcctagattcaggaaagtatcactggttaatcagggaatacatctttcggcccattggaaaatgtctgttcttagcaccctaaatgcccaggtattagcatacttgggaaatgtctagaaacccctatttcaatttactgaccatttttggtaaattcctagagatgccaaaatgcatttcaaaaagctttcatgttcaagaagacttgtggaatgatagaaaacatttaacgctgttatgtacgaagtgaaatactgttaaacttttagattatttaatagaagacacattttacaaggcaaagtgtttagatatgctccctcctatgcctatccacacatccttaactcttcacgttgtttgagactgttaggctgtttttttattgtatatttcatcaaatagtgggtgataaaacaacagacactctaaggaatggcatgacattctcctttcttctcctgcattcattggaacctgaatgtagtattaattataagactgttagacttcaggggactacactcttattctaaaatagtggtcaactaactgtgcccttcagacagaattcctgcccagcacctggctttgtaattaaagttttactggaacagaggaataccagttaatttatatctcgtctgttgccacttttgctttcatgctattaaagctgagtatttgggagatacttgaaaaatctaaaatgcttactatctggccctttagagaaaaggttttccaatctctgttctagaggattcgtggtcatttggaaagaaaagtatgttaagacaaaatgagcaggtggttggattagtattttctttctacacatatagaaactgttcctatcatacgtgactcagttttcaaacttgcttaatccaaagcctggggggtggatgtaggagagaagttgaaattagctggggttttttttttgtatcacaaaagttacattttttttttttttttttttttttttttaagacgtagtcttgctctgttgcccaggctggagtgcagtggtgtgatttcagctcacagcaagctctgcctcccaggtttacgccattctcctgcctcagcctcctaagtagctggtactacaggtgcctgccaccacgcccggctaattttttatatttttagtagagacagggtttcaccatgttagccactttggtctcaatctcctgacctcgtgattcaactgcctcgccctcccaaagtgctgggattacaggcgtgagccaccgcacccagccgaaaagttataattttaatggtctaaatcaaatttgttcaacctgcagcctgtgggcacatgtggcccaggacagctttgcagcccaacacaaatgtataaacttgcttaaaacatgatgagatattttttgccatttttttttcaactcatcagctatcattagggttagtgtattaatattttatgcacagcccaagataattctttgtccagtgtcacccagggaagccaaaagattggacaccctgggaataaaacagaaaaaaggtgtaaaaggcttcgagttcatggacagaacaacatttttgtaagtaaagtatttacggatgtggcccctttgtaatctcctgggctcagggataatttccaggctggggagaaggttgtgtcatggagacagcagtactgttttggaaggagaattgacttgtcacaatggacggagaactaccatcccatttgggccaacctcttttttttttttctttttgtttcgagatggagtctcgctctgtcaccaggctggagtgcagtggtgcaatctcagctcactgcaacctctgcctcccgagttcaagctattcttctgtctcagcctcctgagtagctgtgattacaggtgcgtgacaccacaccccgctaatttttgtatttttagtggagacgggatttcaccatgttggtcaggctggtgtcaaactcctgatcttaggtgatctgcctgcctcagcctcccaaagtgctgggattacaggtgtgagcctctgtgcccggcttctgccagcttctcattatgatttttgagcagatttcgctgctttttctgcctttgttgtgtttataaactagaagtaattatgtcaactttgtaagggctcagtagcgtagaataaggccatgtctgtaatctccccttctgtgaacagaggttatgttctcaaaagccttcaattaacatgagtggaatggattttctaaatttatatggaggagaaagttgtaggtcctatatgagtgatgacaggtgatacttaagttaactggaacatatggcccttagccacaatttccccacatgcccttctgggggatgctttgtagacctgatatcccagaaaggagtgtggactcataaagtcactgctgtcctttggttttcctgatgtaccaaatgtagtaaggcctcttttcaatgtggtaaaagctctgggccaccccataaggctgcaagcgctagaagctcttcccatagagaacatctatatcctcaaaccaaggagaaaaaggaagctgctgttcataaatattgaagaggcagggagagcttgcactgaggccagggtgtattaacatgcatgccatcgtgaagtggcttctaatggacatttgtaaggtggtgtcccctcccttcccctcccccctctaatgctgcctgggttgctctttgcaacacgtgcagtctgcaacttagctggcttttagcaaaattacccatcgcgattcatttgtcccattgggccatgggataggtgactacagagccagattcgaatgtggccctgtgccggtgcccaaaccagcaggctgcacgtgtgcactgacagaatggtacatcccaccactgctctgtgtctgtgtgcgactgtcagttgctctctactgctcctcatagacttcctgtctgcctttctctgcatttctcagtctccccatctccccttcttatctaatccccttccttcctctctcaactcttccttcctctatcctttttctttcccttttttttttaactattcttctttagagtttgttttctcattgaacttgtgatgtacacattaaaggaaaactcattaatgtggaaaattaggagcatcatagctaatgtatgctcagggcttactgtgtgctagacattattctgagtttacacagtgatgtcagatttctcctctgtcacagtaagttccaaaagatagtgaagaatattgcagtgaaaacactgaaactcacatatttcatactcaggggtatcttttaagtgtgaagcaagagaaaaaaacgtggaaaaaaaaagactcaggaaatgctttccatttagctttcttgactaagttagtggaagacttattccagattataaagagaagaaccaaaataaagagtttaagaatgaaggggtatgcagcaactggtagggtcgagtctcctcaggcacaacatgcaaccaaggaggggcagctcactcggcctgcgctggccacacaagtgcacctgccacagtattgaggggctggactgatttctcattaatgtctgggcaaaactcaaagaggcaaacattttcattacatactgttatccatcctattgtgggaccaatttctccagaaaggtctctctcggtgggaggattaataaacaccatcagaaatccaattaaacccaattgttaaaatccaacaaatacgttgcttgtggatacagttgtgtatagtaatgtgtatggtgatggcctatcatataggaatgatagaggcagcacagtgctgtaatggaaaccataagggcacgcacaatggctcatgcctgtaatcccagcactttgggaggccgaggcgggaggatcacataaggccaggagtttgagaccagcctggccaacatggtgaaaccccatctctactaaaactacaaaaatagccaggtgtcctggtgcatgtctgtaatcccagctacctgggaggctgaagcatcagaatcgcttcagcttgggagctggagcttgcagccagccaagatcacaccactgctctctatcctgggagacagagcaagactgtctccaaaaaaaaaaaaaaaaaaaagggcatggatctagatgccagacaatctgggtgcatatctttgctccaaaagcaaagattgtaaactctctttacaatctggggcaagttagctaatctctgcttcagtttgctccttagcaagatgggatgatattaccacttacctcagagagttgttaaatgggtaaattcatatgtaagtgttcttagagcagagttcagtacatagtaagtactgtgtaagaattggccatcattaatattattcattggataaatatcaaattcaaaataccgtttacattgggaaagggaaaaaggagagaaatatatgagagacgtatgctgggggtatctacgatgtttttttttttgatttttttatgtcattttaaatgtttctattcttctgttctgttcttaaagtatgcctgtaattattaggatataattatggattctgtcttatttattttttaatcttcttattgtgtctatcttttgtctttctccatattctgggagaaacatctaagtttccattccttataactgattatttttcttgggatcaattctggtcttcaccatctgccaatgtgagttttagtttctctataaacttttaaactttaaactttttttcttttttttttgggggggggggggcaatgcattcttaacccccttccagtttttctcagcctattcttgtttgtttttgttttctatttctgtttcattgagatgcatacaaaatggaagatggccaacatttctaaaaattttgtttcctgacatagagaacgtttagaggtcaggttgctctgagactgtgttgtgatttcttttttttttttttttacttgtttgtcctttcttttattatctcttgctgttatcctcacttttttctttgctgttcttcatcctttaattagcattcaaactaatcgttattagagtgtgtaacatgatctttgacatacctaggtaattttacttaagtatatgagttaagttgatacgcacagttcctcagcatgaatgtcattgttttgcaaattttagctgaaggtgacatcactgtactaaaattttcttgtgcatccacttcctagctatgactctctacagatggatataacttttttaagatgaaaaccatttattttcaatttctagtttaactgcctcacagtaaaaaagtgtactttttgtgatggcaggaatttgaagtatgttgaaactgcctttgtgatctggctcatggttaacttcaataacgtatgaaaagaatccatatttttatgtgtagtgttctgtagctcttttagttggtttatactcttttaatggtctgttgaccattttatctaaatattccattttgtcttttacttatttctattataaatggttaatctcttctactaagattgttaaatccatctttttgtttatggctgtgttatttggcacatgcaagttcatgattgttatatattcttgcttaattatttttccctttatgcatcatccatttttatctttagtgtttagtgttttttatttttattttgcctaaaattttatttttatgttaatatttgctatactagctattctgctttcaaaatgttcctgatgtttttctttatctttatcatttatcttttatctttaacatttttatatttctctcttttaatcatgtgtgttaggtaggcaaggatagctgctaggacaaaatattttctgatgttttaatagcttaacacaatggtaatttatttccagcttatgtaacagtgcttattgggcgctcagttgaggctggaaatagacatgtgagtgttttatggactaggccttgaagaagtgtacctcccttagatttatattccactggccaactctaagtctcacggctatgcctaattgtgaaggagactgggcaatgaatctagttgagtgccctgcaaactaaggcacagggatttttgtgaacagctggtagtctccattacagttctcacatctggacaacaagtaccttttgctcccttattctcacacagagaacatattcacttttcttccaaaggcagagtctcaaaatcccatttaattctttgattctgtgcaaattctagggtgtccttcatgcttagatatggttccttatggtcctgtgggtttcagaaaggcagcccattcatgccgtctacccccctgctgctctatataatagaaggtggagtagagacagaatatcagtagcaaaatctccattttcaaaagaaaagaatgagaaacatgttgctccatgacagtcaatgatagaatcacgctggggaggtaaagaaccttgtagtaagagagcattctttatccaggtctgaaatctgctctctggagggaagtgccctgtccattatcctccatggtcccatctgaactggatctagagaagggttactctccttaggggaattagcagctgtcagcccacttcctgctggtgcatggttgaggctccgtttttttgtttttagcagttataggcttttaaggtcagattaatctttatttaatttcttaataatcttataggattcagatgtatttgtttcccattaattcatgagtagtggccacaccagtctttcctagacttgaatctcaagttgctttatttttctaatttgttatcatcatgcctctctttcagcacagtagcagctactatgaggctatttggaataatgagcttggtttgaaaagtagcatcattaatctgatatatgctactgggctgaattatttgaattcataatgggctattgtctctcaaagacttttgcaggcttattttatgctttttggactccagaatcaattgactttttcaactctgtaatgtcctaactttcatttctgcttgcacactggacaatgctttttttcaggaacacatctctttcttgtaatatctttgtaaaagcagcgtggagcagccagcacacaatgacattttagctcttccctagagcttcagactcaataggtactagatctaccttatgagttatggcagagcacaattttaccaaaagtctttcagtgtaaagacacagatccacatgggtgtctctgattgacagttggctttgtctatttggtgagtaggatatccaagctcatttcatttagtggctgtattgtcccctaggaacttattataacttaacgtttatctcatggaaggttgaagtatggggaacccaattcatatgagaaatagcccaggagttacattctcttctgctcagtgaccattagtggaaatgtaaatatctcacctcaatgcagtgtgggttaggaaatgtggctttctgtctagtcaacctctttttcctatgctgtggaaagaggagaagtattctgagggacagctagttctatctgcagtgtatcttttttaaacagcatagaactattttttttttttaattctagtcttggtttctgcctttcaatgtgtgaatttaagttcatgtttcttttgatgactgataaatttgaaataatttctgtatttcattgtgttttcttcactaccaagtttttcttatttttaaacttttctgagcatatatatgtatattttttgagacagagtctcagtgtcacccaggctggaatgcagtggcttgatctcggctcactgcaaactctgcctcctgagttcaagcaatcctcccacctcagcctcccaagtagctgcattaaatacgtgtgccaccaggcccggccaatttttgtatttttagtagagatggaatttcaccatgttggccaggctggtcttgaactcctgacctcaagtggtctgcccgccttggcctcccacagtgtggggattataggcgtgagccattatgcctggccaccaggcatattttggaattgatagaatttctttttatctgagttactccatacatcattttttctccctgttgctcatttggaagctaatgattctttcctccctttcttcctttctgtctttctctgttttcctctctccctgttagtcttgaaagtcttacgtacatgtttaaattttttcttagagtatcaagttatttaatgtctatcattctaatcaacaaagccagaccatgcatgatttaatggatcagtgaaatccttccccccataaaacaaacttcacttgttagtgttgttttagttgcttcttaaattcattttcagtataatttatttggtcctgtagctactccaaatgacgcacaaaatttggctaaactgatgactctttttgtgtttatggtgttttgagtcctcaactttttctgtcttgaatttttttttttttttttttttttttttttttttttttttaaggcagagtttctgtctgtcgcccaggctggagtgcagtggcgcgatcttggctcactgcaagctccgcctcctcggttcatgccattctcctgcctcagcctcccgagtagctggaactacaggtgcccgccaccaggcctggctaattttttttgtattattagtagagatggggtttcaccgtgttagccaggatggtcttgatctcctgaccttgtggtccgtctgcctcggcctcccaaagtgctaagattacaggcacgagtctccgcacccggccctgtttttgcatttttagtagagacgggttttcaccaggttggccagcctggtctcaaactgttgaccttaggtgatctgcctacctcggcctcccaaagtgctgggataacaggcgtgagccactgcgcctgtctacattttctgtctttactggtattatggtgggaacccataaaccactgcgaggcagataccattttaagcaggaaaccttatttttttccgaagcacatttaaaaatattttccagtttatctattaaacatcctcctttgcttctggagatcctctgaaagatttatctctttcgattcatctgtaaagtaaaaataaccgtcgtcgtcatttctcaagcgtgacgatactgttacacgtttactgcatattctgcataccaagcacatatccgtcacacgcagtgtggccaacttccgagaggccggcattcagccaaacagcctgaagaaccaggagaaatgcctgagtttccaaatggcttatggtaagttgttgctgccactatgagtagcctacttgcatttctatttaatggcttttccccatatttgatggtatgttaaacagtcaatcattcattttctaaattaaagcctgtcctgaaaacgtgctcagtgctattgactgtgcatcaggtattagagacacagatatgaaactgtactttttaatttacgataaatgtcagtgtgaattattggttgttttgcttttctttcatagtctccgtaggcttcttgggaatggaaattggtataacctttttggaggaccctcagtaaaaagctatcaaaatttaaaatgtgggtatctcttgacctagtgagtctacttccaggaattcatcttaaagaaaaaaattatagtttcctaagtatttgtattgcagcattgctttcagtggccaacaaaacaaaacaaaacaaaattggaaacaacataaaataatattaccggagaaacaatgagtaacatgtataggatttttttttttttttttttgacggagtcttgctctgttgcccaggctcgagtgcagtggcatgatgttggctcactgcaactccgcatcctggtttcaagtggttcttctgcctcagccttccaattagcggggactaccagcgcatgtcaccatgcctggctaatttttgtatttttgtagagatggggtttcaccatcatggccaggctgttctcgaactcctgacctcaagtgatccacccgcttcagcctcccaaagtgctgggattacaggcatgagccaccacgcccagccgcttctcgtagatactacccaggaattttcacagtaacttcaaggaagagattgttctgtaatttctgtttttactgataaggaagctcacgcttagagaatgtaagtaaaaagttcacaaagctagtgaagtatgtgggggcggtttttaatgaatgattgaacattctttagtggaactacaatactatgtttttaggaaaagttgcacgatgtttttacatgggtagaaaatatactctggaaggatttgaaccaggctgtccctgttcttatcttggggcagtaggactttggggcacgttttcactttatatgttatcaacttctgtattatttgtaatacaatgaaccagttttatttttgcaactaacagtaagtataaatagctgatgaccacttggggtgaaccgaagtgcctatgacaaaccacacgcaggcatcctcgggactattgaggccagataatcctttgttatgggggctgttctgttcgttgtaagatattgagtagcatccctgacctctgccccctggatgccagttcactttccaacaagttgcaacaagcagaaatgtctgtagacattagcagatgtctgctagcagttagaatggcctctggttgagaatcagagcagactctgctcacactgggctatcagggtatagttctctccctcccaacagctggaactgagaccatctccctccatttgaggatcattccgatttcccaagtccaccgtgtggaatgtaaaatcctttgaaccagaacagacaaatcttgtttttgtctttttattgaatttaaccactattgacttgcgacttgcggcaatcaccagatcccagatctctgtgtttggagctacacgtctttctgaatcgaggaggtggggcactgatttttcttttatcactgacttccccgaagtgggaagttccagtgcttaacaagtttcattaagaacacagctattaaatattcagaatatacagactgttgctgttgagaatgtaattatgcagtaaattagctgatgtccagtacgttgccttttaagcagatctttgatgtatgcagtacttgcataagatatagggcatgtttattaagagtcttcaactgtgtataaaactagagcagtcaaaagtaatggtgtctgctgaaggattctttatcatatgaatttacctttagtcatctattatttatttcagctattttatatgccattataataaatattatgacagagaaagcttttacgcttcaacttattgtactcctctttacttgcctgcaatccttcaggaaaatgtaaccacgctttacctatagttaacgtaaatcatcacttacattagaatgaaaaattcactatgaaaaaaagctcttacttcaatagcaaggcataaatgcacaatcatgttgactgccaacctcctgtgtcattcactgtccttccttaaactgtttttaagctgcaaagtgaatatattgcatagagggaaataggaaggttttggattattttcgctctcttattagtttctggcaggataagcattttttatccggattgcaaaatattgccaattactgtctaagcatttttaatagttttgctttccatggcacgcaactcatatactaaattaaataagctgttatctggtgcaatttctccttgaatagacttagaattacctatagatattgacacggttattttataaattgagttccagcaacacaaggcaaaaattttggcctgtatgtaatgaaggaagagttgtcatcattttcttattagggatgtttgtgtattttggcagggggaggtaggaaggggacctgatggagggccctggagtgaaggttgatgctggatggttgatttgaaggttaggaatggcaaactcagcctctgttcttcaagaatccccctgcgtccccccgccctgccccctgcctaaaaaaaaggaaatccagggctttgctagggatcatttttggtgtggttctgtgttttaaaatgtggaatcatctccaaaagtgtttgtttattaaaagcaaagtgataaaatgtgtcaagtcagtgaagagactctcaaactcccctttcctgcgaatcctatcagaaagaacatttatgagggcatacttttcatctttaggcttggcaaagatgggtcaaactccccatcagactggcacatggtgctgtttcaggtttgactaagagagaaaagaatcactagtcaatgaaagcaactgtgtccccatgcattttccagtgaagatgcgatcacccattgccaccgttaccattacttaaataatattagaggaattagtgttatgaagtcccacatatgatattgatgaattattaaaccagttgagttagatttctattgtagttcagtgaataatgtcatgtcaatactgtgctcaacgccagtgtctcttgctgttgtaaatgtgacagctcctatttaaggttttagaacataaaatcaggactgagagtatgtaaagcggaagggtgagagacatcagcataatgcaattaaggcccattggattagaatttgcaggatgccattagcaataagctctgagtgtagattattgccgtgcttacattttctccttcagcggtaacacttctcttgtaaattctaactgggtaaaataaatatgatataaaacagacacaaataagaatatatagatgatgttaatttcttcagagcttcccggtgttacgtcttcaagaatatgacgacaggggaacagcccagtgtggcagtcatgtgacgacatgagcattggaaccagccacatctcagttggcaacacgtatctgtgtcttactagcttggccactgtcacgtcactcagcctctgttttctcatctgtaaaatggggaaaattatagatgcttcagaagatatttgctatcactattaaatgaaaacaagcatgtcatcagtgcttattatttttgttgcttttatgatcaataaatacatgcaaattagagctttttaaatgagattctggaaataagtttttccgtatgtgtaagggaggggtagatacactgccatccaatcagcatcaatgggtaccttgaagtgagatcacaaaatagctaattccctgtaaacagcaacccttctctctgcagttgcacatgagtagtcccccagttaaaagagaatttcctccagatacaatggaggccacgttcaacacagccatctagtgtacctgggcttcttccacctccagccactgtaccgacgtgttcctttatttcacccacatagtgatgatgcttccaacacagcataacaaagagctgctgctttgtgctgctagatttgccaaaagtctgtgccagggattcttttgttggaggtaagtggagaacgcaaggcccacatgcacaagatgggagtattttgaagcatgctccgtaagacccaacatgtgggcagcagaccaactacttgggttcactatggcgagaaatgggataggagagcgaactcactgataccctcccagctaattcctaggcaatctgcaattaacaatgattgtaaagtaataatttgtggttttgaaaactaggtttgatcactggaattattcctgtcctatgttctaaaggcctgttgccttgagatgttttttctcctcccattattggtaagcataatgtaggcatgagacgttgcctttgaagtgtcggaaggatggagaggagaaaagaaaacggagattgaatctggaaaacgcattcatctttagaggcagtgttaatgagtacatgaatttagtcctgtaaatgttttctcccttatttgggacatggtgtattgaaggtgtctgttaactgtgctaccaatgagtgcccctgtatccgagggaaactggagaagtgtacttgggctaccgggttaccaagagcaggacagcatgaggcagttacagatctgatggtttttcttggtctttgtctcagctgccatgagggcttctaaggggcaaggagggttgggggatgagaggacaggtacatagtgtggacataatggaatatggaatagcaattgaaatcttgcgttgggctgaatcatggctttgcagttattatcttgatgcggctgtgcatgagccttttgaacctcagcttctccatctgtgaaataggtggataatgactgcaccctgcgaagatgctatagggataaataactgctgtggggcaaggactgaaatggttgttgttttgagatggcttttatcattgggccagtgacgacccattcagccgtatcagtgaagagtgaagcactgcactctttaaggatagggctgaatggtttatcacccattcagcggtgaccaccacatcttatgcattgtgatgatcacgatgataaaacaatacataatcacaatataaggatctagagttatgaactactgatcaggtatcatgttctgctccaactgctttagatacattgcctgacttcccgatagggcaggtgctgttattactcccacttcacagaggagcaaactaaatatacaagaagcagtaacttgcccagccccaaaccaccccctgaaaaaagaaaacaagggagacccacagttattaatatgcattattattggaaaacaatggtcatcacattttagcagtggccttcaaaataatgataatagcatatattgagagcccattgtgtggcttgtaccttatattcactctatctaatcttcactctaaccatagaaggcaatactattatgctcattcataattaaggcaattgaagcccagatccttccagtagctttcctgaagtcaagttgccagtgcattggacatactgggctgtagttccagggcagcctggctctggtgtctttgctgcaatgacaatatctccccatttctctgtttaaataccacacactccccatatggtttctttggtttcaggcagtatcgcatcagagtcacatatggctaatttatagtcataaaatgatactagagatcactgttgcataacaacaagaaacccctttgattccacacttacagactcttgagtcactaacacaggtttcagtatatataaagaatagatgaagaagacttagtgtattaaggtggcagtgaactgtgctactgatgagtgccactatattcaagggaaatgggagacatgcacctgggttgtttgattatgaccttctggctgagccctggatgttgggagcaagtgggcttctgagctacatagaagttgcctgatgcttcacatgtgggatgccacctgtgtggctctgttttaaaatgatgggtaggtagagtctgtatacataatttaaaatacattaacatttctgttttgcctgagataagcttgtactggtgtgatcagaaggaagaatgaagatttggggaaggaaaattttgagagccattttacagcatttcaagattcagtgatctcagaacctcttttggttaaacaagcatgggaggatggatgattggatggatggatgaatggataggtaggtgggaagataaatggatagacatataggtaggaaggaatgagggatatatggaaggctagcagtttattttacggtggtgggatttttttcttttccttttttactcagacagtcttgttctgttgcccaggctggagtgcagtggcacgatcatgtctcacggcagcctcgactttccaggttcaagtgatcttcctgccgcagcctcctgtgtagcaggtgcatgctgctatgcccagccagttatattttagatgcttttttatatggcccatattcatatgtctttgtgacttttttttataatggatgtgagtgtgaagtaggagttggcctgaaacaagcccagagaggtagacagggaccaagtcatggactgagttagttgttgttgttcctcactttctgtttttatttctcctctttctggacacatagcacgttgcaccttctagaagctaggcacagccacatgactttgtcaaggaaatgtgagcagaagcaacaccagtcactattaagtggaagtctttgagatgccacgtgtaactcaccacattgccttccacatgccgtagaggctggcagtgttacagacaacagaggctccatccacctggtccctgagtggccacggtgagctgggcccactgacctacaatgagtgtgaagtgtgagcaagtcataattctgggttattctaattaatggagatttgggggttgttccttactgaagcacatcctgattgatgcagaggatcttgtgagccatgctaaggaattcagcccacgtcttactgaccactctgacgtactaaagggttggttttgccaatgaagagagcaggctctgactgaacgaggcctgaacttttcatgttctagatggcatgtgctaattctaacacttcttaatgaaagtcatggtttgcttggtggtgatggaacagttctatgtcttgaatgtggtgatggttatatgaatacatacacatgataaaatgtcttagaattatgcacaaaggtacagcaaagaaaataaacgcatctcaagttgtgttagttccttctcacactgctatataaacatacctgagactgtgtaatttataaagaaagcaggtttaattggctcattgttctgtgttcatgttctgcttctggataggccttaggaaacttccaatcatggcgaagaggaagcaggcaaatcttagcaggagcaggaggacgaatagggggaggtgatatgctcttgtaaacaagcagatcttaggcatactggatcacgagacagcactagggggatggcactaagctgtttttaaccagccccatgatccaatcacctcccaccaggccccacctccagtattggggattacaatttaatatgagatttgggtagggacacagagccaaaccacatcaggtgacatcccagtaatgactgtggtctagtaaattgtgttgtgttgatgttgattttcaggttttgccattgtattgtatgtatgtaagatgtatatatgggggaagctggatgatgggtatagggtgttctctgtaccagtttggccatgttttgtgaatctataattagtttcaaataaaagttaacaaccagaagatcatgagctaaaccaataaagtgaattatggtcagttgcagattcactgccagacctgggaggaaatctcaccttggcagatcgagtctcttgtcctcgcctaacaatcagcagttcacctctcgaaaaggggttccgtttgcaatctgtcagccactaccttcttatttagagcatgtcccactacaaacatttctataaagttactaagtttgttagacaattagaattgcaaacccccaacacacacataaacacatatgcacaccctaatttaaaggctgcattttccatcccctggacttactgtattgcctccagtttctctccatttctcaggattggtagcagaaatgggaaacctgatacctagggcaagagaattgcctgaataacagtgtgtggacttgaatcactatccccaggagcctagtaacccacagcttgtggattagtctgttgaactacttgatggcttgtgacccctttttcccttagagttatatgttctgattttcttcttattgatagtggcagctctgtgctttattttgaagggaagcaggggaaccaaaagaaaacttagcagttgtaagttacttacagagaagactgggctagttggctgtgctatcatttttgttgaaatactgctttggggtcgccatctgggaatgttcttcctgttttatgggggaaatacatacatgcgtttttataatatgtagcctgcatatcccttggggtttccactgggggcttggctgagcagagcaatttctttaccaccccctccacagcataatgaatggctgcctttcctcttgtgatacattcacatttctgtaagattctgcacgtggcagtgagtgtcatgctccaagtaaaacgaggcagggaccagaggacttaggatgaggatgaaaggtcactttgtttgctgactctgaatgtcaggtagttgtgtttatgaggcatcagcgtctctgtggggtattgaaacatttacactttgaaaatatttttaatcatcagataaatatcagttactcagacagcttatgagggttctgctcctcatctggaggtacacacctttcacggggtgtgacttcaccacatgccttcaatattcttggtggcagttgccctctttataggggggatgtggcgtcaccttatagcagaccctctagctctgttatttcctgaacgtaggaaactaacaacccacgtgtgggcgttttccccttttcctagatcaggttcatgtttctcctcctcgttccaaaatctgcacactttggcatctgccactgttacccaagaccaggaatttaaatctgtgtttgccagtttgcctccaccactgatgtgctgttggggtttggggacataatttcatcactttctaccacctttccttaaaactaggctttgtgccaggtgcggtggctcacgcctgtaatcctagcactttcggaggccggggtgggtggatcacaaggtcaagagattgagaccatcctggccaacatggtgaaaccccgtctgtactgaaaatacaaaaataagctgggtgtgttggcacgcacctgtagtcccagctagtcgggaggctgaggcaggagaatcgcttgagcccaggaagtggaggttgcagtgagccaagatggtgccactgcacttcagcctgggcgacagagtgagactccatctaaacacacacacacacacacacacacacaaaagcacagggctttgttagcaggcatgacttggattctttaggatccttccctcagtaatctggtctgatgtggccttcagggaggatctttggacatcattgccatccatctgtccactgtgctggactataacccacccagactaccatttattgccaagtggcatcgggacaagagttttacacaagaaacatcttctctgctagttaaattaattagataatttgtcttccagacaggatgttaggaacttatgaacatgtatcgttacaaacctatgagtagatgactaatattcatcttttacagataaggaaactgaggctcaacagtgttaaatggtccagaatgagtgtgttttctagctgtcactgcctgatgtttactgctcaaagcttaggacttggattagagcccaggacttggcagccaagataaaccagctgcaattacgctgaacgtctcagcccagctcctgtccatccctgaacaggacacttagggtagaggatgttctcagcagtgccatttgcatcccccttcatagccttacaggtatcatgttatcctccttaatcttacttaagcatcacagtctagactagaattcccaagtcaaccgtttgttttacgggactcttcttatttgaataggcaggtggccctgtgttcttgggttttttgtcctttcaaggagctaggtctaagaagtgatagtatttaatctcgcactccgaagcgcacccagatttaaaagttgggagtggcccatacacagaaggctagtgggaggggcaacccggagatttgtccttgcagaatgatgccatgaagaacatggccaatggaacaccattgcttcaaatcccgacctctccagttctcctggtttcttgctaggcgggaacttgggcttctttatcagtgactggggtcagttcttgtactcaatttcctatctctgtgatctcttgtaagatgctgcattgtcaaatggagaaaacattgtctttgagttgttaggagccttgagtgagatggtatgcaaatgtccagcccgtggcaggccctaagtacacagtagccattattaccattattattcctatcaccagcatgtattccacctgttgatagagttttctgggtttactaagccagggtgttgcctttgggatcgaggtccgtcagaatccattggtataaacgagtctttctgcttttgtactttctataaaggagttgtctttgatttttgatgcaggtttaatggagatatttcagaacctggatggcagcttttgaaattaagatattgtccattgcatctttccatgatcgaggcgttgtcgtgcattcccctccttacagcgttttaggatgcagattgagaggagataacgttagcccgaagcgcctttgcagcctcttttgcgcggctgaaacacagcacaacccacccccccgccccaccccccagcctgtaggtttagcagaatcccagcctcacatcctccccgaacttggcagtaaaagccctgttcttccattcattccgatgatttatattctctctgggcgtcttatattaaacaggggaattccgacatgttccataacacatttactgtaacttgataccatgaactacacttgctgttatttatcatttctttttattttctctcattgcagcataaagccaaggtagaagcaatgaccctggacctcgctctgctccgtagcgtgcagcattttgctgaagcattcaaggccaagaatgtgtgagtgttccagtggagggttatagatcataatttcttgctattgtaatatctttatcagatgaacacaattgggagaatgcaaggctgttgtgttgtcttggcgtccaaacaggaggctcatttatattggccctgttaaggtgaaccgtattttcttgactcacagtcaccttcattatgagatgtgtcatcaatctaataacagcttcccacataccaaaagagaagacactattaaagcactagtaaaagtggctaataaaagcttggcaatagtaagatgcatcctgattataagattttttgtagtgcatttcagaatggagtaagagtatatttaaattgcattcaggaacaagtaaactcagttatccagtatggcagggaggttgacaatccaagcacccaaaagacctctagtttctaaagccttcgatgatttgatgtggtacatggatgtggttccaaaaaacatggactcacattccttttatttattttttttcatccttttcagtctttcaaaattccagttggagaaagccttagttagggcctagcatattttgatcctatcatatgctagcatccctttctaacagagaaggttgtaggagaaagggagagaagcggaagggggtggggagacagagagacagacaggaggcctcaaaccctgaaacactgagctaaggaaagtgatcatggcaagctacactaattacaatactttgtttccaagtgtttatttttactcatatttagggcaggcaatcctggtttctcgttgaacatagaggtttgaatttcattaataaataacttcatttattttttttcagtgacttgattcaaacatgaggattaagttaataatagcacaggttgtgcgaaggataagataattacacaagaggcaccagaaccactgaatgtggagagctctcataaatgacaagctgcctttgggttaggctctgttgggaacattagttctgcagtgttgcaagcagatgaaggatgtgagggaagggatcttaaaccagatattcaaatggccctgtggggagctgacaccacactgctgtctagtgtccaattctccttgcatggctgtgtcacccaggttggaacgtagtgcacaatctcgccttaatgcaacgtcccactgtgggcccaagtgattttcctgtcccagcctcctgagtagctgggactacagatgcctgccaccatggcctgctaatttttgtatttttagtagacatagggtttcaccatattggtcagactggtctcaaactcctggcctcaggtgatccacccgcctcagcctctgaaaatgctgggattacacacatgaaccactgcgcccagccgctctactttattagatttaaaaagtttgctctcagctgggtgcagtggcttatgcctgtaatcccagcagtttgggaggccaaggcggggagggtcatgaggtcaagagatcaagaccatcctggccaacattgtgaaaccccatctctactaaagatacaaaaaattagctgggtgtagtggtgcacacctctagtcctagctacttgggaggctgaggcaggaaaatcgcttgaacctgggaggcagaggttgcagtgagccaagatggcaccactgcactccagcctggcgacagattgagactccgtctcaaaaaaaaaaaaaaaaaaaaaaaaaaaaaaaagtttgtactcagcctggcgtggtggctcacgcctgtaatcccagcactttgtgaggccgaggtgggcggatcacctgaagtcaggagttcgagaccagcctgggcaacaaggtaaaaccccgtctctactaaaaatgcaaaattaactgggcggggaggcacatgcctgtaatcccagctacttgggaggctgaggcaggagaatggcttgaacccgggaggtggaggttgcagtgagctgagactgaaccagtgcactccagcccgggtgacaagagcaaaactctgtctcaaaaaaaaaaaaaaaaattgactcaggctcttgctggagtatgtcagtgtcccaagtcactgaggtctacattagagtcagtcttagtgagagttgcaacatcgcctaagcgcagaccccaagctggcttgtaggaacagtgagataacatcccccagccagccagatctgagagagccctcctgtgtgtgtcctttgcagcgcttggctgttagtagcttccaccctttgccagaactatcaagaggcacctcaacaggctgcaacactagcattcaagacatttgttcgctgatttgcttcgtcattcatttatccacccgttccttcacttcacacacatttcaggagcacctctaaagccccagacattcttctgggctctgagaagagagtggtggccctggaagccacagtaaccgcacacaagctgtcacctcagttgtcagctattatggatggctgactcctcaaactcatctgtctgtggttgtttgggagggaatgataatgacaagaacagcagcggagtcagcagctcatttactgagggcttatgggccatacgtggaaaatattttgcatgtatgttttgattcaattctcaaagcagtccttgggagtagatgctattaatatctctactatacagataaggaaagtgaggctagagaggatatataatttatccaaggcatgtggaatgtgggtagaggggccgatttagcctcttcacggctccaacttgaccaccgtactatactgtgtttcattttagtttattttttatttattttttgagacagggtctcgctgtgttgcccaggctgaagtgcagtggtgcaatctctgttcattgcaacctctggccttgggttcaagcgattctcatgcctcatcctccagagtagctgggattacaggtgcaggttaccacacacagctaatttttgtattttctgtagagatgaggtttcaccatgttggccaggctagtcaactcctgacctcaagtgatctctccaccttggcctcccaaactgctggaattacaggcgtgagccaccctgcccgaccctttcattttaaatgtgatagaaacagactcagagaatgtgagtgactttcgcagggtcacttagcaggttggtgacgggcatggggtttcactccagtctgcctcttgttcttttcctcatagcatgtgagatctcacaattcactgccgctgaataactttgtccagttcctctgtcagaatgtgttggaagtgagcagctttgctgaagagagccaactgttacataataggatcatcttccacgtcttaactggaccattagtttttaaccattaagtagttgggaaatcatcaagttcaagtgccttttgtaatcaccaagctcaaaaccttggaggaaactctcacccattttgccctaatcccagattttagcacaggactttggaattttagaaagtacttctaggttgagaaacaagggtgattttccatatagagacctctgtagcacaaccctctttgtatgtgtcccatgagagtacaggattttacatggcttagagaaatactgtggtggtgaaaatatgcataaaaaagcgagagattttacttttgaaatgctgccaaagtgaaatctctcttggataggcagatgacagtttagtacttgcaggtctttcgattctgacaactgtcagaagtgaatttaagtgctggtgactaggctgccagagaaacacatgtaactctattcttatcaccccccatcttcagacattaaaattttcttgtgtgtaaaacataatgacaaatgaaagaaaggctgccagttcagaaccaatctcttttcacgctgttgcattgaggagaggaaaaaatcccttaaatttgaattccatgtggatgctcttatttaatatgccgtttcaaagcctgtatgtgatcaagccagagtattatcaggctctgagttcctgtgtgtattcccttggtccatgctccatctcaagtgtttctccacactgggataggcagcatattgtgtagtcttagagcagaaaaggtagaaacagattcttagtacaaacactggtgagaaaagcagcatattgtactgtggaaccacccgccgtctgccttctgtgggagatggggatcagcctcttcctggatctcttctttttattcgggtgctgggaggtgaggctgcaaaggaggctgttgtagagggagccctcctaaccatgattatgtaaacaatagctgctaggcaacttgttgtttgttttatgcaaggcagtgtgctaagcacttacatacatgtattctgtctgtagtttgttataagagtcctgcacacttaaccatgattatccctactttgcaaattacaaggttgcagtgcagagagcctaagacactttctcaacttgagcaagtaggagatccagaatttgaacccaaatctctctgaatccaaaacgactttttgttactttgcacacttcagtcataggaatttcagtgtggatttctgtattggttatgtattgccgagtaagaaatgactctggccaggcacggtggctcacacatgtaatcccagcacctggggaggccgcagtgggtggattgcttgaggccaggagtttgagaacagcctggccaacatggcaaaaccccgtctgtactaaaaatacaaaaattagccgggcatggtgatgcatacctgaagtcccagctactcaggaggctgaggcatgagaattgcttgagctctggggtgggcagaggttgcagtgagccgagatcatgcctgggggacagtgagactctgtctcaaacaaattactccaaaatttagtggctaaaaaacaacgtaaaacaagaaacatttcttttgtgcctcctcttttcctccctccctctttctcatagttaatttgtttgaatcaggattcaaataaggtcgatgcatttttaatctataggttttgtctcctttttttttttttccttaaaaaaatttcttttaatgcaacagatttaagggaccagggtgttctctagagcaggggtccatgacctctaggccacaaaccaatagcggagccgtggcctgttataaattgggtggcatggcagggagtgagtggtgggcaagcataggaagctgcgtctgtgcttagagccgctctctgtcactctcattagtgcctcaggtcctccccctgtcagatcagcaacagcattagtctcataggaccgtgatccctattgtgagccacacatgcaagggatctaggctgcatgctccttacgaaaatctaatgcctgatgatctgtcactgcctcccatcaccttcaagatgggattgtctagttctaggaaaacaagctcagggctcccaccgattgtacattatggtgagttggataactatttcattatatattacaacgtaataataatagaaataaagtgcacaataaatgtcatctgcttgaatcgtcccaaagccacccccactcctttgagtctatggaaaaattgtcttccagaaaaccacttgctggtgccaaaaaaatttggaaacctctgctctagagatttctgcagtctgtactttggtgattgcatctctgtggtgtcttttaacatactcttctgtctcctgagtttcctgtgaaagggtagataactcaagagactcaatcaacttcgtgtttaatgttttcgtaagaatacttcagaggcagtggtgtaatcgtccaagagtacacacaggcctgattgccaaagccagttttcttcaggcccagcacgtcctgacctcctcactcctctgcccactctctgtttactcactcccattttcattcattgattctgttattctccactaagttttctgggtggtcagcccaggaagcctcagcctgcttccagatagttctcctcagagttagcggtagcagcggtcgtcggccagtgtgtctcgggtcaaattattttgggcattactggaaagttccaaaccaaagcctgtggtaagttccacccaaactggcttgtgagggatatttttgtttaaactgcattcctggagaggagccagacttcctactgcctggcagcagtggtgtccataggagtatgaagagctgggaccctttctaatcactcagaccaaatattggggttttctgaaatggactgagaaataacagtatgtttttatgaggctttgcacattttccttcctagcagtagctgcttagtctactgaaaagtgcatattttgaacagggcctagaagagttaacagctcctagagagaggtgctctgtaatactttttcttcttcaaaaaatggtttatggctgggcgcaatggttcatgcctataatcccagcgcttttgggaggccaaggtgagaggattgcttaagcccagaaacgtgagaccagcctgggcaacgtagtgagacgctgtctctatattacaaaattttttaaaaaacggtttgtaggtccttaagtccctgataaaatagagaactgaattgcaatcctggaacttaaaaagttggtgacgacacctgagatatttattacttagattgcagttactggtcagcttgtataatactgaccaagggttttgattcttcctggaattgataggaaattcatattaaaataattacccaagtccaaacatttttagaactgcatttttgatcatggatttttatgtctcttctgaactttctgtcaccggtataatttaaagaaattatacttaagctttgtctcacttagaagataatatagaacagtggtgtttttttaattaaaaaaaaggttaaaataacggttttgtatccttgctttacttcttaaacatatgggaggaaaaaaaatctttaacaagtttatttattttcattttctgctaaattactttcagaacttgaatctactaatcccagatataatattcttggattcatattccaaattttgctgtctcaaatccatctagggaagtgggtgggctataaattataaataaattccaaattttgtgggatgaattaccctgaagaccaacgtgtaaattacatattaatctttctttttctccctagctcggttttaagaataatgttttagccaacatatctgcattactcttggctcaatatgagaaatccatttttggtttgcctaacagaagatcatcttgctttgcttctctacacagtatgaaaacccaaagaaaagaaaaacagaggcagttttttgctctaatgaatgctctaaatctagctcttaattatgattttttaaggaaaattttgaaaagtctacaagttaaatttttttttctatcccatacattttccatcctaaggcattgaaaaagcacactgtgaaatacttagtgtatctagaaacatcagggaagaatgcttccctcctaagcaaaattttgccttctgaaactttttcagcattcagtctttttatataatacttagaaaaatatttctgaaatagatcatacactctcttcccaaaaacatcaaagtatgaccgtaaagggcagaggtaggtaaacttcttgtaaggggccagagagtgaatatttgagaattttcagactattaagatctctgttgcaactgcttgcttttgccgtggtagcctgaaagcagccatagatagtatggaaatggatgatcatggcagtgttgcaataaaactttacaaaacagacaatgggccagattggccaggggccatagtatgctacccctgggcaacaacctgtatgccctggagtagtgtaaagaacgtgggtgttgggggtcaactgacgcttccagctctaccacttactggctgtgtggctttgggcaaactactgaaaatctctcagcgtcactttccaagtgtgtgtaatgtgtattttcacagtgctttgcaggttgttgattattgaaaatagccataatgcatgaaattaccagacacatctcactttatggagcctggggctattggtaatatgcatttctttctcatcttgatcgtaaaatgatcttagaaaggtttctgagaatatatagagtttaagacagcaataagacaactaattaattaaacaggaaaaggggatgttgtgctcagagaggaagtgtgggtctcataagggctttcacaatcgtttgagaggacacgtgtgatgtctcatgcctgttatcccagcactttgggaggccaaggcaggcaggttgcttgagttccggagtttgagaccagcctcggtaatttggcaaaaccttgtctctacaaaaattacagaaattagttgggtgtggtggtgcacacctgtagtcccagctgcttgggaggctgacgagtaaggatcacttgagccagcatggtggaggctgccatgatcatgctactgcactccagcctgggcaacagagccagaacctgtcttgtaaagaaaaggaaaaagagagagaagggcagaaagaaagaagggaaggaagaaaggaaaattgggcccaggaatgatctttacaatgcctgacaaccaagagaagaagggaaatgagcttcacattgcctgcaagctctagggtgacaagagccaagagaaattattgttactgtagtgatgttccactgaggatcataaagtactttattactctactgagtatggttttttgttttgttttttctttttctttttctttttcttttttgctattcttttgttattcttgatttatgctgatggaaagccatggacccaaggatgcttcacagttttctttcggagtaaatgcttagattccattttctttgacatgactatgtctgttcctcttgattttaggcatctttttcagatgagttgccataaaagcagcctgctctggataagtgaggtacagcaggacacactgcaaatactaggaatccttaagtacagtggaaccccagagcactctacctgctttctttctcacctccttaaaaactttttttgccctcacctcatcatttattcagcagtcacaacagtgccaagaacttggctagagattggaaataaagcttatgccttctctcatatctcctgtaccttatttctttcttacagtagttgtgatgcttagcagttttttgataactttttatgatgccaaccttcaaaaacctgcccctggtggagagaataattattacatcaattaggggtcacttagcatgacatttgtcggaaaaaaaaaagttagtgagcctttttgccatattaaaagtcatcactgccaagacataaatgaaaatgtgttcgaattaaccacaccaatgttcacaaaataaacatttttgatttcccaacagaatcctaggtttaactatcactatcatctttcatgaaatcaaagtcatatatgtaaattgaacacaactttcccttccatagagagtaaaaaccacgctttggagggtagatacaattaccccagggttgtcttttcccactcctcacaatcccaccagtgcacatgcaaggtgatgtccttcctttagctatagcaaataatgttaattattgttggtgttaaataatgattatgtaaagcactagactagacattcgtcggcaaagtttttctgcaaagaatcagatagtaaatatttttgctctcatcagccagacagtctctgcggcaaccattcaagcattgttgaatacattgttgagtgttacatgagactattgtaatataaaagtagcctgggacaacacataaataactgggtgtggctgtgtcctaataaaactttatttacaaagaacaggaagtggcttggatttggtatctggcctggcagctgtggtttactactccttggacggtggcccagagaccctttaaatgaaattcattttactagcaccctttttcatcatgagaaatatattctgtttttcttagaaaatgggttatgttaggtctggtcaaggtaaataagtgttgagagtcgatgttgtgtgcatagttaatttcaattctttgaagaaactcccccatgatatttcacggctgagagaagaggaaagagtttaagtggaacagtgtgctttgctgagctttggaaatattaccatatagggaagcaggtcaataagacaactaagtgctgtttcaataacgaagatactgaagcgctaattggagtatggaaccatataatgatgataataattgctaatatttatcagctatttatcatgtgtcatgtacagctaagcacttacataccatcccattttatccttataatgactctaagagtgggttaaaaaatggcagaagaatggcagtgtttaatggttcagcctggtgcaatgattaaccacattttacagactaagaaattaagaacctcaaccaagttcatgctagctggtacgcagtaaggctagaacttcgtccaaaatctcttcttctgttgagctcagcttgcatagtagcttggagaatcagaaagatctgtctcatttgggaaatataccatgtaaaaaacattgtttctaaaggagatttgtcccatgagtaaaatagatgatggacagccactgcctagtgggacaattagaaaggtcagttcaaggttggaggagatgcttctttcagccaattttcctttttctcaggatcacctcaggtgatccgcccacctcaacctcccaaactgctgggattataggcgtgagccaccgctcctggcctttcagccaattttctatcaccaaagggaaatcgttttgctggaatatgtgtaaaggaggttaaagtcagaagagattctcgtccgctcagttaaggtactcagactattttccaaccaatcaagagggtgctgcttcatggagttcgtttaagctgaagcggcagctgttgactgtcatttgcatcatctttatacatttactgtgaatgtcactgtccatttccactttctttctacttgtcttcaaattgatgcttatcaagtagacagaagaagaccaaggggtcgttttgctatttatacctccaaattgatggcgtgatcactctcaagtgcaaacccagccctgacactgtcctgtttggcaatgtcctgctatctgacctgcaaatagctacacttcctgctgtggcccacccaggcctctgggatctgatcccttctcccatgtcacctgtggccatgtcttccccaacccaggcttctctgctccgctgcttatgttctggatcctgactctgagcctttgcttgtgtggctcctctcccacttgtccatcatcatgtcagttatgtaagcatagattccaaagtgacaatgagggtagttaggatggcaagaggagaaaaaccaagctggattcatggattgcttgtgtcacgtcctctacagagcctcccttctacctgctcttacccgggcaccacagttgatgagttattttttggaccatcagcaacacacccaatcattgtacatggaatacttcggggatgcttttttctatattgattttacttcattaaactgagctccagaggagcagaaactttggctaatacatcttggtcttagcttgtaatatctgtgctacaacttattaagatggtgacgctggcaaattccttaatctttctaattcttaatttcatcagcaaagatgggaaaggatactaacaccactctgggttgttgagaggattcaataactgaatatttataaagcgtagtacctgatacttaataaaaaagtgaattttaacctgtgtcatcattgtcatcgtctttatcatcctttgcaattattacatttactgccttctagtacaaggaaggggatgggtggctggctggctaggtggatagaaggatggaagaggtaagtacaaggaaggggatgagtggctggctggctagatggatagaaagatggaacaggtaagtataaggaaggggataggtggctggctggctagatggatggaaggggtggaaggggatgcaagaggtaagtacaaggaaggggatgggtggctggctggctagatggatagaaggttggaagacaggaaggatggaacggaagaagagggaagaacaaaaatggaaacacatagtactgttaggtgaactgaacttctaaggtgccgattctcagtgatagaatcttgagttgatacctccttgggtggcatggagcctatacctttgtagatcttgggaaacaacttctaaagtaatcatagttgtatgtaatcgtagttacaacaatagttattttaggcacataacccaaaggttttcttacaaggaatctatgaaccttaagagtgagggcttctgttaagagtaagggcttccctggagtggacatggatcatgggactgagccagcttggcattgttgggttgaacagggagcgacacctctcagcccagtctatcaagcctgctctttgacctgcagtgagaccacccacgcagacatcaatgcagcaaatccccggcgtcagggtttcaacatttggttactctcagagaactctcgatttatataagacttggaaaaagggtttgagtttctgtggtttacaattatatttcccaacttggcccatgaatccagcttggtttttctcctcttagcatcctaaccaccctcattgtcactttggaatctacacttacataattgacatgttgagaagctgtgctaaaaccacactgaaatcacattttaataacatgggaaccatcttttcccagtaaattgttgagaagctaattcttgtcagcctaaaaacttgaatatacatttgaataaatcagcggtgctacaccgtggcagcctgctgaaaatccccaaggaagattatatttttagttgagctacttgtcactgcactgtgtttttaatattgtgagtcctttcttgtcttcatttttgaagaatctattgcataccttgtcattcagaaaaacataaacgggacctctcaattagcggtaaagttcgtcagtttaacttttaagcttaaactcctgttatagttcggtcacttactcgtcatcaaaaagatatttgagctgatattatgcaataatttataaccaaaaacaggaggaaaaggtctctgtttgtctcagaagtacaagttatgcataaggtgacaaattacacagctttgggaaatgggtcttaatggaatgcaccaggctaatagaaaagcagtgcctcgatttcccacctcagatctgaaaactcctgagagactgacagggcggttccccagcttggctgtgtgaggaatcagctgggaatcgaacactgcagtctggctgtcacccccaggattctaatgtaattgttctgcattgtggatcgatggatggatggatgaatggctggacagaaggaagacttggaaaaaatctttgagtttctgtggtttacaattttatttcccaacttggcccatgaatccagcttggtttttctcctcttaccatcctaaggagggagggagggaggaaaagggggaaggaagcaggtagaaagggaacagggaagggaggactggaggaaggaaagcagggatcattctggagtgtacactgggcatttgattttaaagcaaatccaagagatcattaaatttgtatcaatgaatacactgttacccctcaatcaacactacaattcatatatcagaatagcactttgttacttgtttctgagatagggctggctctgtcacccagactggtgtgcagtggcacgatcacagctcactatggcctcagccaccagggttcaagtgatccttccactcagcctcctgagtagttgggactacatgcctgcaccatcatgcctggctaatttttatttttgtagagacgaggtctccttgtgttgtccaggctggtctcaaacttctggaatcaagtgatcctcctgcccctgcctcccaaaatactgggattacaggcatgagccatgtccagctgccttgtttttttctttgaagagaatgatagaccttccataggaaaaatgttaaatatgtgtgtgcagaaataaagatttcaaatatttttgcaagatattttttctaataccacttttttctacattttccataatttagtgaagatagtaaattaacaaagtggaaaagactgaatattttaagaaaagccaagtttaaaaattttgaacctaatatttcttaaagtagctaaaattcagatattgagaataaattcaacttgacatggcaaaattctaataggctgaaataatgttttggtctagaactatgtagctttgtgtagcccatcaattgtctaaaaaaagagtaacctattttgatgaaactcgctgtatcttgtaacctgtatcctgtcttggtattgtgggagtatatatgatttaggggaaagagtctggagagaccttaagtctgctttagggaaagggtgaggaaccccactgaaggctacttaacgcattttgagaatgtcagtaaagatttctcagagcccagggattttttttttaattgagacataatttacatacaatacaattccttttttcttttttttgagacggagtcttgctctgtcgcccaggctggagtgtgatggtgtgatcttggctcactgcaacctctgcctcctgggttcaagtgattctcctgcctcagcctactgagtagctgggattacaggtgtgcgccaccacgcttggctaatttttgtatttttagtagacacggggtttcaccatgttggttaagctggtctcaaactcctgacctctagatccgcctgcctctgtaatcccaaagtgctgggattacaggcgtgagcccctatgcccagccaaaattcattattttaagctgtacaattgagtgatttttattacgttcacaaagttacgttaccattaccacttttgaattgcagaacaatttcatcactccaaaaagaaatctcataacaattagcagttattttccatcgctacttcctccagtcccaaggcaatcagcagtctgctttctatctctacctgtttgcctattctggacatttcatatgagtggagttagataatacatggccttttgtgactggctttcacttagcataatgttctagaggttcatttatgttattgcaaaaatcagtacttcatttctttttatggctgaaaaaaattccattatgtagatgtgccatatttgtttatctggttgtcagtcggatatttctgttgttcctactttttggctactgtaaaagatgctgctatgaacattattgtgattattataccttatttgtaaacatcatgggtggggggttgcagtaaacatgttggaaagtagggttggaggtccgtagaaattgggggcttcagcacttcccccaagctcaacaccaaccccctttctgagcccctcttgaaggagagttccctgggacgtgcctggtattggtacaatcagtcaggaagcatttttcctggggagaaacttacaagtccacgatcaaagccaacaagagacaaggtgttacatgactcattttcggtttaagaagtgacaggctgattctaagttgggttcaattattttgttaaagcgttttgcttatttgacttctcctgacctcggaaataattctaaccaatcagtgctggctcccattggccctggggtctggttgctttacagctggtgacagggggaccactccactaccacatgtgaattaatcctcaactccagagccaagtgccattctccagcaaggttgtatttcttcattagctattcccagggcccagaaagtcccagaggatgtcagagtacattaatttttatcataacatggaatctttcaggtctgaatggcagcacacggctgtcaggggcttctgaactctattacagctccatatatctctaggcaaaacagaggaaagagtcgtcattggcaagggagatgtacaaaatgcatgagatgttttattttttgagtgacttgaccacgtgcttaagcacattccccaaacaatttttttcttattgtttgtaagttgtaagttgtaaattcacctctgccaccacctattaaagcccactccctgcattaaaactgtataaagtgtatttaaataaactctctttgcatgatgtgaatgaaatcgtcatctggtacttaaaactattctataaagttattaaaaaattaatgttcccttcccatgatttttctgcagaatttatgcatccatgatactgcagaagttcataaataatggcttgtattgctgctttagtattgctttatgcctacgaaatataatgttaatttgtagcaatgctaatgtgttttcaggaaggctctttgtttattgcctttattttccccacttaccaagtgggtaaaatgctttgagggttgcattttatgtattcaggaggcccaggtattattttaatagaagcactattgacaaataccagtcatcccccctgtgccaggccctggatgaggcactgcttcgcatgggggctccccagattgtcccacaaggaaagcatagtcaaagacaaagttttcagttgtaagagtaaatgtgttctgcctaggcattgtcaagtaatttactgccagctctagcccttcactcaagtttcctggatacttttgacttcttagccatggatgtgtttgaaggctgcatggaccttcacttacttgcactgcaggtcagcctaattgcatgagctctgtggaccacagagcagggttttccaaagttcaccaagacaaatattgtattatcttaacatatattcattttttaaaactgaaaatcagaagagcaactccacctagcagaagtcttttgcaaagggcgaggcgaggctaaaaagtatagaagagttcgtttccagtgcaattttataaacacagatggtccttaaattaagcaaatggtacctaaatgactgtgttgtggataatggtaacagagggagggactcgggggttttttaaaaagtactgattgtatgcagtgttttaaacagataactgtgatcttagtgtgatgaaagatgctgggagatttcaccagtggtatcttattatttttcggggattttgtaattcaacaaaattctgttgtatgccaagcataaccctaggtgtgagagcacaaggtgacttcagataccacctctatccttcaggggtttggggcccattattatgacttaatccattttgggcgtgagaagctgagggtcacagaaagaaccaattccctctttaaataatgccaccccaaccctcctcatctgccaggtctttcccttcttctatttgtatgaataatagtcactttctcttgtggagttcgctaaattctactttggcctatcaaatttctttcatatcacaactaaatttcttaaggacgggactatggttcatttgtcagacgaacaaatgggaatttgccaagagacacttgggttaatttacgtcttttccatccaagggcactatgttgaagtgaggctagtaggtcatgagtgtggttgaagttactttttcttactttcccgaccagcccccatccttactgcacttaaagttgattgtccattttattaaatgtccccaggaagccagaacacagggcagtaaagtgctgaatgcaaagggcaggagaaaaatggaaacaaccagaactgtaacaccaaggaatgagacctgcatgtcagatatcatgcccattgcactaagtgccattggggcacaattatcaaatggatgcattttccctagaaaaccatcttggagagcatgtggatgtacttctattttacatttccccctatttacaatcaatgagattgagattttgttgctgggactgctgatgatgggatgggaaaatataatcaaggtaatggacatgaggcaaaaatttaaggaaatgacaaaaacaagagtatttccattttcagttaagtgtatgtactgatgttctggaattcactataagaagttgcaaatggtgcatgaaatgaaaaattcctggtggtctccaggggacacagccggtgctgtgctccactctgggtaactgttttggattattttctctattccaactgaaataaaaaaaaattaattaaatgtggctaggttatcttgacagcagaatccattcccagttaattattattttaatacttgatggtgtctgtcaaattgtcgacatgtgacggtcctttcaaatttaaaggaatagctgatggtcactggccacccaagctgatactgattttatatgttgatgtttctcattttatttgctctttccttgaatatttattcaggacattctctaccagacatattgagtaagggcaacagaaacaatacataagtatcttataaatgtggaaaacaatgtatatgtgttttttatctctcaatgattggtgggtaccatatccccaaagtagaatgagcatttgagaaaacaggaaatatcctcttttaggcaccatctctgtcaaggctgatgctgggctttttatatattttctctaattcttgtggctgtcaaacaaggtgggcattatcattccctttataggggacacagctgtggctcagaggggtttattcactttcctgagggccacacacataatgagaggcagacacaggtgacgaagtgagttttccctgtcacgccatcttatctgtcacatacctctctgacatgctaaaattgcactaaacaaaagaattctcttatgcacatatcatgcaaaagatattctttaactggggatcatgtttctcattccatcaatagaatgactaacattttctgagggtgtctcacgtgaaagtaaatcgctcatgtttgttctttttaaaagatgcccttcgtattgtgtatcttgcagtcttgctttctcaaacttaagccaactatatcgtcatttttgcaaaatcactgcgtcagtttactattatttaatgtttattgctaccaattttaagaaatcctttataggactatttgtgaaattgattttgtgaggatgatgatataatttccattacattacagcatataaatataaatatatatatatatatatatatatatatatatatatatatatatatatatattttattatttttttttgagacggagtcttgctctgtcaccaggctggagtgcagtggtgcaatctcggctcactgtaacctccgccgcccgggttcaagcgattcccctgccttagcctcctgagtagctgggactacaggcatgtgctaccacacccagctaattttttgtattttagtagagatggtttcaccatgttggcgaggatggtctcagtctcctgacctcgtgatccgcctgccttggccttccaaagtgctgggatatacattttttttttttttttgagagatggagtgtcactctgttgccgaggctggagtgtagtggcgcaatctcggctcactgcaacctcctcctccggggttcaagcgattctcctgcctcagcctccccagtagctgggattacagtcgtgtgccaccacgcctggttagtttttgtatttttagtagagatgggtttcactgtgttggctaaggtggtctcaaactcatgacctcaagtgatccgcccgcttcagcctcccaaagtgctgggattacaggcgtcagccactgtgcccggccggatagaaataatttttataaactccttggatgctacctaaaatcatcttgttttgctagtggcacatgctgcattttgggcagctgtggccttggtggattgctgaagtagatttgaccttacctggactgaggcagctgttgaagggaattgctgtgttcagtgtatactgccatccatgatttcatgaaaccagctctagctatttaagcaggggtcaaacttagaattctacattatttttttcccttttctgggaggaaagacagttgaacaccagcaaagactaagaagtttcttagaagactgtgggtccttgggccctttctattgaatttcagagtatttccaaatactatgaagtcttgcagcttagttgagaaatgccccagatggtgtgacattctgcttccaggagggattggaaagtatttccttttacataacattccactcagctcattcctttgctgtgtctgaaattgaatcccccaaagccacaattatcttaacattcagaagagtgtttatttaatctgcaaaatcttgcctcacttttggggagcatgttaacaatttcacttacaaatcttctgtgtaactcaaccccatggtggtgtctactgctgctcctagactctttaaagcacctttctcatctcaggtttgaaatgatatgtctcattcttgggttccttgagtcgtaatgggtttgtcttgtctccacagcataaatgactctttcttgatcaactagaaccacatcaacttcttccctccagcttcagtgatatattgtgaaacatggctattcaacgtcctgtagaccaaatgccataagaaaaatagcattgattcaaacgtatccatccagatacctaaaaaagttttacttcttaccacatcttgagtctgggcaaacacgcacttcctatggacattgattactgtctactgtagagataacatttgcacatacagattatggcacatggtagaaagtgttaagtaatgtaggaatggacatatcccaagcaaaattggaagccaagtcccctgtccctgctcaagttggtatgactggtgtatggtgccttaatgggtacttaaagtccaggtgagagtggcaggaggcagccaaatgcctaggtagataggagccggtccctgttgaaaccccacttccaagttgaagacagtttaaagactgaaagccaagctacaagttaaatcctcggaccagattgagaacttgtcttcttacttggtgcactcttctgattgatccccacctttcacctattttacatattcctgcccttccctaactggtttcctatgctgtcatgcccacctttgagtgttgccttcactttaaccttctgtgcatgctcacaaagtaattagcatgtaccctccattctgagttaatataaggccccagacccagccacatggggcaactttactgccttcaggtaggggaaccacccccaccacattccctctccactgagagttttccttttagttaataaattcggctccactcactctccattgtctgcatgcctaattcttcctggttgtgagacaagcagttggacctagctgagctaaggagcagaaagactgtatcacagggaacttgtgtaacagcttgatctcctgtcctacgtagctatctattggtaagaagttgaaggaacttgtgtcattccgttgtgcctgtcgtcttgaccttgtaaaaggtcttgggtaagcatgcaagaagttttgaagagggagatacagctaatttgcagataaagagcaagggaagaattcctggagaaaggaagagtttcctgagtcacctttgggaggtaggaagggtttgacatgtaggctgggcatctgggaacgagtgagggattctgtgagccccatctcagtggaccactcaaggaaggtgggtaagccctgggtataagtgtgtaagcagggaacagaaagtactgtgatttaaaatatgttaatttttctactgtacagatgagagccagcttggagatgggctgtagctcaagcatcttacctacctctgatttcttaatgccacgttataaggctgctgcttatagctcttgaagtcactccaaaaacagatgagtgagaccctgttgctaaagtcccactgggtgtagattattcacagatgtatacacagtggctcactccaggtaggatgtgatcagtgcttttagaaatacagaaagtcctattggtttaaaaaaaatttttttttgtaatgaattgagttttaaagctagcactgtacaataaaagggtgaatttcactatgaattatgacaaacacagtcatagagctgccatcatcactgtcaagatacagaacagtgccatcaccccccaaatgtcctctgtgccttactgtagtcatacctgctcctgacacctagcccctgggaaccattgatcttttttctgtccctagttgtttgtcttctctgcaatgttacataaacagaaatattctgggtgtcgcttttggagtttggattccttcccatagcataatgcatgcagtatttgtctgtttctgctaaattacccccaagacctagcgacttaaaacagcaaacatacactatctcactctgttagttttccattgctgttgtaataaattaccacaaacttatgtgcttaaaacccaaagctattatctgacagctctgtaggttaaagatttgtcatggttctcattgggctaaaattaaggtgtcggtatggctctgctgctttctagagactccagggagaatatttttccttgccttttccagcttctaaaggtcacccacaacatcttcaaaaccagcactgttgcatctctgaccttagccctgtagtcccatttccctctagccacaatcgggaaaggatctcaggactgttgtgatgacactgtgcttacctagattatctagcatgagctccctgtctcaaggtgatagagtttgcatgtttttctcctgcacatgccatgttgaaacataatccctagtgttggcggtgggtgtgctgggaggtatttggatcatgggggtggaaccctcatgcatgacttacggccatccctttggtgataagtgagttcacatgatatctggcaccttccttcctctgttgctcttgccctcaccatgttagctgcctactccccttttgccttccgccatgactgtaagcctcctgaggcctcaccggaagccaagcacatgcttcttgtagagtctgcagaatcggagccaattaaatctcttttcattataaattatccagcctcagttacttctttattgcagtgcaagaatagcttaacacacaaggtcttacccttgatcacggtctgcagcatgtcttttaccatgtaaggtaatatgttcagtggctgtgggggttaggatgtggacttctttgggggacttttatttttcccagttactatttttgtgactcaggaatttagggacagtttggctggttgtttctggctcagggtctttcttgggctgcaatcaagatgtcagctgggggctgggcatggtggctcactcctgttatcacagcactttgggaggtcgaggtgagtggaccatttgaggttaggagtttgagaccaacctggccaacatggtgaaacgccatactaaaagtacaaaaattagttgggcatggtggcacatgcatgtaatcccagttagttggggggctaaggctggagaacagcttcaaaacaggaggcggaggttgtggtcaactgagatcacaccactgcactccagcctgggtgaaagagcaaggccccacctcaaaaaaaaaaaaaaaaaaaaaaagttagctggggccaaggtcatctcaagtcttgactatgaaaggacctaacatcatgcatggctgttggcagaggtcacttcctcatgagcattaaactgaaagctataattcctgactattgaccagaggcgaacctcagttccctgccatgtgggcctcttcatggggcagttgataacacagcagttagcttccattggattgagtaagcaagagagcaagaacaggagtgatacagaagccagcatctttttgtaaaccaatctcagaagaattgtccatgattttttctatattctgttagttagaaacaaattcctaggtctcacccacccttgaggtgaggggattacacaaaagtatgaaaaccaggaagcagggagcattgggagtcatttggaccctgcctaggacagtgcgtttgagatccatgttattctatccattagtagtagtttgcttctttttaatgttgagtaatatgccattgtgtgtttatatattgctaatggattttaaagagggctaatcaacgtgttgattagagggaaattttcttcagtgaaataatatttgagcaaaaccttgaagaacaattaggaatttgacagagggaatggcacgaataaagacccagacttaatcaagtgaggggcgtactcatccatggggcagtggatgattcacctgcctggagcttaaggagaagggggtgtagttgtggctgttgctcagaaggacctgaatgtcaggatgcatttgtgtttaatttagcagacatttaggaaccattaaaagtttttgagaatgggtaggtaagattagaatagtattttaataagtttaactaggctttaaccagtattcataaaaagtcaagtgggagaatgtagaggtgacaagaccaggtgtgggctattgcagtgactacacctaaaaggaacagagctagaaacatggagtgacatgaagtcattgtcttaggttggtgatcctagcagctgagcctgggatggggattcttgttcctatgatcgattaggggactgttcccagaggagagcggagagggaagcaggctttggtttctactggaaatctgtttccgcccgattccatggggagctctggagaaggaattgtatcaccgagttggtcctccttgtcaacagagcatgtgtgtgggggtgatgacttcccagatgtgagggtgccctccagcaatggacagttatctggaggagttcatgctccagaggtagtgcctacctctgtggagaagtaggggatggcacggtattttaggggttcctaatgagcctagagatactgacattgaccagtcatggagactaaaggagaagatgggatagcacattgttttcctaagtatttgtaatcaggtgactggtttgcaaatatcagccattacagaaataaagggtatcaggacggggaggagatgtgaggagagaagatgaagagtttagatttaggcatgttgaccctgaatttgtgggaaggtatccaggaagataagactgacaggtgggaatgagattctggaacttggaaagaatatagtggctagagctaagggtttgaagtcttcatggcgattttgttcggagtcatggatttggaagaaactgctgcagggaagattttagagatggaatgaaaagagattggtgatggaacaatgggcaaaagaggaagggttggaggagacaaaaaatggagtggtagtggcattgggaggtccaagagtggatggtatcacagaagccaagacaggaaagtgagccagaagtgagggaggagcaggatcctctgcaacagggcagtctagtcttagcagagaggaggttgctgaatttattgattgagaagccactcctcgccaggcagttttgagaggttctggatggtgatagaatggaattcattcagctgatgatgagaagtagatttgggtcagggaaggagactgaatggagatgaatatttcaaaactatagaccataaatgggaagagagagacgagtgcaacctgcctaggtcaagtgaatgtccttttttctcttcccagcccttgtcttttttaccctctttgttttctgcatttctttccttctgttctgatttttccttacctgatggtcagaaagatctgattgagctgacgcgtagcaagaatgagccagtggagaggaaaatgtaaccacctaatgggttctcctttcctgctagctggacagagctgatttatcaagacgggggtactgcaaatagagaaagaatttaatccacacagagccagctgtatgggaaaccagagttgtactactcaaatcaatctccccgagaattcagggatcggagtctttaaggagaaatgtggtggatagggagccagtgagtgatctgggagtgctgattgtctcacgtgtccatgtgaagagaccaccaaacagggtttgtgtgaacaacaaggctgtttatttcacctgggtgcaggtgggctgagtctgaaaaaggagtcagcaaagggtgatgggattgtcattagttcttagaggttttggcataggcggtagagttaggagcaatgtttttggggcagcgggtggatctcacaaagtacattctcaagggtggggagaattacaaagaaccttcttaaaggtggtggagattacaaagtacgttgatcagttaggtagggacagaagcaaatcacaatgggggaatgtcatcagttaaggctattttcacttcttttgtggatcttcagttgcttcaggccatctggatgcatacgagcaggtcactggggatatgatggcttagcctgggctcagaggcctgacactgatttgttggcttgaagatgaaatcacagggaatcaaaggtgccctcctgtgctgactcagttcctgggtgggggccaaaggactggttggcaggtctgcatggggccaccgtgttgtcagaaatgcaaaaatctggctggtgcaatggcttacccctgtaatcccagtactttgggaggctgaggttgtcaggcctctgagcccaagctgagccgtcataacccctgtgacctgcacatatacatccagatggcctgaagcaactgaagaactacaaaagaagtgaaatagccagttcttgccttaactgatgacattccatcagtgtgatttgttcctgccccaccctaactgatcagttgaccttgtgacattcctcttcctgaggcagtgagtctcaggagctcccccaccgagcaccttgtgacccccgcccctgcctgcaagacaaaaccccctttaactgtaattttccactacccacccaaatcctgtaaaactgccctacacctatttccctttgctgacccctttttcaaactccgtctgcctgcactcaggtgattaaaaagctttattgctcacacaaagcctgtttggtggtctcttcacatggacacgtgtaacagaggtgggcagatcacttgaggtcaggagttcaagaccagcctggccaacgtggtgaaaccctgcatctactaaaaatacaaaaattagctgggcatggtgctgtgcacctgtaatcccagctactcaggaggttgaggcacgaggatcacttaaacccaggaggaggagattgcagtgagccaattgcgccactgcactccagcctgcaatgcagagtgaaactgtcttaaaacaaacaaacaaacaaaaagcaaaaatctgaaaagacatctcaaaagccaatcttaggttctacaacagtgatgttatctgcatgaataattgagaaagttgcaaatcttgtgacctgaggaataacggctggtaattatttaaaactcaagcccctctcatcctaacgtggtggcctttcattcattttacaggaacagtttagttttgggggaaagctgttatttaaactataaacgaaatttctcccaaagttagcttggcccatgcccaggaatgaccaaagacagctaaccagttaccggaaacgggtcccaatctagaccccaagagagagttgttggatcttgggcaagaaagaatttggggtgagtctataaaattaaagtaactttataaagaaagtaaaagaataaaagaatggctactccataggcagagcagcaactttggctgttggactaaggatatttatagttaattattgattagctataatatattttaatataatatatataattataatacaatattatatataatatatattttatgtaactataaacaaggggtagattactcatgagttttcacggaaaggggtaggcagttcccggaagtgagggttcttcccctttttagaccatatagggtaacttcttgatgttgccatggcatgtgtacactgtcatggtgctggtgggagtgtctcttagcgtgctaatggattcatattagggtataatgagtagtaaggatgaccaaatgtcgttgccatctttgttttggtgggttttggccggcttctttactgcaacctattttatcagcaaggtctttatgacctgtatcttgtgctgacctcctatgttatcctgtaacttagaatgcctgacctcgtgggaatgcagcccagtaggtctcaatcttattttacccagcccctattcaaaatggagtcactctggtttgaatgcttctgacaaacctctgagactaaggacaagatggagtctgttaggttagttttaatttcctcagttattatttcacaaagggggtttcagaaagatagaaaatgctagaaagagacggggtagtcagtggtagggatcttgaggggttaaaaaagggaaggagctggtccctttgcagtaggaagtgccacctcactccactcttgccagaaagcctggctctgtcataaggaatcttggcccattgtcactctcattgatgacaacccccgcccccaccactaccaccttaactactgaggggatgtcctctggcccagaaggaatgcattggctctagttgaaggggttgctggtttgtaaatagcatccccacagtcagcagacacagagaatgccatggggccactcatcagaaaggtggaggggctttatctgtgggtagatgagagccatgtagaacctgcatgctgccttccattggaatctcaggctctaaacaaggaggacaaccttttctgcccttaatcacctctcacagatgagaatccacccaagaagaagaaaaaaaatcagccccttaaaatgctgactagtaacatcagtttttggaaggatactatttttgtttccattctgtctttatagtttgaacttttccttttcatagtctgtaaatattcatcatctcagagccttttgaattgcaatggcttttagtcaaaactgagcgcaatgtgccatttgaataataagaacctcattaaagtgaggcaaaagtaattcttttccttttgtacaagccaattaagtgtctttacaattaaaacaaagtcaagcactttatagtttcatattccacaagcctgtttttaattaatagaggtgacaagttttaggtacaggatacatattttgcctctggagttgtgcaattaacattaatgaagggtattaaaatttggtgagagaggaaagggttttcccaggtcctctgtgggttcttgcctccaggcctgtctttggtagcaagttccttggtttgctgaggtttgcattttcttgagagaatgtacaggcaagaataaaagtaactagaagagacattgttgttattgagaagtatgaagttaaaattcccaatgtccaggcctgtcttaaaattaggtaaacactgcagaaactatctttgaggaatttaattttgtcttgtggataaaagtgaaggataaagaggagaaataacaattatctaagctggcaggccagcaagatactggggctttacttctcacaaccatgggaggagtatatttagtttacaggggaggacacagattcacaggggtgaactaactggccatgagtcaggtaaggaaaataacatggctgagctacagtttctctaagaagttggttctgtccatttcagggagcttatgtaagacagaaggtattgtgcagtagccttgaagtcaggtgaccctttgggggtgtgtgtgtgtttgcttctttatattagcttttttttcattttgagacagggtgttgctcttcctcagttgcccaggctggagatcagtggggtgattacagctcactgcagccacaacctcccaggttcaagagatcctcccacctcagcttcccaagtagctgagactacaggtgcatgccactggctatttttatttttttctttttagttttgagtttttaattttttgtagagatgaggtcttgctatgttgtccaggttggtcttgaacccctgagtccaaaagatgctgctgtcttggcctcccactgtgctgagattacaggcatgagccaccatatctggcctatgttagctatttctgaaacttcatttctgtctgtaaatggcaatcataatatatgtcacgtagggttcttaaatacaaaaagctcttaaaaagtgcctaacccatagttagtactcaaaaaaggaaaaaaaagtattaatagccctggaaaagtgagcaaaatatttcagatgcaacctgaaaggagttcaaatgtaagtctctcttcactttgcccatctttccctcttccccgcaaggtttttagcagtggtcctgtcttactacaatatatgaattatccctgctacaaattagtagattctgctttgatttgaagcagagtctaatgagtgttacaggtaggctcggtgcttcaaaggatttctgcctatctcttcacagagtagctgggctattgagggactgtgtattgacaattgtagtgggcaccctatgtggaaaacaggtgttgtcaaataactgcaactgaccccaaccacaccatgacttttcaggttttaggtaggggatgggtgggaaaacagatgaggcaacagaatgaattattccttaataagatccagattaccgagtgataataagatttgcatgaatacttcaaacaacaacagtgattaaatacgtttttctagttaaaaaattaatgagtgctttccagcaagcgcttaaagaattaatactggccgggaacggtggctcacgcctgtaatcccaacactttgggaggctgaggtgggtggatcacgaggtcaggaggtcaagaccatcctggctaacatggtgaaaccccgtctctactaaaaatacaaaaacaagattagtggggcgtggtggcgggcacctgtaggcccagctacttgggaggctgaggcaggagaatggcgtgaacccgggaggtggagcttgcagtgagccgagattgcaccactgcactccagcctgggcaggagacagagtaagactccatctcagaaaaaaaaaaaaagaattaatatcaattttccacaaactcttttaaaaaaacagaagaggaggaaacactttccatctgacactgtgaagccactattactctgacaacagaggcagacaaagatatcacaagaaaaggaaactttaggtcactttcacttataaatagagatgcaacaattttgtacaaaatgctagcaagccaaatgcagccacatatacaaagaattgtatattatgactaagtggaatttatccaaacaattcacggttggttttatattaaaaaatcagtcaatataatataacataatagtagaataaaagatcctctcaatacatacataaaaacatgttttaaaaaggtccagcacgctttcttgatgaaaacttttagtaaacttggaacaaagtggcattttctcaactcaataaagggcatctgcaaaaaacccacaaatgacatcataattaatgctgaaagattgagtaccgtccccttaggatcaagaaataagacaaggatattcactctcatcactttaatattctactagaaatcctagctagggaaattgggcaaaaaacaaaaaagcaaaagaatggaaaaaaaagatccagattgaaaagaagtaaaactatctttatttgcaaatgaaatcaccttatctgtagaaaatcctagaaaggtacttaaaaaatattaaaatgaacaggttcagccaggataaaagtaggataaaagtttaatatgcgtaagtcaattgtatttctatatactagcaatgaaggcatcccatgttcatgtatcagaagatttaatattgtatagctgaccaaactctgcaaattgtgtacaaatttagtgcaatctctattaaaatttcagttgacttttttacagaaattgaaaagctgatcctacattttgtatatgaatgcaaaggaacctgaataaccaaaacaagcttgaaaaagaagagtgttggagggcttccatttctcaatttcaaaactttctataaatccttagtaataaagacagtgtcatattggcataagaatagatctatagataataaaatagacttgagagtccagaaatgaatccatgcatattgtgaattgattttcagcaaggatgccaagacaattcaaaatagtcttttcaacagtgatgctagaaccactggatagccccatgcaaaagaatgagattagatcacacttgcataaactacacagcaaaaaatagcaaaaaaaaaaaaaaaaaaaaaaaaagggtcagagacttaaatgtaagagctaaaactatacaactcttagaagcaaacataggggtatatttttctgattttggcttagacaatgatttcttggatacaaccctgacagcacaagtgacaaaagaaaaaaagatatccagaatgatccagaatgaaaagtgtttgtgctgcaaatgataccatcacgaaagtgtacagatgacctacagaatgggggaaatacttacaaattaaatattaaataagggatttgtatctagaataaagaacttttacaattcaataatgaaaactcatttaaaaaatgagcataagatctaaatagatattcctccaaatatgatacacaaattgccaatgaatacataaaagatgttcaatctcattagggaaatgcaaatgaaagccacaatgagattccacttattgctaggatggctaaaataaaaaagtcagataacaaatacttacaaacacatggagagatgaaagttcaaatacagtcctggcggaaatgtaaaattgtatggccaaactggaaaacagtttggccattattcaaaaagttaaacattgaattaccatatgacccaataatcccactcctagatgtatcttgaagagaaatgaaaacatgcatttccatagcatcttacaaatgaatgtacatagtagtgatattcctaatagccaataaatggaaacaatccaaatatccatcattggtgaatggataaacaaagcgtggtatattcatataatggaatattatttgcccattaaaaagaaatggattactgatatatgctacaacatggatgaaccctgcaaacatcatgccaagggacagaagccagtcacaaaagactacgtattgtatggttccatttagtatataaaatgtccggaataggcgaatctataggacagaaagtacactgatggtgttttgggaataagagtgtaggtagatagagggtggctagtgattgctaatttttttttttttttttgagttaaaaaagtgctataaaattagaatgtagttatggttgtacaattatttgagtatactaaaacagctgtacagtatacataggtagattttatggtatgtgcattatatttcagtaaagttctttaataaattagctaatgcttattgtagaaaagttggaaaataccaaaaaccataaacaggaaataggaaaaaaagtaatcctgactgtatatctggaaatcttttcgtggggtatggggtatgaatcacacatattaattttaatttcctgctttttcaattaaattgagaaagtttgggaacctctggcttaatcattatttatccacttctctgttgttggatgttagattgcttctagttcatatgtaattttataattttagttgacatgtcattatggattcttgggcataaacgtttatatgaattttgaatattaggaaataatcttggaagctatattagttttctaaagctattataacaaattaccacagatggagtgcctcaaaacaacagaattttactctcttacagtttcagagaccaaacatctgaaatcaagtggtttgcagcgttggctccttctggaggctggaaggagcatctgttccatgcctttctcctagcttcccatgactgccagccacccttggaatttcttggcttttatcttagtcagtctaatctctgcctctgtctttccatctccttctctgtgggtgttccttctccccttctgttttgtaaggataggcctgtcattggatttaaggcccaccttaatccaagatgatctcattttaagatgtgggacttaatcacatttgcgaagaccctttttccaaataaggtcgcattcacagatccctaccattcaactcactatggaagcaatgggatgggaggtaccattcaactcacagattcctaccattcaacccactataaagcagtggcatatgaaaaggatgggaggttgctatgggaatggtctgccccagatgcaggtaaaatggggaagcattttatatagaatggaaaaacaacagtaaagctggctaaaacttgatctgctttttacagtcatgtgctgacaattctaaacattatcaatgataaaatacttctccctcatgatattaactgtgcaatttttgctgcccctgctacatacatgctttattgcttggaaacaggattacttggtgaaataatgtgaatctttcaattctcatgatacatgttttcaacttaatatccagggtgcaggaatatatattcccaccaactttatacaagataatacaaatataatagtatgaataaatatgctaatttgatagaaaatattttaatatttactactagtgtagttggacgtgttaaatattgcaatggttatttgtaatctacctttataaaatttctaatgtctgccactgtttctgttagactcttaagaagatacgtgtttgtctcatagatttgtaagaactctttatatactaaaaatatggggcttctatatgattgcatatattcgtcacttttgttccactgttttagagagcagaagattttaatttctataaagatttttatgtttccctttattgcatgccaatgtttgttttttaaaaacttgtacgtcttaggctgcgatgtgaaaagtgtcttttttttgatttggaaacagagtcttgctctgatgcctgtagtggtatgatcatagctcattgcagcccttgaactcctgggctcaagtaatcctcctatctcagcctccgaagtagctgggactacagccacacaccaccacacctggctcactttcgggtggttgttgttgagatggggtcttgctgtgttgctcaggctggttttgaatactgggctcaagtgattatcctgccttagcctcccaaagtgctggaatttcagaggtgagccactgtgcccagcctcctgttttttttacatgtatatatatatatatatatatacacacacacacacacatatatatatacacacacacatatatatatacacacacatatatatacacatatatacacatatatatacacacatatatatatacacacacacatatatatacacacacatatatatacacacacatatatatatatacatatacacacacacacacacacacacacacacacacacacacacatatattttttttttcttttagatggagtgtctctctgttgcccaggctggggtgcagtgacatgatctctgctcactacaacctctgcctcctgggttcaagtgattctcctgccttagcctcccaagtagctgggattacaggcgtgtgccaccacgctgggctaacttttgtatttttagtagagatgggggtttcaccatgttggtcaggctggtcttgaacttctgacctcgtgatttgcctgcctcagcctcccaaagtgctgagattacaggcgtgagccgccatgcctgcccttatttttatatatcttccataacctttctatctctttctttctctttctctgtttctgtgtgtgtctgtgtctgataataaaatacattaaattttattttataacataaatgttttataaggtcggtagatttgtttatgattttaatggctgcatagtattctatcatatggatatattctaaatgtaataattcctcaatggtatatttagtttactttatatttgctgctttagtttgtcacaaacaccgtggatagccttgtatatatttattttgttgtatagttcttattggtacagtatgatttttcacaagtatacaattactttctgagaatttagctttttgattcacgtgaaagccttacttgtattgttaacaattttgttacgtttgtgaggcctaggcagaaggattgcttgagaccaggaactcaagaccaccttgaccaccttgggcaacatagggggagcccatctctacaaaaataaaaaataagaaataaaatagccatgcatggtggtgtgcccctgtagtcccagttactcgggaggctaaggtggaaggatcgtctgagcctgggagtttgagactgcagtgagttatgaccacaccactgcactccagcctggatgacagagaaagatcttgtcaaaaaaaaaaaaaaaattaaatatatacaaaataagggagaatactatgacaggcttccacttacctatctttaggcttctttataaaatgttcatttaatctgatctctataagaaattctgtatccttaaacaacatgtgcccttctctttacacagagcgattacccccttgctatgttttattaacagctagcaagtgctgggtcctgtgtcagttgttttgttttttctttttctttgtttttcttttcttttcttttcttttttttttttgttttttttttttttggagatagagtcttgctctgttggtcaggctggagtgcagtggcatgatcttagctcactgcaacctctgcctcctgggttcaagtgattctccggcctcagcctcctgagtaactgggattacagacatataccaccacacctggctaattttttttgtgttttgacagagatggggtttcaccatgttggtcaggctggtctcaaactcctgacctaaaatggtccacctgccttggcctcccaaagtgctgggattacaggcgtgagcccccgcgcctggccctgtgtcagcctttttaacagcataatttttcctttattagtcataactactttaagggctattttgatttacagacaaagtgagacttggatgaattaagaaagaattaatcaggtggttgaacctgagttccaactagggtgacaactcttcgcagattgcctgctgctgtcctggttttcacactgaaagttccgtatcctaataagcctctcatcctcagcaacggaggacagttgcccactcaaagccttgtgacattctagggtatcctatttctacatggtgggaatctagaagacggagaaagaatttctcattcccgaaggagcatggattatccttggttgtagtgtttatgtccacatcacgtggattcccgaaggagcatggattatccttggttgtagtgtttatgtccacatcacatgggatattttatttttcaggcctcttcatgtgcttgtgtgcaacgcagcaacttttgctctaccctggagtctcaccaaagatggcctggagaccacctttcaagtgaatcatctggggcacttctaccttgtccagctcctccaggatgttttgtgccgctcagctcctgcccgtgtcattgtggtctcctcagagtcccatcggtgggtttgaattgcatatttgttcacttatcccctttctcataccagctaatattcccccaaggctctcattctgaaaataattttcattagtcctgcttgagacatgtgggtggactcagcttggctcacttaatttttccaggtcttttttgttcgcctgtgattgtgggggactgtttagaaggactttctagagcaaggaagattgtttttacgactatacttcaagctcctcattgattttgcttagagatggaataataattgatgaaatctgaatggcatgacctttattgatttgtaattcaacaacttcaacatcttaccaagaagaatgtgcagttattctagcaggagaaacaatgcaattagagcctgcgagatgaaatcaaattgttttataatgagaaattagggaattcgaggcagacattagctgtgtaattgtggaaagggaagaactgtagttagagcatattagaaatctggccgtgcctcttttggttaaaatttcaattaaaacatcagatggcacttttttcctattgccattaggagaatattcaattgactgaaaaggacatttgaaaatttcctcgtattttcagcatatttgtttctagagttggagaaacaactatttgtctagagagaagtactctgaaaagacaaaggccttgctgggtgaggctggatttaatacatgttagggagatttctctttcacgtttgcttggtgtgtgtttggcggggggaacttacactcttagcaaagtagctagaaaaaaaaataacgtgcaaggggcctattttttcctccttcttctccgtcttaagtcctgaaatgttttagtgacccagaatgaagcttatttttttaatcatacttccataaaatgtaacccctgggacttggaagagagagaccagccaagggttagcttgaaccctttatcactcccaaacacaggggcttatggtataagtgacacactgcagatagatttacttttgccattttaaatttatgatggctgaaatgaaaggtaaatgccagtaataatcctcccccgtgttaaaagacatgaaacatctagtaattaggtggtaacaaaatctggacagccttatctttgcaaatcacaccaggtttgtgaaggaaagtggagtggccctgttaaggggcgagggaggctactgtgggggcaggcagcagagagagctccagaaataaatctgccagccccagtcatccaccagatgtggagggcaccacgggatatgtttaaatgagctggtatttaatgggagattatgtcgaattgtcagctgctcactctccttgtaaatctgtatctcaaatggtatttcgtgtgacgtctttgttctttgcttaactacggtgtaattcatgcctacttcagagatccaaatctcagcatcatttaaaagattagtttgaaaggaagggacttgggctcttgaattagacctatgttagtttatagggaggccttcctgaaatgtgttgtcaggcttgctcctgtgtgatggctggcactggttttatgctttccaattattctttgcacatcgttatttattattactgttattattatttgacatggagtcttgatctgttaccaggctgcagtgcagtggcatgatctcggctcaccacaacttcagactcccagggttaagcgattctcctgcctcagccttccaagtagctgggaccacaggcgcttgccaccacacctggctaatttttgtatttttagtagagacggggtttcaccatgttggccaggatggtctcgatctcttgaccttgtgatccgcctgccttggcttctcacagtgctgtgattacaggcgtgagccaccacgcccggcctctttgcacattatttaagggtgttttaacaaaatggcaatttccccaggctggcttgtgtattaccttcgcattgcatcccttggctcccatgagtgagcgtggtgacttggtgcgtaggtggtacgtgaagacagttgctcactacccaagaactcagggccctaaaccatgctgtaaaatgcaagtgctgatatctaattacctccatcaaccttggcagaatctcttcgttggagttaagaccccctgttaggggaaaaaagaaagtcctatgtttgcagaaaatattatactagactgctccaaggcaaaatatttattagccttcctgtgtcttcactgtgttttagttacttatctggaatctgagcaactgaattgagtttctgcatacctaaaatacatcatagtgaaatgagaagttgacttctttgctgtgaaaaaatttcagataacaattaaagtagaatgaaaagagcagagtgctggttgaacaaccctcaatggctgcagctgcatggagtgccaaattgccctcccccaccccacacacaaaatcacacatacacgcacgcacgcacacacacacacacggagtttctcagcttctgtgtagacagaatccagcctaattattttaggcgggaattttaaaaatcctcaataaaattgggcttggtagcacatgcctgtaatcctatctagtaagaggctgaggtgggaggatggcttgagcccaggagtttgaggttgcggtaagcgttgatcatgccactgcattccagcctgggtgacagagtgagaccccatctctaaaataaaaattaaaaattgtttaaaaaaaatgcagtataggccaggcacagtgtctcacgcctgtaatcccagcactcaagagttcgagatcagcctagccagcatggcgaaaccccatctctactaaaaatacaaaaattagccaggtgtggtggtgcacgcctgtaatcccagctatttgggaggctgaggcaggagaattgcttgaacttgggaggtggagattgcagtgagtggagattgcaccagtgcactccagcctgggtgacagagcaagaccctgtttcagaaaacaaaaacccaaaaagcaaaacccccacagtatatatagaaatacaagatttgtgaggggcgggggtccccctacaaagcaagtgttactgtccacagagcaaatgtcaatattttaatgtactagtaagggaaaattctattaagacataattgtttggctttgtcagtttgtcaacttgaaaatagagtcagcagcatctaaagagttgttttactacctctggagctgagaggtgaacatagtcgtttttcaggaagccgtttctggctcagacagataagaagctggcccacccttgccacttcctggaggactgtcagtgctagctaatgagactgtaaaagtggactatctgcccaggagacagtgaggaaggaaatcaggggtcacccttacagggaagggctctttgcagagagagtgcctgatacgtagcagctggtacttctccatcttgaaactgtccttcctggttttgtctaatttgtcatcatgggattcttttgacttgtttctagattagggatcaagaagaaatgactttctcctcttagacatttaattcacttagtgttccctagtcatgacatacttctgtgttatccttaaatactgaaacagggaccttattcttaacagtagaaaatcactgtgtatgatgatagtgtatacctgtaataccagctactcaggaagctgaggcaggaggatcccttgagctcaggagttgagattagcatgggcaacaaagcaagaccttgtctctaaaagaataagcagaaaccaaaagccctaaacatgaggaaattccacatgtaaacattaatggaaaacatagaagagttgaacctagtggtaaattttacctttagagcaatgcttgaaacaagggaaactgtcaaattctcatcatgggatttgtgttcctttgttttttttattaaggacttggtccttggattggaattccaaacccatgaccaaactgtaatcatctaattctgtattgagtccttactatgtgtcaggcactgtagtaagcaacactcaagaatcttacagtctactttccaagaattcacagtctagttttggaatcaggtgatcaattgacttacagtctggtatggtgatgacagaggagcaatgtacagatagaacagaaggatggcacagtgagccttttcaccaatcttggaaggccagtaatgtcagtgaacactaggaatggtgtcatggcctgggtcctgaagagtggatacttaatgtccatggaggcatgcatttttatctgccttgcatggcttctttcattctctccctgacttccacccaaaaaatcaccatgatatccagctgtggaagagttcattatggagagcttcctggaagaagtagtccctgaactgggttgggctaaacaaatatgccaagaagggtttctggaagcagttgacaaaagatgagtagagagagggagggggtggtgctatatttattccatacctttcagatactctctaaatccttgtccctgttgtctatgccatgtaggtagagttttcaagtcatgtcccataccttggatcattggattctcaactcagtagcacctttgtgtgacacctcttctgtaataccttattatgttgaaataaagttagcaaataacataacttacatgcacaaatatattttcaattcgatatgatagctttactgtaatgaaagaaaaaataactgaaacaaaatggcgtgtgtttcaacatgtaaatgcttgggccaggctacaggaaagatggggatgtatgtatccgtggatgaatcaccttgaatggactctcataaaaaagcccaccattaccaggtgtgtggtattgcagactccagcaccaccaaccttgagtgaagcctgactatattagtctgttctcatgctgctaagaaagacatacccgagaccgggtaatttataaaggaaacaggtttaatgggctcacagttacacatggctggggaggcctcacaatcatggcggaagatgaaggaagggcaaagggatgtcttacatgacatcaggcaacagagtatgtgcaggggaattctcatttataaaaccatcagatttcgtgagacttattcactaccatgagaacagtatgggagaaagcacccccatgattcacttatctccacctggctctgcccttgacacatgggggttattacaattcagtgtgagatttgggtggggacacagccgaaccgtatcagtcaccctccaaaaatcacacaaaatctgaaagtgcttttattcattctacatgtaaatagttgttgcactacccacctggaaattcagtggatgtttctaggctcagataattatccacaggcttttcatctccatgagtgtccactggggcattcttcattgagcaatacatcatgtgcattgcaagacatctgccatccctgctaccatcaccagcagtcatcacgacaaccagaagaaggccgtcatatattttcaaattgcctgctgagttccattgccttagacaattaagcttggaagtcagactcttcctgtggtttgggtactagaaaaaaggcagccaacaattcgtttcaaggtctcatttctgtatccttgatgacgtttctggccatcagctttgttgatgactttagagcagctatgtcatttaacactagaaattggatgtcaccgagtcctgtggaagggatatttaatttccattaaaacatgaatttcattctgcccttgccatgcttttcttggtcttagcccaacctgagctgctgatattaaggaataataggataattccataattttcattttaccttttgctttttgttttccatagcagttatctagaggattcccattatgcttcttcattacccggtgcccagaatgaacttatagaagcagaatatgaggggtcctttgacaaacatgagactgtttagaaaattccttttgtttgctgtgatccattttgtaagggaagtcactataatgttgttatttaagagaaagagacaaacggaaagaaacaaacagctggtgtttaacgactccgtcagacccaattataaagcatcaactagttacgttgatttgtgtacatccatgccatgggtatacttaaaaacattagattttgccagaactcatcttggctttgtttacatttttcttttaaacgtataagactattgatggtacctcaccaaggttataacccctttataatcattaatttttaatctagaaaagagtcttggagacaacaagactcatctataatttcttggatgctcaaatgaaaatatacaggactcaagcattagctaaaataatccaggaaagccctgtcaaaggttaggaatgtgatatctttctgtttccaaaagcagcagccctttattcaagacacttttctgtttaatttaattatctttgaacttcctgttgaaggttttgaaaaatatatgttagagggtggggagagagttcagtatgtcaggactgctacatttatgagtgtgggtctttattgaagtctctctttgtagccaatcctttttttttttttaatttttaaattttaaattcttacttttagatatgggggtctcactctgttgcccaggctagagttcagtggcacaatcatagctcactgcaacgttgacctcccaggctgaagcgatcctcctgcctcagccccccaagtagctgggaccacaggcatgtgccaaaatactcaactaattgtttattttttgtagacatggtgtctccctatgttgcctaagctggtcttgaactcctacactcaagcaatcctcccgcctcagcttcctaaagtgctgggattagaggcatgagccaccagacatgacctgtgtttatattgttaaatcaccattgtcaatcttgaaaggagactttgttttgatgtatgtaagattgagtttttactcatctctacatagtttcctcagattgcttttttttttttttgagaccgagtctagctctgtcacccaggctggagtgcagtggcacaatctttgctcactgcaacctctgcctcccatgtttcagtgattctcttgcttcagattcccgtgtacaggcatgccaccacacctggctaatttttgtatttttagtagagatggcattttgccatgttggccaggctggtcttgaactcccgacctcaggtgatccactcgtctaagactcccaaagtgctcggattacagatgtgagccactgcacccagcattccttagatttccaataaaaataaaaagctgtgtgggaagtcagaacttggttgcttcatgtcatatttcctatttttaagatttacagatattaacgactccttgggaaaactggacttcagtcgcctctctccaacaaaaaacgactattgggcgatgctggcttataacaggtccaagctctgcaacatcctcttctccaacgagctgcaccgtcgcctctccccacgcggggtcacgtcgaacgcagtgcatcctggaaatatgatgtactccaacattcatcgcagctggtgggtgtacacactgctgtttaccttggcgaggcctttcaccaagtccatggtaagagaacagcttctggcgccgcaaacaccttgggtcctagagaaacctgcacacttgtgtctccacctttttacctcttgcgggcatgagtctggtctcagtaataacattgtccagcccatcataaagggctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaaactgtatcttttgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatggttttagtaggaagtattttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaactgtctgctgccttctcttacactcattcccacctgccacccttaaccttcgtatttggggatgacttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccaccactatgcccggctaattttttgtatttttagtagagacggggtttcaccgttttagccgggatggtctcaatctcctgacctcgtgatccgcccgcctcggcctcccaaagtgctgggattacaggcgtgagccaccgcgcccggcctggggatgacttttaaaaccacatcaaaagtcttttgaagtgcttaggaggaggtaagtaagtatatcttttattctaatcacccaagtggtttttaggcagagtaaacagacatattccaagagtcgaatacttaggatcagtggcagtgaagtgaaaggacctacggagaatggtgttccatgccgcagggtgggattgatctctaggaagtaaatgaatgaaacttacctgtaggtggatcacagggttttgaaatctccccatcactttgctcccgatgactgcataagcgcagcctcttcatgaaagtttctttgaccatggttatgcctcatactttgttgtgtccttcagtttacatgaaaagaaggaatatggatctgaactgggtgccagtgccatttaaatgaggcatttaggaatggggagaggagagaggtggattcttccttattttctgctggcccagtgccttccgctttaacaagcccagtcaaccatcatttgtaatctttgggtcttgagtcatctcacttgtatttgatcattgatgtgttttaaggagctcggttcagtggcatcagagagttcgttttctccttcttccataaggtccctaatcagaggaacgggatgggaaagctttagagatgagtctgtgactatggaatttggtgaggggtgatataaccatcctgccatttgttgtagactcgaatggatgaggagtcattgatagaaaatagtggaaactgttattctgtggcctgatcccattgcttagggactctgtgccagggcatgtgggaaaagaaggaaggcaagttctgctaaaatataaagtcagggtaaacatttttatttattggagaagagttgattattatctaatatttaatataatatgcttaataaagtcagacttgaaagttggctggttggacctaacgggagtatctctaaaaaataccagcaaattaagttggatcggtgactgtatcatgatatcggagtgttagctgttttgggagtacgtgtgctcaggacttgggctgagtggaaaaccagagtatggggttagaaatggaggcagagggactaccatgtcggggaggatgcacaatgaattggacgaaggttgcaactcagtgagcaccgtacctgtagtgtgtcttagtaatagcagatgcccaacctccatgcctaactcctttgcctaccccaccagtgtgcagcagcctctgccgcaccctactgcagtctctcctatttccctggcaggagagctcagagactacttgtgaacaggcctcaatgcctatagcaaggcaaggcttgggagaaacaaatgtcctctgggagcagccttgggtaaaagattaactgcgcactgagctttagatccctgagtgagaaagctgtgggaaaatgagtgtgtagctcatgagagggtttggagaaaagtggtgacatcgcaaaaatcccaggttttgttgaagttgtctgtggaggggcactcatagaaagggcactggacgtgagcatttcccttgtagttgagatgggatttgacatgacttcctggtggtggcaagacaagaaagtggcaacctgggacagtggacctcacagctctcctgctaatggtgctgatggctaagctcagctcttacccttgaccactggaacaacttagacatgtcaccagctttctgagcctgtctcattacgatgaaaattgtgatacaggttagtgtaaggaccgacaataatgcatataacatcaataatgatggatatagaatttctgcagttattataatctggctctccagtatggtagtcgtgggccacatgtggctattgagttctaaaaatgtggctaatagaactgaggaagtgaattttcaatttgattccatgtttgttaattcgaactgaaaaacaccacgtgtgccaagtggctgccatactggagagcgtggtcaaatgacatgcctagctcagtgcctttcgcatgggaggtatgcagtacttcctgccacgatggctgttactcttgtcgttgtgagcagtgccttggtcccgatgatgattctccaaaatgtaatctctgctgacagaacaagagtctgcaaattgggagtctggaaagggaagagaagggctttgtccctggccccaaagactcagggagaggtttactggccaggtagaaagggcgtccaggtgaagggaccctggttcagtgatctccaacctgcacgtctcatttgtgaggaagccgtagggtgtggacttttcttgtttctgaccttgagtgattagaaaatagcagcttttatatgtcacaaatggactttagataagcatgaagatgacgaagactgtggaatatgtagctaagagtcttactaaaatcctctctagtgtatttatatatttaagcgtttggtagtacttttttagccatcagcgttctctatattaggttgatacagaagttattgaggtttttgccattgaaagtaatacgtcacttcatgcagaggtggaattggcgctctgagcttgcttgtcaaattcacaggcattcacttttctttcataaacatttaggactctgtatttaggagaggaatcactgtgaatgtagacctcgggttggtcattttcctagtaagatagaccagactgactggaaaagtcaccctcttgggctatcctgcgtatgtggctcggcattgcttccgtcaggataatgcatcagtttcttggacaaagggtgcatttctgctatttgaatgcagacatatttttggatataagccacgcagttgcatcccatttcttccgtaggtaaaggctgggtttctaattgtgattgagaagcttagcatagatgcaatgtccctatcaccagatggctagtgtgctctgccttgtctgccttttaccttagagagggtgcttccttctgacacgggtattgctggagtacacattctgttgcatgaggtcaggggagcaagaaatacaacccagacttgcgctcggaagccctgccttcatttcttctctgtagctggctcccttaagtattaaacagcagtattctaatatcaacgtcccttttttatttgctgtgacttgctgtgactacggtgattttagttacagtaattaggtcactcttcatggagtcgggctattttaagtgcctctttaaggaatattgttgcagatcagtaattttacaattggatgttcttgtgcaactttattaaatgtgatctgtcttttaaatgttgcccttttacagttacacatttctaattgttgctgtaaatgcattatcactttgaaattaattaatttttccattttggctgcctgcaatataataatcactaatgagaaactcacaggaatcaattctcagcacagcggcccctactggtaaagccatgtctctgcctccctcttcttcttcagatccagagaactggacaagtgtattggggcgtcctgggagggaagtgtttgtttcttcctcccttcaatttatggtgaaataaaaatcacagataaacttggaaagtgagttatttttaagtgtcgttctaaaaaagatgcaatatacttcaaatagctgcttctaaaatatgttaaaggaaactaacatttgctgagtactttctaataatgaagtcacatcatacgtgcattacatgtttattttcttgactctagagcattcttttatgcagttaaattactctaaaatgttttgcacctgcacgcattaatgtgtattgtttggtaagaactttcgagttggtgaaaaaatgtattgtattttagtatctatatttatatatacatattagtctatgggttttaattcacaaaaccaggtgttgtatctggtgcacataagggattttcaaggctaatcttgggtttttgcagttgtaaccatgtgtgatgactttagaatcctaccacacttccaaatagagatgcagattgaccattttcccagataccacgatgctttatgtatcagcatatattttcattaatttctcataatttctgttagaattaataattccaagttctacaatcttagaattattatctttattttgtaattgaaaagcacagaaacctcatgcagcgtgttcaagaaaatgatataccagccttgtaaactttcacttgctaattgcagctgcatttgctttgtccaatgcacggtaatgcccctggcatccatatctagttatgcagttatgcttcctttttaaaatgtttgacagcaccttcactgaaatgaatgctgccaccaccgccaaccccaccttttttttttccacataagctttcatttctggtaaatacatccttgccagagttcccaggtccaagccggtcctttgtggaccagtatgcagatttgaagttgagcactgtcacttgcctcttaggagtgttttgtgcaaccacatatttgtgttggcagataacagtagaaagaatatcatgtgttagggtagcaagagcttagcagatgttttagggaactgcattttcaaatcattttacattaaaaaatggcttacgtttatggaacttctgcgacgatcgggttacgtttcctgtgcccgtgtaaagccagtcatcgtgctgagttttaacggatgtgcagctaccctgctaatggatgggccggcaatgctggtcctgttgcaaagttataaattataactagaaaaagcacaagatgtcattcttctaaccttcgtgaaagccaaacggggtaattctgcccttgaataacccgctgcagggtgatttatagttgtacaatttaaaacgtaatgaaggagataatagatgttgatttgttcctgaaattagtattttagaaaaatacttctccccctttccatctttaaatacctgcagctgactacactatagatactatcaagggcaaagccccctgtttgaatgtgtattggtacattggtgtatcacatacaaggcagagggtgtataaaacaggctttctgttgcgagggggaaatatggttttcaaagtggaaatttcattgtattcttcatgaatctaaacattttgagactcctgagtgaggtttgaattttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagtgaccaatggatgtaagtaagttggaaaagggcaaaggatttagaatcatgagggttgtattcaaactgcagcctctactcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatgcttacaagatggcttctgtggtgccagccattgcatcctatttgataaggtctgaaggcacagatgggagggatgaggctcctcattgcatgcctttttcctttatcaagagacagagcattctgcttcagaactgtcctcctgagttgacttcccgtcagatcccactggttgggactgagtcatctgtttgtatcctagttataaaggagactagaaaagtgcataactggctttttgagcctctagagtggcaggcgaactctgattttgaggaaaaaggatagggtaatggtgttgacacaggcactgttgaatacgtatgtacatattttaatagttttctcattaatcaaatggaaatgctatcgattttataggatcgttgtgagaagaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcagtctgaacagcacacgtcaaggaagcagttttggtctctcagattatatgaagctctccaatatgttctttcagaacagccagtgcctagaatactgcctgactcgtagtagcactccttatgtgttgaatgagtaaatgaagagtccctggaatttcttcttcataacattgaacacaactgcagtttgaaaacataatttctgtagttttttttttttctttttttttgagacggagtgtctctccgttgcccggattggagtgtagtggcacaatcccggctcactgcaacctccgcgcctccccagttcaagcaattctcctgcctcagcctcccaagtagctgggattacaagcactggccaccaaacccagctaatttatatatttttagtagaagcggggtttcaacatgttggccaggctggtctcaaactcctgacctcaggtgatccacctgccttggccttccaaagtgtggtgggattccaggcatgagccactgtgcctggcctgtagtttctttttcttttttcttttcttttcttttttttgagatgaagtcttgctctgtcacctaggctggaatgcagtggtgcaatcttggctcactgcagcctccgcctcccaggttcaagcgattctcctgtgtcagcctcctgagtagctgagattacaggtgtgcaccaccacgcacggctgatgtttgtatttttagtagagacgggatttcaacatgttggccaagctcgtctcaaacctgcctcagcctcccaaagtgctgggattacagatgtgagccactgcacccagcctgtagtttcttatttaatgtctgtccccccttctcttgacagtggtgtttttgccttcacactactgtatccctggtccataccgtaaatgttctgtaaatgtttgtaaatgaatacatgaaagatgaccaggtgctgaatcagtgagagtccttaatgtacttcttatcatttatccctctgaggtaggcaagggattatagtttagaatgtgtaaatacgtaaaagataaggcaaggagacctgctgagagtcacacagcaagcccccaaggtcccccaggctcatggtcaaatgacatgtaagggacgtatccagcggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataaccattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttgaggaggccaagctgggaggatgacttgagcctgggagttggaggctgcagtgagctatgatggtgcccctgcactccatcctgggtgacatagtgagaccctatctctaaaggaaaaaaaaaattatatgtattcgtggtgtgaaatgtgatgttttgatattcatatgcattgtgaaatgactaccacaatcaagctaattaacacatcggtcaacttacatagctatcattttttgtgtgtggcaagaacattgaaagtctagtctcagcaattttcaagtatataatacgttattattattactatcgttaactgtattcaccatgctgtacaatagatctccagaatgtattcattctgtctaactgaaacttaggatcctttgaccactatctccccatttatcaccccctcccacttccccactaccagcccctcctgggaactgccctctactctctgcttctgtgagtttgactgctttaaattccacacaaaaagtgagatcatagagtatttgtctttctgcgcctggcttattttacgataaattgattgcttctcttcccattgtttatagatacccattctcgtaatgatggcactgtgtctgtcatagaaggcctaattctccctgttaacattgaacataaaaacctcatatgggccaggcacagtggctcatacctgaaatcccagcactttgggaggctgaggcggatgaatcacctgaggttgggagttcgagaccagcctggtcaacattgcgaaattctgtctctactaaaaagatacaaaaaaattggctggctggtcatggtggctcatgcctgtaatcccagcactttgggaggccgagccgggcgaatcacgaggtcaggagattgagaccatcctagctaacatggtgaaaccctgtctctaccaaaaatacaaaaaaattagccaggcgtggtggtggggcgcggtcgtgggtgcctgtagtcccagctactcaggaggctaaggcaggagaatggcgtgaacccgggaggtggaggttgcagtgagccaagatcgcaccactgcactccagcctgcgtgacagagcgagactccatctcaaaaaaaaaaaaaaaaaaaaaaggctgtgtgtggtgactcgtgtctattgtcccagctacttgggaggctgagacatgaaaatcacatgaacctgggaggtggaggttgcagtgagctgacatcgcatcactgcactccagcctgggtgacagagtgagactgaaaaacaaaaaaacaaaaaaaaacccaaaactatatgtgcaagcctcaggaaccactaagacagattacacaatgctcatcagaactcagcaggcttccacagtgcagattttaagccctccagttgcctgttttactggcaccaagaacacaccttagcttggaggaaacattggccactttcttgttaaaaacaaagagagggaaactagatctgcctttgtgaggctggagcacctcatcaatgtattttttctgccttgctttatagtgttttaaatccgcctcggcctttgttcctgaatgagcacccgagaaggggagaaagtgactatctggccttagtatgtgtaacaaattatttaatgaacatttaaccaagatttgcaattcccctagttttatcttcccggtttccttttcttctgtgtgcccgttggcattttggtaatgtgctgcctctttataactctttgtagctcttttattacttttcttttttcttttaagtttgtggtgccttctttgatcctcccctctttcagtttccttttctccaatttcatacttatttccagtgatttttggctgcaacgcagtttagatattggaggccagcgtgattaaaccgaggccaagagtttgtattgccccatgacgatgtttctggaatgtttcttctgtgaacagtgatttttgtataactcactggacatgttgatttttccctgtgaggtgtaaggtaatgttttcctagcaaaaacaaagagggctgaaacctggtgctcagaatcgtttggaaacggaactcctctccctcttctttttacaccaagataaagaaatactttgcaaatcagctgagcacatgttcccagctccgtgccgggctctgtggtcatgggtttccttctttatgtcttactcatctaatgtaattttagagtgtgttctctttagataattgtgtgtctctgagcaaatcacttatcctctctggtcctcagttttcttatctgtaaaatgaatcagttaaccaagaatagccatcccttgggttaatagaacagtttaacttgaaaggaaataaaaaaaggagactaacatgggcccacagacattgtatttcataaattttggatgaaaactgaacctaccatcatttattaagagaatggatattttcatgtcagaaattataggaaggatacagttatgggatgaggagcaattcttttttttttttttttgaggtggagtctcactctgtcaccaggctagagtgcagtggggcgatctcggctcactgcaaacctctgcctcccgggttcaagcaattctcctgcctcagactcccgagtagctaggactacaggcgcgtgccaccacacccggctaattttttgtattcttagtagagacgaggtttcacggtgttagccaggatggtctcgatctcctgacctcatgatccacccgcctcggcctcccaaagtgctggaattacaggcgtgagccaccgcacccggcctatgaggagcagttctttcaatggaatatatttgacttcagggagaactcactcaaatgctgctgttactgtttttccctttgttggaagtgatggggttgtacttggaatgactggcctagaaaaccctacaggtaccatttaagctccatagttcttctgtgtgtgtttcggatcccaggttccaaacctgcactaaaacttgttgctgcatctcacctaatcgtgtagtgagccaggtgagctcatctgtgaaatgcagacctttctggacgtaccacctcgtggggtgaagggaaagaaatgatacaggtgtacatcagggtataagctgtcctagagtctggattctttttatccagaagccattctttcagcctgtgcctttttgtaaataccataccccatctatttccacaaaggatttggggcattagcgagtaaagggggaatatgttctagaagaagggcgctcacctcagtaaattgatgggtgggccacaaaaatcatgtcacaagatcttgttgatgtgcatgcattcattcattcaacaaatattattgagcatctaacataagccgggtgctttgctagggacagaatgctgtacaaggtccctgtcctcatggggaccgtatgttgggaagacagatgataggcatggaaatgaagagacaaaccactccgacttcagcccaggaaggagctttaatttgagtaattgttttcactaattcatcttcacagaaagaaataatatgatcaccttcggttagtaaacaaaacaaataggcaaacaggtttacaggctgaggtgggctggatcacttgaggccgggagtttgaaaccagcctagctaacacggtgaaacccttctctactaaaaatacaaaaatattatctgggtgtggtggagctttcctgtagtcccagctactctagaggctgaagcatgagaatcacttgaacccaggaggtggaggttgccatgagcagagatcgtgccactgtactccagcctgggtgatggagcaaggctctgtcttggggcggggggcagggcaggggaggggggaaagaagagaaacagctttacttacgtttttgatgagcctagcctttgctgtgctttggaaaatgggctgtggaatttggctgaaatagtcaaatgcgtagctggctgtatgtggactgataactgggcttattttgcttcttttagatctggaaagactaagcgcaaaatagaaatgctaatggtattgatgtgtttttcttcctttggtgtgataaaaaggtatcagtagggatcattcataaaactagttagtaaactatcagtttaatgtacaatggtgaagaaatacatacatcatacttgagaccatgttccagagagtattttgtaacctgtgacgctcttttcaagtcttagagaggaagtatggaaagagcatgcgcttttgactgaggaggtcttgggtttaaaggtcgaattttgccacttactttctccatggccttggtcaacatcctgaagtctcaggtccttgtctgcctttgctttgacacgagatgttgcctgcctcaggcggttgttgcaaggactaaaatcaggaaggcctggaaagacttggaagcatttctgtcacatcccaggaactccgtaaatgccagcaagtgttagattattgtgatgattttactactcctattattgatattataattaatattataattgttcattattaccttataaaaattacttatgatatgtttttcttactatttggtgaacatcgagtatagtaccaagtgtatacttttttttttttttttttttttttgaggtggaatctcctgtctcccaggctggaatgcagtggcattttctcggctcactgcagcctccgcctcccaagttcaagccattctccagtctcagcctcctcagtggctgggattacaggcatgtgctactacccccggcaaacttttatatttttagtagagacagagttttgccatgttcaccaggctggacatgaacttctgacctcaagggatccacctaccttggcctcccaaagtgctgggatgacaggtgtgagccactgccaattatatacttattttaggtgtattatgctgtgccctgtgcttttctttgttatactggaaggtcatgatggcaggatgtcttatttatgcttctctgtactctgtcctgtccagtgcctttcagaagtaaggtttttagaaaggtttgagttatttcctgttttctgaaccagacaggcagagtatttgatcttacaaaaatctggctcagttcaagttagctgtgtagctttggaacggaccctggacagatggattttctaaaattacagaggaaactagatctgtaactctgtacatttactcctgtgccagtaacaatggcaatattttaatactgtaataaattttttcttatgcatttgctataaattagtaaatctgtgtaaagctgcttattgcatcatcatgtagaatttctacatcctgcagaagtttaagaaaattgtcttccttttacagacaaggacactgaagtttagaagtgctaagtaaactgtcttagatcacttagctagcaagtgacagggatggaattgaatctgtatttatcagaggtgaaagtatatgtgtaattattcaactacacttaggtaaatatccgcatacatgcatgcctccccttagactccattgttccaaaaggtaatgacaacaaaaattagtcggaggcggaaggaaatgcaaaagtggacatttactcgagaaagaataaagaaaccatgcaggattccatttcacaaacctctacagctgttgctggggagtcagtggaggggtactggaggaaggcagactttgttctaagctacttagcagccaaggaaagcagaagaaactattattattatttattattattatgtgagttggagtctccttgtgtcatccaggctgaagtgcagtggcatagtctctgctttctacaacgtccacctcctgggtttaatcgatcctcctgcctcagcctcccaagtagctgggattacaggcacccaccactacatccagctgacttttgtatttttagtggagacagggtttcaccatactggcccagctggtcttgaactcctgacctcaagtgatctgcctgcctcagcctcccgatgtgttgggattacaggtgtgaaccactgcttctggcctagaaactattattaatagaagttctgggacaacggccctgctctcattacttgcccccaatccatgcaatgaaatactggcctgtgagtatgtggtcccttcagctcattttctgaagctgaccaaaggagcacagtaatgcataacgggggagtaaaattcctcaagacgagcaaaaaaggcagaaattaataaaactctatgtattagttatctatcactgcataacaagttacctcaatatttagcaggttaatacaatgcacattcattattttatagcctttgtagattaggaaccagccattgcttagctggaccatctgctttagagtctcacaggctgcattcaaggtgtccactgggctggggtcaacttcttaccgacaaagctggtgccccaaaagaatggggtcttatcctgttgggtgtcatgaagccaacacacaaaaccgaaagtagtgtcaagcagtacaggctttattcaatggccatggaattgagaagcaggagcatggctcacaaattcacaaatcagcttctccactaatgaggggtgaggaagttaaaatatagactttgttgttgttgctgttttaatgaagaggctggacattaaaatcaaggggaggaataatcatgtcttctcttgaaatgggcagtgaacttcccggaaccagagtgttgccttcctttttatccttttatggctgcttctgatcattgtcatggtgattgtcaactgtcttggcgctggtgagggggctgtttagcatggaaataggattataatgacacctgaggtctttttgaagtccttgggtcggctatcttgcttctaacaaatctcagctggtctggttacagagggaactttttatcacaggtgtcctgtttcttaaagataagcagtgttattacagggtagaaattcacctatgtcaagtaggcattataccaggtaacaatctcaagactcagcagggaaggatccacttgcaagcccacgtgcttgctggtaggactcagttccttatggcccagtggattgaaggcttcctttcctgcctggtgtttggttccttgccacgtagggatctccatcatggctgctggctttatcgaagcatgtaagccaagaaggaaatagaatccattggtaaaatgaaagtcacagttctttgtaatgtaaccacggaagtgacgtcttactgcttttgccatattctttttgttagaaggaaatcactgagtctgatcgttgttaaaggggaaaggatttcacagtggtatgaatcctgagaggcaggggtgatcagggccagctaccacactctacaacttgaattttgttttagatttcagtgccttttggggaccctgctacattgtggtagatttactcacaggacttgatgatttttcttgacctgcctgaagccatagcatttattacggataagtttgtcttttcttcgttctttttctgtttgcatcctttcgtcatccttttcttccctctttctggactgagagaggcaccaaatgcacccatttaaaacatatatgcatttctgctttctgatgggaggtaagatttagtcatttaataagaaagcttatgaaaagaataaacaaactggtagataatgtatcctaaagtcaagtatttgctttcatgttgctttagtagaaggggcccttgttaatcgatggcccaaattgtctttctcaagaaatgtgtattgcagaatttggatttgagttacaaaaactagccagaaagcgtgaactttttttttttttaagccataaagcttggtaaggctagccaatcatttcaaagcctgtgtagaatatctagactatatgtaatcctaggatttgttgttgttttgttatgattttttttaagcaggaagctaaaaaaaataaccacccgttactttgctgcttttagaaaataggtttgagattgattttgaatactaaagtatagttttcatgttataaagccaaccatgttaaaaatgtataataaagtatctaatttagcaaaattcaaatttcccctatgaaatatcaagctctttttatgcttcttcacatggcaccttgtgtagaatttgaaccactttaaacattgcatccttgagttgcatatgatgggatctcttgaatcatttacattttgaaaaaagaaagtgaaatattctttaagaagccaaagtaatccacgagaatgtatggtgtttgttcagctggatatcttatttatttgaagtactgagagagaaatcttttctgactgctcaaaacagggaataataaacagtcagagtgtccaagtaatctgagctagaaagttccttctttcagagaaaagttataaaaagtatatttgccggatccaaaaaaaatactgtgtatcaactactgagacctgcataatgttttcttagtattctcactctttaaaagaaaaaagaaaacctgtaaaatttgggaacttaaactttttttgatattttaatatttctaggcaggtgagtgcaataagtctgttttttgatcttagaacataacatttcttgttggctattgtgtgtgctatgtgtatgatttgtctctttgttaattctctataaatataaaagagcaagtaatgaaattaccatggctgaattctgaatattaacccagagcagatttcctctaagaaagatcataagaagatgcttaaaagaaaacattatatttcaaaagaattaggttctgaaatatacccaataatgaaaacaatacaattttcttctgctttttgtccttcctgttccaagcactgggaaggagctggcatatttcttatgtatgaaaagtagaataatatattggattcctttatccctaacccggaagagtctttcttggactgtggtttgctttcccgttatacttaagcttgtttattgcatcttccgatgtcacattatctcattgccaagctaaaggctctgttgggttcttagttgaacccagagtggaggccgatttcatccaaagccattttttttaaaattagaaattaaactcacctttggcaagtcctcctgaccagggatgggtcctcatgttagtctgtaatgtgaagatatgaaatgtatttgatacaataggagattcactgtgattttcactgaatgagtatacattctgcagaactagaagataaagataataaaacaattcacatttcttaggactaatttattttccacagtccactaccaacatggtgggatggggaggagctgagaagagcatatttggctgagtttggttgcagaaggatgcaatgtgaggtagcagaaggggctgtaagaacacaggattttgaagttgaagaaaccagcctggaatgaatcccagcccttccttttagtgacctgctggccagccacattacctccttgggctttggattttctttttcactgtaaaatggggaaagtagctcccacatctttgggctgttggtgggaggtgtgcaggacacagctgaaacctttggtgtatagtggatactaaagcaatgctagtcttcttcgtgtgctaccagttagaatgaattttgctgacatcttactggtttctgagggtatacagacacttattgtcaaagatattattgattatctgatccccaaacatatggagttacatcacagcaggtgagaaatacccttcaactcttgattctaaggaaaatccttggggagccgccatcattccttccacgaaggaatgaaattataacgtaatgtattgttggagcccttagttcaacactgtcttttttcaggtcatattaatgcaatggttagcatatcaacttccttctgtttttagtgactctaatacattatattcaccttgttctctgcatgttctttctttaagtcatgttagatcccttttttggaagcaggtcaaatttgaattaataaaatgatttatgttgaagtacaggcatatcccacagaatctcttaataccaggccaaaagtaactttatcttgatctgtagttcggacatatttcttggattgtccgcactcataaaaagagattgcgtaacaccctttgaacaaatggatatttgagaaccatcctgtcttcagatttagattttttcaatttttttttactgtcatatgattcacatgctagttactgattgctatcatgcagtctgccagcagaccagatggcagatcttttaattagatatgtttgtgtgtgtatgcatgtgtgtgtacatgtaatcacagttcatcaaggacctaataaatacttttttctctctctctctttttttttttttttttttgagacggagtcttattctgttgcccaggctggagtgcagtggcggatcttggctcattgcaacctctgactcccaggttcaagggactctcttgcctcagcctcccgagtagctgggactgtaggcatgcactaccacacctggctaattattatgtttttaatagagactaggttttaccatgttggccaggctggtatcgaattcctgacctccatgtgatcggcctgccttggcctcccgaagtgctgggattacaggcatgaaccactgtgcctagccttaataaatacgtatttatgtctttcgatctttttctgtttttctacattccgtttcccctatggctgctattgttttccagtgagctatttatatatatatatacatatttttgagagggaatcttactctgttgcccaggctaaagtaccatgtcaagattatggctcactgcagcctcatgagcctcaaccttcttggcctaagtgatcctcctctctcagcctcccgagtagctgggattacaggcacctgccttcatgcctggataattttttgtatttttgtgaagacgggtttcatcatgttggccaggctgcagctatttatatcttatatgtgtatttgtaaaaaatttattcctcagccctgtgtggtagctcacttctgtaatcctagcactttgggaggctgaggtgggaggattacctaaggtcaggagtttgataatagcctggccaatatggtgagaccctgtctgtactaaaagtacagaaattagttgggcatggtagcggtgcctgtaatcccagctgcttgggaggctgaggcaggaaaatcgtttgaacccgagaggtggaggtggcagtgagtggagatcacgccacagcacttcagcctgggcgcatgagcgagactatgtctcaaaaaaaaaaaaaaaatttcttattcagttgatttaagatggtttataaagacaacatgagctagcggtagaaatgcgaatggacgcttgtagacagtaaggactcaatacgtgggtttgttcaagttatattgtgcagacaggcatatgcagttagaaaatctgtctagggtagggagagataaaaccagctacttcagccctgctatttttatcctgaagattttttttttactctgtttatgaataaaacattttaatcagtgctgtatcaacactgatcaatttttttcatggaagtgtaatacagggtgaattccattaagtcaattaaatacttagatccagtttttaaacagtgcgaagatagttaagctcttcttttattgaaagcctttttaccaaaaccatttttttttattttatagtgaagatttcatgtatctgttttctgtacatgccaagttttacagctttttgtatcatgagttttcttttgcatcaattatttctaccaagtccaacttgtagattgggcagatctggatttcaccacacctggtttttgttgtcattgagtttttgtgatggggtgatttcagtgagaaatatatgccattaatttgatgaaaaatcagtatttatttattaactaatacccaagaaattccccagcaagcctcttccagtattctagagtttctcgtttcttgaggattggtctccgggcatactcctaatctaattgtttcccaaactttcaatgttttggatgactttggaagccttgatttctgtaggctgtagcaggacaaattctgatggacagatcaagatgttctatgttgctctaaaacagcatctctcaaacttttttggaccactatctaagttttttctgttaaaacccaatacatttatacttatgtatattcgtgtgtgtgtgtgtgtgtgtgtgtattatatgcatgtgtgtgtatttgtctgaaataaaagttttacaaaatgatacttttatctgagcagtgtcctgctgttttttttcccctaggttgtgtttttgtgtttttgtttgtttgtttgtttctttgtttgtttttgagacagaatttcacttttgttgcccaggctgcagtgcaatggcacgatctctgctgaccccaagctccgcttcccaggatcaagcgattctcctgcctcagcctcttgagtagctgggattacaggcatgcgccaccatacctggggaatttttttttgtatttttagcaaggttgttgatcaggctggtctcgaactctcaacgtcaggtgatccatcctcctcagcctcccaaagtgctgggattgcaggcttgagccaccgtgcccacctgtgttttttgttttgtttttgtgtatgtgccaatgatgacccagtttcaataccaactgttgctttcaccacccactattggtttcaccaccccgctagatcacagtctgttctttggcagtcactgccccaatactgtttgatgtgctcccctctgataaatgttcattgagtgccccacatgtcaggtactgacttaaggcatagcaaatgcaaaaatgagcaaggtgttctcttggctctatgggtgcctaccttagaaggatggagatgggaagaatgtgaaagggaggtgagatgagcagcactgggatgtgtggcttttctgtcttgaggatagatagaagaggagtcagataaagttgcagaacagagatgacgtctttactgagacttgaatgatgtgtcggaggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggccaaggtggacggatcaccagagttcaggagtttgagaccagcctggccaaaatggtgaaatgccatctctactaaaaacacaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacagagcaagactctgtctcaaaaaaaaaaaaaaaaaaaaaaaaaaatcaaaattgatgcaaaaaatatgataacatttcaaaatttaaatcaagacaaattcaatattatagcaaaggttcaagtaatgaacatgaatttgtaatgatgcctgggggaggtgaaggttaaaaaaaaaaaaaaggccaccaaggacctcatgttaaagttgatgatgacggaagtgagcagtgatgatgagatttaaaaaactaacttttatttttacattattttaactagtatttgtgttaacattattttaatctcctgtgcacttaagggagctggcataggccggcagtggctataggccaggacctgtgctatgtagcttatctatttctcatgctgattctacttttgttactaccgaaggagcttagagggaatcagtgacgtggacaaggctatgtaactaaagggggtggaggaggattcaagccccttgcaacggactgaagtgcccaagctctaaatccctgccacccacagcctctgttggccccaggttgtgtctgagattcagaggttgtttttatagcagcaacacagtaagttgggaagagggacacatttttaacatagacaccaaaagagaggctggaagagttgaccacttagaaatgtcacgagtgtctgtgaatagtgttgggggctgagaggcaagagaagaaaatagtcctaatgttgtacaagtagcaatggaaacaaacttgttaaaaaaaatttaattttgtttatgcatgtgtgcataaacaaagcaatagaaaatatttgatatttaagattgagcacttaacaaaatactttgtctctttttggtttgctgtcttaagcaatagccttaaattcttgtcccagggatacctgatagagctaatatagaacaatattttaacataatttgaagtatttttttcttctgatgggtatgtagttcatttttataaaaaaatttaaaaattctgaatctgtggtgtttctgaaacatcctgatatattttttgttgatgactcttaacaaaggatgtaagacagattctaagaagagaaaaggtagaatatccacatgtctcagtttcataatatgtgtaaaaattatcatgcccattcattatttaaagtgctgtggctttttagtgaataccaacattaacaaaccatgttaacatgatttaaaatatgtaatgaaatttgcaatgcatcagatgatggaactatcaaattagttcacgtggcgttggctgatcacccttatgaagagttacttgcattgtttgaagagggaagatgcacatccccttgtgggctggcagcatttttgctaacactgccttaaatgatgctactggcaggatggttaatttgatgttgaaatgtcacacaatatgtgcccaccctacgatttgaatcttctgtgccgttaagggaattggcagtgttcagacagaatggtaacattctctctgatcgtgtctgtgtctgcacccttttttgttttgtttctgttgtcttcattaatagacctttcaggaaccttcctgggatctcagataacagttcttctggaacaggattatccagaggtagcaaaagctctcctgcaaatattccattgcacgactttaaataaagcagcaagaagtcttttcattcagttcagatttgctacttgttctcttggttccttcaaagtaatgactaagtacaggtctttagatagagagctgcaccaaccaggtattgcttcgtgtcttccacgtacgtcctgagaaagcgaaggtgaatttcaccaattggtaggtggaaatagaaaaactgttgattctttttttcattcaccaatcttttttttccccaaatgctaagctttatttggggaaatcttaacagccgtttttataagactctgcatttacaacatttgtgggggctgcagaggacgcacatgaaaataacatgaactggccatgtacggtggctcatgcctgtaatcccagcactttgggaggccgaggcaggtggatcacctgaggtcaggagttcgagaccagcttggccaacatggtgaaacctcatctctactaaaaatacaaaaattatagctgggcgtggtggcgggcgcctgtagtcccagctacttgggaggctgaggcaggagaatggcctgatcccgggaggcggagctttcagtgagccaagatcgccctactgcactccagcctgagcgtgagactctgactcaaaaaaaaaaaaaaaaaaattagctgggcgtagtggcaggtgcctgtaatcacagctatccagaggctgaggcaccagaactgcctgaacctgggaggcggaggttgcagtgagccaagatggtgccactgcactccagcctgggtgacaaaaaaaaaactttacctgggcttagtaagttgcctgacttctcatcctggagttcgtatccccttgtttctagaagagaaatccctcagatgtgaaggtgtgttccatgattttgtcgaacttgccctacatactgttttattatatattctgcccacttctattccctgccaattaattaattgtttcattggtatagttttttttttttttttttttgatacagggtcttactgtgttattcaggctagagtacagtggcgtgatcacagctcactgcagtcttgacctcccaggctcaagcaatcctctggcctcagcctcccaagtagctgggactattggcaatgccaccatgttcggctaatgtttttaattttttatagagacaaggtttccctatgttgcccaggctggtctggaactcctgtgctcaagccatcctcccacctcagtctcacaaagtgctgggattacaggtacaagccaccatgtcaggccattggtataccattgtttttcttaaacatttatttattttcttatatttacagcatatgtggtcatttaaaattattttatagcatataaaagtaaaaagaatataaattaattttttagcattaatattagggaagataatctgacatttaaaaatacatgtctatatgtgtatacatacatagaagtatatatataaataccagtactagtgtctgctaataggtggcgccactttttatctgtgtgtgttgggggtggaattagcatgtagaggttggcaaaggggacaggagactgtgggatgattagtatattcttatttggcctgggagggaaaaaaaatctttcatttccaacaatattcattctctgtgtcacctcagcatttaatttacttccgtcacaaaactacttgaagttgtcccaggctagttggtcctattaattacaacctagagggattctattagtaaactaatggattacagtacctaaatggaagccagcagatgactttggaaggactgatccgcaagggccttctgtgtgaagattaaatgaagcttcctttagccttctcaggtggccacagtttcccataaccttagagattatctaggccaaggctattaatttagagattaagaagccaaacccagaaaggttgaaagactgtcgtaagttcacactgaaagagagtggtgtaatgcccttttcaccaggctccaagaaatttgcctattttatgttttaacggacatggtatccccagcatttttaataaatgcccttttcttgcataagtaactggatatttccgagtggcctacaagtggagcgtgatttcatctttcatcaagagaagcagcttttcctcctcttgtatccgttttcttccttttctaactatcaaggtcatgcggtatctgccattttgcatattcttgctttgcttcatgttttccttaaactctgtgcacatgaatatttgtggtatatggcttaattgtaagcgatcaggcatcaatggctttttatgaggcaaaatctactttctgcatttgcgtgtgccattattatagattgctgatgtttgccaatggatattcttggaagtcgtcttctggtttaaatgcagttaagtatttaaaaataataccagtgacatgtttgcatttacattcagcctgaaggcctacttgatgctgcaactgaaaaattgttagactagattttattttattttaattctttttgagacagggtcttagtctgtcacccaggctgctggagtgcagtggtgcaatcatggctcactgcagtcttgaccaccctggctcaggtgatcctcccacctcagcctcccgggtagttagggctacaggcacacgccagcacacccagctaattttttgtattatttatagagttgggtttttcaccatgttgttcaggctagtgttgaactcctgggctcaagcaatccgcccacctcggcctcccaaagtgctgggattacaggcatgagccactgtacctggactccactatgccttcccctccccttccctcccttccccaccctaaagagtctcgctcttttccccaggctggagtgcagtggcactatctgggctcactgcaacctgtgcctcccggattcaagagattcttgtgcctcagccttccaagtagctggttttgcaggcatgcaccaccacacccagctagtttttctatttttagtagaggcggagtttcaccaagttggccaggttgttctcaaactactgacctctcctcggccttgcaaagtgctgggattataggtaccccgcctggctgatactttccttagttgttttcagtgtaataacctgtcttcagtctactctttgtccttttctctcctttcctccctgaatactcaagcttccagtgcacagatttctccaaccctgaatgtgactgataccaacaccatactagctcttccacagatgcctgtttgttttgcagaacactggcctgaatgactcagacttggagcttgaaagagggagaactgatgtggcctgtggcagacgtgtccaatgacctgctgtgtccttgcttttgaagaactaaagagtagacttgaccactttttaaacatgacattcgatccacgtggcatagcaaggatgggatccacaagatggagtgatctttacgccatcctcctgaccataaatactaaatgaatactctatttcagttgagtttttagtttgctctgttacgtgaggacacatcacttgcacctcagtgtgagtttgaaagtgttttctctggagaataattctgaagaaataggccctccagatatcagtagtgacaggggtatcagtaatgttgattactaagttcttgccacaggtagaagccatgctactgcacaagtttcatacttgaagagtggacatctgacacagtgttggtggttgttgaagtgtatgactattactgtgttgctttggaagcttgatgccataacaaaagtgcagaattccatgtttgataactttctgacttgatgaaaatgaattgtggatacagatttcactatccatgaattgtggccttaactttctcatgtacttactttaaatcagagagcccacctgtccaattctagcttctcctgggcatcctgtatttgacacagcccctcccagcattctgagtcatcgtctgctgctcttgcactgtccgttttccaaatgaggaactcatcggtaaggccagaaaggaaagggagaaaaaacaaacaaacaaacaaacaaaaaataggaaaaaaagaaagagcgtatttatagatggtagagaattctgggcatgagaaacccagccaaacaagtggaatgtgtgcataggtgggactgctgatcttgttttatgaaagaaataaaggcaagtcaaacagatcctttcgcaaggatccccatgtgtgtatgtctaacccagtgacaggtaaggcagccaggagctgctgttatttcagtgcaaagctgttttcacaatcacagacatgcacagctcaaaaaccctcacaggtcacgcctgaataccttcaatgtgccccatgtaaaaatacactgcaagtcgattggacatgccctatgaattataccttatttatgatcgtcgagccctcccttttcccgtcatgctttagaattatgggctggagcagtttttaatactctatttattttaggggaggaaaatgtttttctttaaccacaacattcatgcaataccaactgctggcagtttccccagcatttaaggaaatattgttgtaagacttttatgttctgtacttcaatcagctagagccagcagtatcccaatggaaggaccctcaacagaccattttcagcattttgctacaattaaactcctctggttttagccctcaggcaatttagtacctttttacatatgcacattatgaacttttgaccagggtctagcagtcatatattagaatgctgctcttgaaggcaggcttaacaagttcctctgagtattacagttggagtcagttgtggaaaaggtaatttaagcaacttgcagcgaggccattcagaatctcagcgatgatcctaaatatctttctctcttgctcacgctcttttttttttttcttgtttcctctggaagctggtagcaggagctttcaaagtctgtgattgatcttttattcagtagctaacgagggctgtgattctattagcgcactacaaggcaagagaacagtgatttaatgaagtgtctagtgagccggccatagatttatcctgttgtcgctaatttgcagcgcacttgccagcataaaggaaactgcactcacactgctattaagcaggtatttccttagtaaattgttgtaaggtcaggtacagttatctgagcaaaagcaatgccttacctcttcagtgtctgcaaatgacagccgccgtgctgagcgctcactgaagtggaaccgggagatcagaggtccgtctccaagtcgcccttagcggaggcaggagcagatgaactgccaagtaggagtaatagagtcataattggtgattagaactggaaaggtgcaataacatcttaatacaaactggcgtatgttatagttactgtcagttgttgtaaactcgtcctgccgcctggactagttacgcttcccttgattagctctgagaaacgaggcagcgggcactggggcagccacatagacaacatctaaatttttgttgctttcctgggtcttgccctgtccttactgtttcccttgggcacgctgttcaccccttaggacatactacagtaaccttttcccaccaccgtgggaggactgtgattttgtaaatgtcctctgatctctcctctttgcaggcgcagtgacatttatgcacactggctttgaggctcattgatcttttgttttatttgcctttgctgaggcaggggcaggtctttgtttcatgtcagatccgtatcccactgcaattctgtgttactgtaggagatttggggttggcatgccagagtgaaaacgcgaaagaaaataaacaggcagcactgaggaattatacacttgagcttggcatttttcttaacgcagggctattttaggtgcactgcgcatgttggaggtgcccttgcaggtataggtaggcattgtccatccgtggtaaaaagcaatagaagaaattcttacccgatgcttaatgaattgccaggctggttaaaaaggataacccttgaaacctagggtgtccaactgctaatttatatagactggagatatttccatgcctcgcagcaaaatttttctttaaattcacagaagcagcagctatccagcattgtccagttgtgctgagtagctgtcattattgataaacatgtaactggtcatttgtattgttttgagtaggatatggcttatcaggatgcatagtagagaaaaatgagatgaggtaatgagatcacatacactgaagcatcttacgaatctggcacatagtaggttctcaataaatcttttttgattctgtgactgttagaatctgttggctgatactctgtcatctggctctcactctgctccataaaacttgggtaattctaatgcttacttcatcccagggctgatgtgtgttaggttagggtttatgatcaagtaaagagtttaaagaagtgttttatgagggagttttgtttgcaaatgatcacctggtaatttaagagggtgagctaaacttcctccttttctagtatggacctttggggctcaggatgaggatgttcaatttgtactgctggtggagctgcctttccattaagtgagtctttctccaagggaacagaagtcttaggttgttgatctggcggtcagaacctaggacaggcaaggcagtgggctgttgtagaggagatgaagctgatcagagcacacccacaccagtgacaaccggtcaggacctgggaagggctctgacccattcatctgagagatgtggcatgaggaacactgagacctaatgcttattgcttaatattgtggacaagggactctgtgggttgtctagtactaagcagaatggaagggaaggatggaaggaagagagggagagacggagggagatggaggatgacagggagatggagggaggcaaaaagaaaaagggagaaggaaagagaggaaagaggggaagggaggaaggaaagaagagagagaaggaggaagagagggaaggaggcacagaggtagagaggcagggagataatggagatcctggccaaaagttaatgctccgtttctagtagtccacagaaagcaccttgaccaagtgactgaatacaaatcgtatcacaaactactaggatttcttgggtgcttaccatgtgccatatttccttgaatcttcatgacgatccttcaagggatccttgttttctaaagggtaaaggtgcaggttagaggctatgtcagaagcaagtcaggatttgaaggcagatctgtctgcttttgcccctctgtaaatccagagctgctgcctcatttcttacgttgcccccacccgtgcagcaattcttcctgggaggcctcattgttcatattcataaagggccccattcagtctcctttttggagaaatggccactgcaactctctgttctgacctggggggaaatgttagaccctcaataaggagaatcagagaaagaagaaataaaacatattactccattcccatacttctgtgaagaaatacccgagactgggtaatttataaagaaaaagagatttactgaactcagtcgtttcacctggctggggaggcctcaaaattatggcagaaggcaaaggaggagcaaaggcacatcttacatggcagcagacaagaaagcgtgtgcaggggaactgccctttataaaatcaccagatctcatgagatttattcactatcaagggaacagcacaggcagatcccatggctttgactcagttacctcccactgggtccctaccatgacacatgggagttctgggaactacagttcaagatgagatttgggtggggacacagacaaattgtatcatagaatcataaaaattgctatttctaaggcagatgaataatcctggttggaaatcatactgatttagacttaaaaccattcagccttctttaccatttctgaatgtggccctgagggaggatttgtcttttgctattttctttttttaagagatggggtcttgttgtgttgcccaggccactctccaactcctaagctcaagcagtccgcctgcatcggcctcccgaagtgctgggattacaggtgtgagccaccacacccagcctgggggagggtttgttaaagaactgtctgttttatcacatgaccacaagttaaaatgttgggcaatgtccctgaatgataccttttcattagtaactcacatggacccataatctctgaatttaacatgcttttcaggaatgtgttcatattttccacctataaaacctgttttagtaatttactcccttgtaaatgttccttggtatgtaaatttagcatatttccttttaattgcccaggtaaataatacccaccatcagagggcaccagtagtgtaatcaccttattttttaaaatgtattctgtgtttcatgattttttctgaataactgatctttacagtctgaattgcattctgttgggcttgacttatttttaaattaaaagagactaacacattaaacactaagaggtcacataggatattccatttatataaaatatgcagagtaggcaaattcataaagacagaatacgcatcggtggtttctggggcggcggggagtatggaaagcctgttaatgagtacaagtttctttagttttttttggttttttgttttttttttgagacggagtcttgctctgttgcccaggctggagtgcagtggcaccatctctgctcactgcaagctccgcctcccaggttaatgccattctcctgcctcagccttcctagtagctgggactataggtgcccgccaccatgcttggctaattttttgtgtttttagtagagacggggtttcatcgtgttacccaggatggtctcgatctcctgaccttttgatcagcctgccttggcctcccaaagtgctgggattacaggcgtgagccattgcacccggctattgggtacaagtttcctttggggtggtgaaactgttttggaactagaggtgatagctctacaacactgtcaatgtactaaatgacactaaattgtacactttgaaataatttatgttatgtgaatttcatctcagcaaaaagaggctaacacataaggagacatattttgatacatgtggcatattaagctgctgttgttgttttttaaatattccagctgcgtgcagtggctcacacctgtaatcccagcactttgggaggctgaggtgggtggatcacttgaggtcaggagttcgagatcagcctggccaacatggtgaaaccctgtctctactataaactccgtctctactataaatacaaaaattagccaggcttggcgctgggtttctgtaatcccagctacttaggaggctgagacaggagaatcacttgaacccgagaggcagaggttgcagtgagccgatatctcacctctgcactccagcgtgggcaacagagcgagactccgtctcaaaaaaaaaagcacaaaaaatttttttcttccatctgtatcacacagttgcaacgttgtagcatgggcaggaaataattgggttgtatgtaatgcccagtaaagtaaacagatcttagagagggacaccgatccctaccctgcatggggttattcacagagccatggggacactaaacgtaccttatctcttgaccatgctattgattagttatgtgtttgcctgtgttattaataatgtatacattgaaaaatctatgtgcattatagtctttgatcttgtcatgaatttcaaagccaaagattccattttccttctttttaaaaaaaatttttcaaagaggtaggctggaagtaaatttaaaaattttcccctttctggcagagggcttttttctgatcaccacccatgttaattagatatgcatgtatgtgtatgtatgatgtatatacccatatacacacagtctatatatacatgtatgcgcacatacacatattttaaggaaagaattataaaatgatcaattcaagcttactatatgctagaggtgaggaatatttgaatacaagtcttatctagtagattaaaacagaaattaaagactgtagactaaggcaggatcaaaggacctcttttcattgttcttttattgtttattgacttcaaaaaagactttttagtttaaactgactgtaatgtctcttgaatggtcttttgtaaaatgactttgaaaactcggggataatgtcttcattaagtggagaaaaatcttggggaaaatataactgtaacttggctttcattagagtagaaagagataaagctttgcttaattaatgtctgttttccctctgttcagaagtataaggaaaaaggggactgaaattagtgctgataaaagcttgaattagacattatagcactgaaacttctttttcttccttacttagaatttggaagaacatacttcatacaaagctatgaagcatattggaagattttaggtgccctgtcttcctggatataaaatgactccaaactcagtgatactgatcagcctggcttcttttccacctttctcacttcattgtctttttgtgtgtttctgacatctgttgacaaatgggcaatcttggggatggggggttccactggtatattttctttactgtttaagaaagctcaaaattctctctgctcttttccaagccaccaatcaaaactgacattttctaagtgtcctcattgccctctgggaatgttcatggcctctgggagtccaagaactacctttacactggatcttcactgcttttactattgtgtggctttctaccagttctctgctcagcttctcttttctggagacctgatatgctttgttagcttagcatgctgttctaggctgcctttcttttttttttttttttttaaacttcatggtgagcagaacactgtactccagactgtgaggccccacctgtgcagcctgctggcttctcataccagcttccttctcaccttaaccccacgtattgttgcaacggcaaaaaagagaattgcacagaggaacaccacctatcagagttcacactgagtttgcagattcatccttttgcttccagccatcccatggaatgctgttcttggaagggtcatctcatggtccattgtcggccctcttagaagagatttcaggccttcccttgtagcttgatagttacagggagtgctagggtaagtggaaaaagcacatgacttggaataaagacttagtacacatcccatgtctgatttatactaactagttcatggacctagcctacgttactgcacctgtttgagcctcagttttcctgtctgcaaaggagggatgatggtacttacctcaaagaattgtagttggatcaaatgagttggagtgggatacagcaacaatctatattctgatttcagcaacactgtgcagtgtaattccatattatattacaccacatcttctgtgggtctttctttgggggaagctaacattttaaaaggtttccctttgtaacctgtaaccccctctaccccaaaagtatattcaagagcgaaacttttggtatgacgatgtcttacatcagtagttctgaatgacttgacttagctatctttcttgagtctctcaaaagacagatggatggatagattgattttgttgtaacacctgttcagttttgctggccttactcgttttcaaatactcaaatgccattgagtcagatttcagaggcaaatggtgatacctcaggtttgaagttgcaagaagtcaccacatgcttgttatggaaatcgtcagggatatttattccctctcctgagaagcataattgagcctccaaaccacccatcaagatatccacctgtaaaatatttaagaactggtactatgaagacatttcccttatgcaatttgttttccatctaagagcagaacaaggaaaatatagctgactataagttacaaaggcagactcttaagctacaaaatacatctcttcacaggagcacttggagaagggctgaaggcaaaccaaaagtgagcaacaaggagactagtgttctgaaacagagatgacaggctccgcagtgagggtgatgatggtgttacgaattacccattcagtttaaactagacattccctggaagcatgtcatggggtgtgcagaagggcttttggataaaaggggtctagttaagagatgttaaaaaaacaaacttgaaaagcatagcaggctgccaggacatgtctgagtaccgcgcagatagtggggaatagtctatggattctgcttacaccatggacaaccaggctgggccatgggttgtgttttttttcctctcattttatagaaatgttaccaggcatattttccctgtttccctaagaagagcttcctctcagtgctagccagccacagggccaagtgacacctagaggtgatcctttggttatttgctaaacagatctaagacaaaccgatatctgtaacctgggattagatagagccaataagatgtaactgaaattctcagggattctaagacatctacattgtatgttggtacgttattgaaggtgatgctagctgctataacaaataagcacgcctgtgcacagttgctcaaagatagtagaagtttatttcttgtttatgtaagatccataatgactcttgccaattagcaggctgctctcttccaagtggtaacccagggactcaagctcttttcatcttgtggctcagccgtctgacacatgtggcttccagcactgccctgctgttgtctgcacaaagctggtggaagaagtaggaatttgcaggaccatgtgtggagcattttaaggatgaggcctgggagtggcacaaatctttgaactccaggaggctaggaaacagagcataaccttgtgcccaggaagatgcggggcatagtacatctttgcctcacctgatgtattgtttgtttaaaatcactttggattctcatttaccttttccccctcaagatctttgtttttgactttggagataaccagaaataactaagcatgcttccttccctctacgatttcatcctcatggggaagcaagaccccactcttttattttcatgtatgtatatatgtatgtatgcatgtatgtatgtatgtttgagacagaatcttgctctgtcgcccaggctggagtgcaatggcaccatcttgacttactgaaacctcctcctcctggattcaagccattctcctgcctcagcctcccaagtagctgggattacaggcacgccaccacacctggctaatttttgtatttttagtagagatgggggtttcaccatgtgggccaggctggtcttgaactcctgacctcaggtgattgacctacctcggcctcccaaagtgctgggattacagtcatgagtcaccatgcccgaccagcaagaccccactgctattgtccagtgtggtaggtacctttgcctaccttctactctacaggctggaacaggtgatattgtgcctacttcacagccttcctagcaactgaggatggctgtatgacagattctagccatcaagtaaaatcagaaaccaacagcacgtttccttgaataccttttgctttctataaaatggtgtggcattgctggtattttcactcttccttcctaccctggatgctgatttgatgcttccagccttagcggttttcttgcttctaggactgaacagggaagagggaaaagtcaaaagaatgacagaaggtcctcacgttgcagaacactgaccaatgttggcaactacaagacaatcaggcgtgattcttcatccaggatctgcttttccctgtcctgccaattcttgagctgctaataaacattctgatgcaaacatggaatacagatttcagagggattctgggtagccctcggagatgaggatgctttgcgaatgtaacaggcatctctcacctcatttgtctggtggaatgtttacaaatgctaattaagttttgcttcaaatggggaacagtcctgtgcagtgtttctaggaagttaccagcttcatcataggaagacgttctccatcgtttggatctttttcaccagcaccttttgattgtggtggtttgggatgtgatgatctcagaactttacatcctccatgaaatctctgcagcgatagttgaatgtcttgccttttctattattgccctttttcttctgtgactttgtactgagacacatttatattagggtaatggcctcatgctatttgaaaatctttatttgggccacattggttggaagataaaaatatataagcaatagtccctgaacatcatttggcctgaactaggctagagtttctcttaatcaaaataataacgatgatttttccatgccaaggagtggtgtcatatcatgaagtagatttatgtacacattaaataaacttttacattttaatgtaccaatttgcaatttttttttctattcaccaaaatattccagataacggttatcagtttttgattctacacatacttcaaatactattaatgcaaaatccttctttagaaatgttacctaattccaatgtttcactttattcagcgaagacattcctttgattattctggttaggtgttatgatgccaatttgcccacacattttttcttaggcgcctatgcttgcagtagacagagagttgaggaaagctcaaggttaaaacaggaaaaagtaacacagtaaatacctatttttgtgcataattcaaattaaaaccccaaccacctagaagcaccaatacaaggaactggctgcatattgcattcctgtgacctgctgtcttaatgatggaatgactaacgaggatcagagggaatgtggtcagcctcttatctcataagccaaatgctgcatattccaagcctgtcaattctgaaagcccttgttcatttttaaataatgaaaaactttggggccttgttcattgtttctaaaggaagacatttagaaaatttagaatataaatttctgttagtagaaactaatttctcttgcttttctctaaagtatacttgatttgaaatatgtgccctgaagttttgctatgttgaaaaaaatgatgagccgggcacagtggctcacgcctgtaatcccagcactttggaaggccaaggcgggtggatcacctgaggtcaggagtttgagaccagcctgaccaacatgttgaaaccgtttctctactgaaaatacaaaaattagccaggaatggtggtacacagctgtagtcccagctacttgggaggctgaggcaggagaatcgcttgaacccgggaagtggaggttgcagtgagccgagatcttgccattgttctccagcctgggcgacaagagtgaaactccatctcaaaaaaaaaaaaaaaaaaaaaaaaaaattatgtcatttcgttgtcacagcgtcagcagaataaatcttagatcaagatgggattactgcgccactcccttcttcccagtctgtggtttagcacgggaaaaagcaaactagggcccttgggccaaatctgatctgcagcctgtttttgtgccgcctgcaggagaacatttttaaattgctgaaaaaatatgaaaggaaaaatatttcaaggtgtgtgaaaactacatgaagtttaaacttgagtgtccttaagtaaagttttataggaacacagtgttgcttatcttttatgtaatgtttgtttgctttgagaccgagtctcactctgtcacccaggctagagtgcagtggtgcgttctctgctcactgcggcctgcatctcccacgttcaagcgattgtcctgcctcagcctcccaagtggcttggagtatagacacgtggcaccacgcctgggtaatttttgtagttttagtggagacaggatttcaccatgttggccaggctagtcttgaactcctgacctcaactgatagacccacctcagcctcccaaagtgctaggattacagacatgagccgacctttttatgtattgttgatacagtatgacaagggaagagttaactgattgcagcaggttagagcacagcatgaagagctgacaatattgaccgactggccctctcagacaaagtttgccaacacccaggtgagcagatacacttatctgtgagcagacgtgattcaggggagattgttgtccctcctttcctaagaaaatgtggaaagatgagaatgttgccaccagtgctgatatggagcgttttttttggaattgtcttaaacaagtcccaaccttgactttgcctgtgtaccctactctttactcccaggtctttgcaaggtaagctgtcaggtgttagctgaagatacggcagcccaccagtggtcccctgaatgccaacaagagtcacctctaagatgatccagctgttgcatggtgtagcatgcctagtccttgcagcacacacgctgccattcttcttcgccgttgttaccgtattaatttagggatgatgagaaagtggcctccctttccctgttaattccttggaggaacttctgttcgaaatgaatagtcttgaaatatgtcataaagttacctatcaggaccacttttacagagatttaaatgtgataataagaataaaagaaaatgaagtgacattgaggacgtcttcttttataacagctctaggtcttgcctgttaagcacgctgtaaaatgactgttacacgtttatggattgaaatggttctgctgaaattttaagtgttaacattgttcaaattttcattactaacacctctcacattgttagaaaacagttttatgtttgacattttgatcatactaacctgggacattttatgctaaagttctcatttcatgccttaggaatcccctgcttattttgatttcagcacctttctgtaggacgccaatagcttatgtttgcacatcttaccccgatgcactctctaaaccgatcatcacagaagatattttgtagtgatgaagaaagcttaaatgtctcatttgtcagattggtttaggtagaaaataaggatttccaccccctcatcgtggttcccttttagattttcttgtttgcttttctttaaagctgctgttactcaaacgacagtccgtaaactgcactttattttttataacagctttattgagagataatttacatgctatacaattcatgcatttaaagtgtacaattcaatggctcagtctattcagagttgtgcaaccattgccacagtcagttttcttacctgaaggagaaagcctgcaccccatattttttacctcccattctccacttcaactcttccccagcctctgcgaaccgctagtctgctcttcatctccatgcgtttgtatattctggacatttctcattaatgggctcacacgatatgtggttctttgtgagtggtcctttcactttgcatgcatcatgttttcaagatactgcacctaatttttcagttccttgttttttcttacaaatacatttttcaaaatgagtaaacatatgtacaaaaatatttaatttatttaggcacgccaggtttatgagattcatctttgtagccaccaagagccactaacagtgctaacatagccaggcattctaaatgtgtttgtcaggtgcataaatctgtgactgataaaaccactgctcattacttggttcttaaactctccctcaatatagctgtagggacatgcaaaacaaaggctggctcattaataggatatgtctagagttctgctttagaaatcataatgtggacatcattgatttctctgatgctggaagctgctgctgcttcttcatctttatcttctcctccctgtgtattgagagcagggacctccttgtgctgttttgggctctccttgttcacccagattggctgcatcagcaccttcttaaaatattagtgttgctgagataggagcttttggtagatggataaactgggatttgtaaatattttgcttagtttttttcccagagttttgcagaagagaataaggtgttggtttgttataaggtggtcctttataaagtttagacctattttaataaggctgacttgggttgaagataactagagccatgactttcatcttgatggacaatgagtactcactctacttttttagtttatatttttattttagttcatttcatttaagacagcgtctgttacccaggctggagtgcagtgacatgatctcggctcactgcaacctacaccttctgggttcaagtgattctgatgtctcagcctccccagtagctgggattacaggcatgtgccaccacaccggctaattttatgcatttttagtagagacgcgtttcaccatgttagccaggctggtcttgaactcctgaattcaaatgatctgcccacctcaacctcccaaaatgctgcgattacattttaaaactctaccttttaaaaattagaacctggacaaagaggtattaaagaatgtgtctcttattaatttattatggtaatgagaagagtttggatttggacctacctaggtttttctttcctccagctccgccaccccaactccttactcatgcttcctctgtaaaatgatcactccccagtttgacaggaattgcccctggaatcccatctggtgttctaattgttaccaaatccaggcaaatcttgcctgtgatacaggtggtgaagctactggatagaactggagcatctaactggtgtgagatggtatctcattgtggttttgatttgcatttctctgatggccagtgatgatgagcattgtttcatgtgtctgttggctgcataaatgtcttcttttgagaagtgtctgatcatatccttcgcccacttgggtggatgaagctggaaaccatcattctcagcaaactgttgcaaggacaaaaaaccaaacaccgcatgttctcactcataggtgggaattgaacaatgagaacagttggacacaggaaggggaacatcacacaccggggcctgttgtggggtgcggggaggggagagggatagcattaggagatatacctaatgtaaatgacgagttaatgggtgcagcacaccaacacagcacatgtctacatatgtaacaaacctgcacgttgtgcacatgtaccctagaactgaaaatataataaaaaatacatattaaaaaaaaaaagaactggagcatcgactttcgttttcatttcaagacccgtcccccatgatcacagaggatgaaaagtctgcttaaattataagctagctaattgcttcttcagttgaagacctaaatgagttttaaagtgaaatgcatatctctaagggctaagtagccaacacaataggcaattgagataggaaagactaatttagaaaaggttgttttgttcgtttttctttttccttccctcccttcctgatttcccatcttcttcctccctcttctctcccctctcccccttctcctttccgtccttcctccttcagttccctctttcctctttttcacccttttatttaacattataaatacgatgggattgtgtctgcgcttttgttggtaattaaataaattatttatacatttaacacaatcttgaattaccaggtgatcatcttaggcactcaaaagcataagagcccttgaaagcaatatctaagcatagatattccatagcacgtcttacaatctaaatattgcttttagtgtaatcgaagcagcaagagtagtcacagcagttgatggactatttttcaaattgatttcaaaaatgtatttaaggggatgatcttctagtctagattacctattgatttttaatatgaaaagctcattatgtaagcagtaaccgcatataaaaacctagcaaacctttgcataaatcctttaattgaatttccagagcctgtggttctactttttttttaattaaatctatttctttttttaagtgttactgtgtaatttgcatgctgtgaagaggccctgtcccagataaagtgccattgatccttattaaacctcacctctgggcttgcttaaaactaactggaaaaattaaagtgttcatgccgcaatgcacttatagcttgtgtgataggattatggaaaaaataataaaactaatttccaggggagaatttctaatgtgagattttattttttttcaatttgataattaatagtgaaatcatatcatatatataaatcatattttagcctataaactgaaatggcaattaggaaagataatatatacttgatgtaaaaccatgttacgtgcggataatcttttagcactttaattttttaattgtagaaggagagaattatgaattcaagtcaaacacattaaatggtgggtttcatccaaaaaatctgattcttttactatgtactgtattagtggatttataatattagtgggaggaagtataaaagatatggaaaaagatattctggttatgttcgtgctaaaatgtgtgtattagaattaccaggggaaagaaaaatataaaagctgcaataggtttttctattttttaatacctaacatttgttattttaaaagcaataaaatcccctaaagaaatattcgtaatcaataagaacacaaaatatggaatatattaactgagttataaaaatgtttgtagtatagcacagaatgaaaaacacagcaaggtatgtacggtttaaagtgtaatcaattttgaggttgtatacaaggatataaatgataaatacaagtagtagcatttttagtaaaggctgttacaaaatactgtatttatggcctattccattctttttatagctcattaatgtagaaaacaaacacagtgtatccatcttctcagacggtttaaaattcccttaaatgatgtttttaaatgtaaataactgagctcatttgatctggttcttccttaagccaatgttagcatgaatggccatatttaccaccccggggttccttttcagactccggaaagaaaaagcgatgataatgacgtatttccctcccttccacaaaacagggccaggtgtaacacactaagaacaaatggcttggcagcctactctcctctctcgaagctccatgcccaccttgctgttgcaccccccaccccaaggaaagccttcccacctttggaagctgcattaattattccaggccacaagggtgccgttgagttactggttcactgcactggctggcaggaaagagttttaatgcaggctccaaaggtgcttaatttcctgtggtccttatgaatatgcatacagtatgtgctcagcaatctagcagttcaaactagacagctggttctggtggtgagggttttttaaatttattttttatttatttattttttctctcccctttccttggacaagccctttctgaataagctgaatctgtagtataatttcattaactcatttccagtatttaatttggttttgatatttccatcatggccccttttctcctttgattttgtcattctgtagaagttgataatctgtattatgatcaacaaggcatattgccatgactgtaggaatcaccaatttagatatccaggcttcctaaaatataagtaagtcagatttagcattactgttttcctgaatgtaggagtatttggaaaaggaaaaaaaaataaacatacatcttggaaagcagagaaaggtgttttgttttctttctgtttggattaacatattctccatcactgtgtaacttcatccaatacgtattgaatacctactatgtgtctggcaccacttcagacagtaaggatatggatatgaatttgtatcagtcaagccttccaggatcttattatctagagagaaagattaaaacatatgcaaataattttgatagaagcaaagacctaactcagcctgagaggaggttgggtttagagaatgctttcattgtaatgttttaaagctttttatttataactatagtttatttggactttatgatttaccaagtaactttagatgcaaatatggtagtactgtgaagattatggtttttgaatgaagtcactttgtggcatgatggtatagaataagatattttcatagtgaaaatggagataagacatgtcccattccctagaatagactgtcactgctctcgttgcctccaaggaggaaactgttataggaatgattgacatggaggttcatctgtagaatatggacagccctctacaaattgggaacaagggccaggacacgaaatatagtgacagcctctggcctgggagtctagacagtggtcaaaggcaggattcatggagttttccaagataagattcaagacccaaactatgaatgaaagccaggctgaggctggcaccaagtagaggcctccaataatgttgacccagcggggctgcattgttcactgccccctcctgggaaggaggaaccaatgacaatggagcatctaagagacaagagaaagggagtgtaaaggtgaggattccatggctttacactccagaaactcaggctagcttgttctcactgaagcagtcataccttctcgaaggcaactaggtggattacagaattgtgctgggtcctatggagtgtcagaaatagtgaagcttctggagcttcactgtccaatatggtagccacgtgtgactattaaaatgtaaattaattaaaattaaaagttcaattgctctgaaatagcagccacatttcaaatcttcagtagccagatgtggttattggctaccatattgggtagcaccgatatagaacatttctaccatagtagaatgctcttttggatacatctgctttaaagcattagtccccaaagtgtgaaggatgaaccacttgggttccgagaggaaacattataacttctgtttatccattaaactctttcatttattattaaacatctcaacacatttattgggtggcaggtactgttttaagtgttttgcatatatttacatgtactgtcctttcaaatattctttgaaataggactattgttgtccatatttcacagatgaggaaagagatgtgctaagaaaagaggtggcagagtagggattccagctcagtagccactttcagggtcccgtacttttcaatgtaagcatattggctctcaatttaaaaatgttattttttacagatagtacacagatgcactgacacaggtaccctctccagtcctctgatggtcaggaattgtgtgcagtatgcagtacattccaaagtcaggctggccatttccccagggagagggtccatgttggaacctttgctccttgtggactttagctttgaaatgtattgtagttttgcatgtgtgcttagttggatggattgagacatcagattatgtggtctgaactaaagcaaccgtcacagaatgaacaagagacttacaaacatttgtgcaaaaagatcagtgtttggatatagttcttagaatagcaaatagtaagaaaagagcaggattggtacttcacctactcctaataaaagcccttcatcttgtgcaaagtaaacacaatcacagtttgatcagaagtggtcaatggaaaaacaaaaatctaaattagcaaagagaaatttgaaattgcatgcattatttttaaagatgaacattgctttaacctataccattcctggaggtagtagctaatagaatgatccaagtttataatttgtaaataagtagacatcttttgaggcgtatgcccttaatttttctaactgatgaaagcgtacttccatcaactcaagacagttcaaagcagcttggagcctcttggattttaaaaagactctgtggcctctgtctctcttggttttcagtgctcagctgaggtctactctgtttatcctctgcctactagaaggatatcctttcaatagaggtgaaaatcctgaaataaaaggtttcataaatggggaaaaaagtcattgattgaaagagtcatggcatagatgctgaagttttgatgggaactttgcaggatgttcgtttgtttatcattagccctgggagagtcatccctcacctcccaccaccccttaatttaaagggatttaaaatattttcaagtacatcctgatatcagcacgtggtacactgagcctagttgatggaattgtgaaaaaaaaaaagaatgttttcccaacaatttggctgtatttgccagaactgtttcaagaatgctatgacttttgctcagggcaagggaagtgtgtgtgtgtgtgtgtgtgtgtgtgtgtgtgtgtgtgtgcgcgcgcctgcatgtgtactgtggatgtgataagagctgtgtttgtgaaaactgtgaagacataacacatatctatgaaccttttctattaatcttcttggggctggagctttaaaataaaataaataacttttctgcagagagagaacctttccttacccaaagatttcgtaactttctcacatccttggttaaggctgagctgcctagctgtctgcatttctgataggttttgctttcatacacatttcaaggacttaagaaatctgtttctaaagaataacttagaatgtgcttgttatggtcccacctattctggggaataggtggatattatacatttatttaggtggaatggtgggtcagatggcttcatgtctttttacatcacagttccacagccctcattagtgaagcagaggttgaaggaggtcacttgctttttatcccaatgtcaaataactccataattttttttattattttttgagacagagtcttgctcttttggccaggctagagtgcagtggcgcgatcttggctcactgcaacctctgtcgattctccttcctcggcctccgtagtagtcaggactacaggcatgcaccaccatagctggctaatttttgtatttttagttagacaccaggtttcaccatgttagccatgctggcctcgaactcctcacttcaggtgatctgactgccttggcctccgaaagtgctgggatgacaggcgtgagctgccttgcctagccaaataactccattatttaagaaaaattaaccagtatttattgaatacttactgggccctgtgctaagtgctttgcatgtgatttctaatttcctgaccattctatgaagtggctactataattatcctgatttcccaggcagagaaactgaggcttagagagttgaagtaatcaactgggtgttaaaaagctggtaagtggcagagcacttattggcgctaagactgtttctcaggaccttgttgtacgagagtcaacgataagacgcagaacgtatgtttcatttttcttgggaaggatctatctcactcatctgccttcctgtgtctagcaagagggccaggcacataaaatacacatggtacaatctgttaaaaggcatgaaaaagaaacagtcattcatatctgttcgtagaagtgggcgtcaagattttggggcactgagatctatgcatgttgtgggcccactttaagaaaaggagtcaaacatttagtgtggaatactggaaggggtccctagacatgaagggcctcttcaacctaccttttgttggcttcaaggttatgccatattttgcaaagtcaagttggagatggctctcgatatgcatgagtgtgttagactgcttttcttctattttttaaaaatgcacccaaatgtaaaagatacttttacctttttgatttgatgttgaaggtcatttgaaaaatactctgtctttattctttgaaatggatttactctcaagaaagttgcatgtcactttacttggaagagacgggtctcagtgaggtgtgcctccgctttcatgaaaagtctcccgtctgcagaagcattggctgacatggaagattttttttttttttaatacttttctttttgccggcatctgcgtagaatttttttttttttttttggtagtttcttaatggtctttagcaaaggaagtaagtgacactgatcggtgaaggcagacagtaagatttataatgtatttgtgctagctgattgccaacagaaccggcctttcccagtggtgctgtacgcagactcggaaaatcaatagggattaacctttgacccccttcacatacttatactgtgggctgcatcgcttaccaatatttcatctgtttcacttagctgctgttacttactcaataatgtgtggccaatctcacaagatactaattctttttttcaaatgcagcatcgcttgaagctgtgataaaatatcacacctttggaaatcaaggctcttcttgtttatttatttaactcacattaattagccttaatttaaaaaaaatgagaagagccagcatcatgatgcaagcattgactttgctcacaaaaacatcttgtggtcaacagtggggcttagggggcaggttttgtggctgtgacagaacacgtggcccctagtgtgtctgttgaaagatgggcccctttcaggaaaatggcttaccttactttttagacataatttttgttttctgttaaagggtcagttatagataagtatgctcccttgcaatgaaatgaacccactttatcaattttgaaggaatcaaaattaacttgaatacattgtctttttgcatatgtatgtagtgctttgtataaacatatgaatttgtaggagctgctcttaatgattattactgcataggctggaatagaagcaaaatttgcagtaatacttttgtacctttctctttaggccttggcatatattaaagtactatacatttgtcttaaaaattgaaattgtagattattttcatctaagacccttttgttcacagatttttttttccaagtatacctattccccagagtttacttacagtttgctattgatccagcagctggtatttgaattggtcgatatactctgtaacttgtttaagataccctacctgagctattagtttaaataatgtattcataaattgattaatcattacagtaagacttattagctgcatttatatctgcgtgttatccacaattgacttatagtctaataatcacgtatacttaagcagaagttgggttttacgttacaatttaataattatcaaggtggcaaacggtagtatttgtgtgtagaagttgagtggatgtggggctttaaaggcaggagtctctaagcaggttgctaattttacttttcctagataaaataattctctctcccaaaatgaaatacaggaagtggaccaaattgtgtcagcctgaaagaagtgattgagtttgcggaagctgtcctgaagtcgaggttctggaagatgggtggggtggggggaagcgaatgtgaagtgccattgcatttgtctccatttctgtcccagttacatcaaggctgggaggaggtctttccactggttttccgggctgtttgtgtactacacagcctgtgtacctggcaaggcacgctctgctctgccctgccttctgatgagctgactaacaccttatagatgaggttcccttagaaccaaagatgccccatgaaactccctaggatgaatgttggaagtccttccaactgggattcccagccggaaaggaaacagttcatctgactacagggtttaggtttacatgtactttaaaaaaaaaaattaataaagtttatttttacagtaattttaagttcacagcaaaactgagtgggaagtgtagagtttcatatactccctgtcctcacacatgcacagcctcctccagctatgcacattttcaatgaaactacatgttcattgaaaatgatcttttgggtggttgatgttcgattttggctctgtgttgggcctgcccagtgaggtccttttgactccctaaggaaccctgttttgggtttcttttgaggttgaagatatttcagactctttccccctcaacttccataggaaccaaactctctttcttcctcccgtttggttggaaagttattttgcctcactgcgtgatttttctactgcaccaactcccctttcaaacgttattccacaacatactaaattaatgtatactgtgttctttgggtaatggggaggggagcctgtctcacagcacgcatttgttcagctctgtgttgaaagagcactgcccgccgcgtgaaggacatctgctcacaagtgagcaattgtgcttctgatttggggcagcacctttgcttgaacgctggctccagatgaaagaacagattgccgcggagccgcttttccaaggatccctctccccagcatggggcttcatacattattgagagcaaacctactttccaccgccactcctggatgcacttattttgcgagccttattcagaatgtcagcatggatcacttggcgacaaaggcctaaagggcaagccaggaagcttccatggatacgttatttatggtgtttaattattattgtacagatttattaaatgactctgttacctaggagtccatgtagttgctgaaaagagtttgctaactttgaatcgtagatgttttatctgaaaacaaaatttccttgtgaatgctgttaccatattcctggtgtctatgtgagggggtgtgtggtggtatgccggtaagtgttgaacaacctgctctgttggcgggaactaggggaaacaaaccctgttttgtagtatttgctgattactgtggtgtaaatactcacaccttggctgatttcaagttgcagcttggaacttggagttagaaagagatgtgtagtcccataccattttatgtatgtaaagtatttgcactatgccgactaatagacataaataacctcatgagcatagataatagtcacatctactaagattattcagaagtattgagctttgagtatgttttacctttttaatatagcttattgaatcatacatttatctactttaatacttaataatgagtgtgcccaacaactaggtcttaaagttcctgatagtttagcagtgtgctctcttaagccagtcggacctggttgttgtacactactgggtgtgtttaattgacttccagttttgttttgttttgttttgttttgttttgttttgaaacagtctcactctgtcgcccaggctggagtgtagtggtgtgatctccgctcactgcagcctctgcctcctgggtttaaggaattctctgccttagcctcccgcgtagctgggattacaggtgcatgccaccatgcccagctgatttttgtattttcagttgagataagggtttactgtcttggccaggctggtcttgaactcctgacttcgtgatccactcgcctcggcctcccaaagtgctgggattacaggcatgagccaccgcccccgaccattgtctgtcaggtttaaattgcaccttgggttcgggtgaagttgatgatctattcctaatgcaggctcattcctaacagggcatccctgcacaattttccgctggggtgtgatgagctgcttcgcatcctgctaagtgtcctcgacagcgagcagacacatgtaccctgcttggtacatgccagatgattctgttgtagtgatattaaggacaacagtattttgccagaagctataacgagatgattctataacaacagcatggtgacatcagactatgttttgcaattttctttaatatttatgctggataaataatttatcttttttctcagttttttttcccttttctttttttttctccccatcttgaacatgttgctgtagacaggtgctaggtttccctgaatgactaaagcagagatttggttattttcctcccagaaaaagtagatgcatcagcagagttgagcccctgggcattatttccccaattccgtatcccatctactaatacaaactaatgagatctattaaggatgagtccacaagtttgaagggagtctcttactaatgttccgtctttgcatggtgttacaacagcgggaccattttacactgagggtttgcgagaggcatggctcccctgttatgtatttgggacttactgcagatgcttcctctggttcagggtgttgaggcttcgtgctgttaatattggaaggtgggtcatttgtactgggcatctgtcctgtatcttggagatgtttagtaacatccctgacctctagccattagataccatctctcccagtagggataataaaaacatgtctccagatgttggcaaatgtctggccttctggggagtaaaatggcccctggttggaaactagtgttccagagctacattcttagctgcttactgcatcattgtttttagccctccttttctctggcttccaggaaccaccaatcccccaacactaggatagggcataaggcaaccttatgtcaccaaattaatgtccgcctaggcaagctggactgcagaaagaaaagcagtatttctaccctaggatcattatcccaccttccccaagcttcgaaagaggtacaggagtcctcagaaatggggcttctaaaataagtggaactgggacctcttctctctcaggctgttacttgttgtggttccagcctattttctgagctgtggagcagggagggatctcacaggaaacttggtaatgtagattttggaggacttgaaaggttcctgctacctttggctggggatggagggaacatggaagatgggtctttgtttagaggaagctctttatcctggtacgctggaagttggcatagtcttagcagttagtccagatgtgaatttcaggattattctgtgagtcttccaagtcctgtctcagcagtgaaataggctcagtgtagcttatgtctaggtggctgagttcattttctagtctaggtaaagggcacctcctgtaattgaattgtgtaaaacctgcacagtggtacacctgagcccttttttaggacccaagagtgctgagattggctcttcctgagattccctctttaaggataagactttctgatttttcaactggatttaccattgtggcatctgcacatgagcagactgactgctttttggccctacctggagcctgggtcctcaggtagctgacccgagagaccgtggagctgcttgtgatatacaatgtcagtgctctgagctcattaggcgtcatctgagacagtggctgtaggggaggggaggtaggctctgagtcaagcagacctggaattttctttatgggccattaggaactgtgtgacgctggggcatctgacttcacctttctgagtcttagtttccttacctgttgaataggtctaatgatatcattatggcagatcagtgggacgattgagtcaaataacatgcccaatgcctgtttctcagagtaggctttcagtgggccacatctgttgtcactattattttgttctttctgccatttgggatgtgctttctgataatggcactaggctgccttgttgcctcctgcatgtagaacacagaacttcgcagtctctgcagagtgtctaaatcctgctctgggccagccctttcagaaacacttcaggagatcaatagttatctgcttacctttctagctgagatgagattttatgcttgttactagcagatcaatagtgaaagcaggttctgttaagttttttataggagtcattaatctccctcagcctcagtttccctatctgtgaagtgagtctaaccaggatgataatgaagagttaggtcaagtgaggttggcagccagacacccaccaccagctgtaacataagaacagatgttctctccagacccccaggtcagctgaggtcgctctgcttggaataatgaactgccacattgaggatttttttcctctctttacttggccaaatatccgagtgtggaagctctcactgtgaacctgctaacatacatttcagtgtctacaaaatgtcttttgagagaaaacagcagggacattcgtgagctcttttttttttctaaccactttcccagtgagacttcagttttcattctccccttagcagctttcaaatatgtacgtaacacaaatgttacatgtttgagcatttaaactgaatttggacagggcttctatttccagaaccttctaactctatttctttgtgacctgatagtcttgctctccagggtaaaagaagaggatggaaatggctgtggggcgcctgagctgggccctggcatgatggcaagatgccgttctgggttcactgggatggctcaaggggagtttggaaaccctcctaacatgtcatctgaaatctgggaccacagttccggctggaacacttgtcactaaagctgctgataagcaaagggtgtatcactggtatgggtaacagttgtgggaggaggaggggtctgacagatagccggatgattttaatgtttatattccactggggtaagctctaacaaagacccatcatttcccagataaccaattcttttaaaagaacatctgttgaaactggcaatttacattcttcttaaaatacggagcgacataattaaccctctggggagactaatattagtttattagagacaatttctagttctgtttatttttaacactaaacgatttgttcagattggggaaaaaattttttttttttttttggttgtggtggcgttggcttttacttggggttgacctttccttatcaaggacgtacaaggtgaatagctgggtgataatatatggtcccatgatcatcaaccaagcaccaacggaagccttttggaagtgcacagtattgtttaacacacaaataactcagcgtttagtaactttcaggtacaatcagtctattttaaagggacctcatgtgttattcatgtatgtgcacatgtgtttatgcagttacctttgtcttcattgatttggactcctttggtgctcgtaattggtgaaattctcttgtgatcattgttgtagttcccgcaaatctatttacggttttcacaaggaggtcacgaacatgcgttgttttcaatgctgggctagtttcagacttctggcttgttgtgggacggaggagaaagaagacagggcattttgatgtggcccagagaccaaatgaaacaaacgatcctctgattgctcagatgtcctctttgacttggaaagcacccacgtgaatgttgaaccatttggccctcagttctccgtcctgcagcaaactgcattgactcctgttttctacacagtggtcttcagctacaccttaccaagcaccccttacccagcaaacgtggcttctcttccccaggcagagcagtccgttacttagactaggaaatggctccgagaagctcacccatcaccatttgctctactgcaaaacaggactcattagcaggagctcataaaatgaaactggcagtgagctcatatggaagaggcatcacgggcaactcggcttggctcaccagcccctgagctgcccccgagtgaccgctccagccttctttccttccacctctccctcttggccaacttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagccttcccagacctttactcacctgggccattaatcaccttccctctcagtcagctgctacaccatgagtgcttttgtatcgtgactgtctggttacaaggtcatcttttcccctggatgagacgccccttggggaaaggaccaagttttattccctgtttaaccttggcctgacaacctaataggtgctcagtgaacagttcttgaatttaattctctccctttccccacactgatgggtatttaagctccagtggtactcgatgtgttgttttctttgttcttttttttgagacagggttttgctgtcacccaggctggagtgcagtggcagagtctctgtgcactgcagcctccgcctcccaggttcaagtgatcctcctacctcagcctcctgagtagctgggactacagttgtgcgctaccacacctggctaccgtgtcttgttttcaatgcagtatataagagggtgcattgtgtacctgtgggagtgattacagaatcccatcaaaatgggaatcactgactgaaaactggagtttatttgtaagctgggagatgggagctgaatttgaaaccccaggagaaaatagcatataaagtcattttaaataactatcatttgcagaggaggggggcacagatgcctccagtggcccaagactcccctttacacattgccgttcccttgccttctactcctcttttcattacccttatcaagattctgcagcccagggtgctgcttgttgatggacatcttcacctgactttctccctggtccaggtgcattttaagcatggaaggtgacacttgccattctcaatggacaaagggagtgggggtgtgggggtgtgctttggggttagtctctgggttttcgaaacttagcattctcagattcccagccaactggtttcacatgacaagtaaatgagcaacctggaagatgagtggcgtttccacacacagggaagcagatagttccattaggtgacagtgtgtgcacagtttatggaggatgaagcgggaaacctgagccacaaggcagtagaggttggacgagacactcattccgaaggcgggtgtgtatgtgcaaactgtataatttttttcttcttttctatctgctagcaaagtgggtaagttgacccatgacatcgtccactggagggaccacatttgtgactctagcaattaagcctcccttctcatctgtggataaaactgacctcccagtgtgctggagtcaaacatattcagcatccaatccacattggactgtttgcatgtaacgtacagaacactcattcatctacatctaggaccataacagcgagcaggagacagtccctgaccctggggactaagcccaggacctgccactaggagatattcatggaatcactgtttctcctccttttcaaagaagactgaatttatgatgaaactttcttcgtatattggctttgagaaattctgttttggtgcttatgtgctctggataattctcaatgactttcaaagttatgattcagggagtaattggttctgagagaatatgcataatcacatcaaggtgtgtttgttttccaccatttgtagccttttgacaaatttctgggggcctcatgcctgctaggccgaatacttgtgtcccttgagcctggagacggcaagtacccagtgtgcatgcatgcactcccaaagtcctttattcacgacagacatcactaatcaatcagtcatgcttagcatactactccaagtagtcattactaatcatctctagtcagcatgggagatactctttaccatcccggtaaagtgacgttttgatgaaaacagcatggatcttcctgcagagaacagactagccccctgtacagcacacaactcggggaattttaggtttggtgatttactgctgttggagcctggacttcttcctgggagaaggctcgaaaaacttcatgtcagttacttaatggaataatacatgtttcctgcttccattgtcttcctggacctgacactcactctttaaccataagcagaagacacatacacaaatgtcctatgttaagaatctttatttaagacaggtggctagcattatttgggtccagaagcttccctggaaagaaaggattcactgcaagatcgacaggcttacccagttcatttaggcgtggcttgatttatgcacacaaagctttgggaacatatcagtcacatcaagctaggtccacctgtgtgagtaactaacgtgtttatttatgattttctttaacagcacagaagagcaattgcatttggtcattctagtatcaactgagttctttataaaatatctttggggtgtttaaggagaattattctttttacaagttctgattaatgacaccgcaaaaatgaaaataatgagctaatatgtatctagtacttgctatgcacttatatgtatagaagcgtataatccacagcactccttctgaatacgttacgtaaatggaaccctcgcaacagtcttacccccattgtagagatgagaaaactgaggcatacagaagagatggaactaggccaagagcatagaggtggaattgttgtgtgagcctgtagagtccgtgttcttacccactgcatgatgtctgatcatcgtcaattttctttccatttggatagatgaatggtaatacttccctactaggtagagcaatgattccagaagtttataataattggaaagtgtattagtcgattctcacactgctataaagacattcctgagactgggaaatttataaagaagggaggtttagttggctcgtggttctgcagactgtataggcttctgcctctcgggaggcctcaggaaacttacagttatggcagaaggtgaaggggaagcaggtaatgtcttcacatggctggcagtggaggaagagagaaagtagggaggtgctagatgcttttaaacaaacagatctcaggagaactctttcacaagacagcactagggggatggtgattagaaagcacctcatgatcccgtctagttcctgcagagaacagattagccccctatgcagcacacacctttgtgaggtcccttctccaacacagggattacaattcaacctgagacgtgggtggggacacagagccaaaccacactggaaggtaaaaaagttggcaaccagaggcttagaggaggttcaaatctcaaagtgatgtctttccttttgcattttggatggtttaataaataagattgatacaaacacaagcattaagcaaacaaaaggaaataaaaacggcaacaaataaaacttctgtgctttttgaaattctgtttttggcaggcaacattccaaagatctttttcatttaaagtccaggagtcttctgtgtgaaccccacacaggtaccttggaaagactgcatctcctggattttgcatggttctggcttaatggacaacatatcagtcattttttgaggaaaataaatttaaggcttggtcatcggtccttgagtcagcacattgagcgttttgtcaattagctcctccccccatctttatggtatggcttttcctgtaattacagtcaagatcctatagccggaggaaggcctgtcaattgagtaagaggctgatgttcatcgcacagtgacagcccattcggagggttttaggcctgtccttagagaggcttgttatttcctctttcggtactttgttgcaacccagctcaccgccatcagatgagtggaggtttcttatgctgtggcgaaacccagggggtcaagcccctcggacatgacgtactgcaaagtgaggatgtttcattgatttatatttttaaaattaaaaataattatttaagctgcatctgtgtgcttataagaaaagatatagaaagattagtagtagactgttgtgttcttttttttttttttgagatagactcttgcctgtcgcccaggttgcagtgcggtggcatgatctcggctcactgcaacttttgcctcctagattcaagcgattctcctgcctcagccttctgagtagctgggattacaggcgcccgccaccacacccagctaatttttgtatttttagtatagacggggtttcaccatgttagccaggctggtctcgaactcttgacctcaggtgatctgcccgccttggcctcccaaagtgctgggattacaggcgtgagccactgcacctggccagtagtagacttttgatagggttttttttctcaaggtgtagatttggctaggaagtcatagaaaatggtctttttttttttttttggagatggagtctcactttgtcacctaggctggagtgcagtggtgtgatctcagctcactgcaacctccacctcctgggttcaagtgactctcttgcctcaacctcccgagtagctgggactacaggccaacgccacggcacctggctaatttttgtatttttagtagagccggggtttcaccatgttggccagggtggtctcgaactcctgacctcaaatgattccctgcctccacctcccaaagtgctgggattataggtgtgggccactgtgcccggccaggaagatggtcatgttttactttgaaccaatctgtgcttggtttatttttttcagtgagtgtggattacgtttataattttcggttactagttaggtaaagaataaaaattaataaacacatttatagttctcagagattccttgagagaggaacatctttaaacggataaccacagtcttctaaacacctgaaagggtgtcttttgctgaactatggagttttagttttgctttagaatttttggatgattagacttgtacttcttttaggctatttttccacctggtactatttggctttactgactgccctcattccccatacaccaccttgttttgttcagattcccctaaatcttcattctcgtcccacctccccatcactcctgactacttgaaacacgacttctgtcctcagaaggcagcagtgttccctcctcccgttcatttttcattttcccgttgcttaaaaaaatcaagcatatgtttgcagtcatcactgatgttctgcctcctcttctaaagttatagatgagtgccaagttggcagagcatgtagaaagatcactgcagatgtccttgtcgtgttgaccttattggagaatttcctatctgtgatgacctgtaaatggaatttaagggaggaatcaaacgtgttagcacggggttggcattgcgtggctgttttcaattaacttgaccactatgataacatcaaaggtgtgtgtaccattctatgaccattgaatctccatggacatgttttgggaaatggatttgtcccattacactgctttctttagtgcataagatcttgaagggagggatgcattctatgcaccccaagtttctggtttactcgtggtttcaggtgtccctttagacaacatcactgacaactcactatgtaaaaccaaacaaattattagctttcttactgtgtgtttgcatttgctgtgcccagggaaatgggaagtgcattgaggaagaggccccaagacatggagaagtcactccaactttccggaaaccccttttgctgtgccatgtgcatggaaggagaggaatgaatgactgttgaagccagatggccttgctcattgattctctcctttcccgccctctcaagccatccagaaggagaatgaaatgctcaaatcaagggagttaactatggcaaagatgttagtaatgggaaactttggaggaaggcaaagtcagaaattattctgcagggagatttggggatgttggatgctaaggcccaagccgtctattgtatgccttttgctttggcataaaacaacagatgaccttctgttaggtgtatgtctgctcatgcttgagagtggtggtgtttggaaagactcaatagcatatgcacatgaggaagttgaccaaatgattccacagcacatactcatttttttgctctgattctagcttttcctccaattttattcagaatttgttcttttcttacctcacaccatatagaaaaatcaactcaaagtggattggagacttaaacataagatctgacagtgtaaaattagtagaagaaaacaaggaggaaagctccatgacactggtctgcacaatgagtgtttttgtatatgaaccgaaaaacaggtagcaaaagcaaaaatagacaactgggattacaacaatctaaaaaatttctttacagaaaggaagcaatgaacagagtgaagcagcatcctacagaaagagaatatttgcaaaccacacatgtgataaggggttaatattcaaaatgtacacacagcgtaaatgcaagaaaagaatctgatgtaaaaatggcccttccaacatctagcattattgtgtgttgaataaatacttgtttgattaggtctaatcactcttcatgattggatttccaaaatgtggactctcagcaggacattacagggacagtggttgggtctggagatgtcacccttagctgtttttcacaatgagaggttgttttatcataaataaatcaataaatggtagattatacaccggagttactgagaattataaaaaaattaaaaaagcccacattttaaagggaatttggtatttttaacaaagcatcagggggctgggagcagtagctcacgcctgtaatgacagcactttgggaggccgaggtgggcggatcacaagatcgggagatcgagaccatcctggctaacatggtgaaatgctgtctctactaaaaatacaaaaagaaattagctgtgcgtggtggcgggcgcctgtagtcccagctacttgggaggctgaggcaggagaatggcatgaacatgggaggtggagcttgcagtgagccgagattgtgccactgcactccagcctgggcaacagagcaagactccatctcaaaaaaaaaaaaaagaaaaaaaagcatcagggttgtcaccatgaagcaggaggagaaaaataatgctgttagacttcttaaagcgtattttgtggtttattttattgctctgtaaattgcaggctgtaattcatggggctcaggccagtgatttcacagttgatagaccaggcacatctcttcccaccccttccccacctaggggcaaggttttcaggaagagccccttttctaaaccacacatggcctgctcacaaatcttatgataaaactctacccactgagaagcacaaggtgtgaggctattgatgaggagttgaaggtgacagagaccgagaaagtgctgcacacctttggcctaaagggtaatgagcaacacacaaggattgggagatgttcatggcaagaaaaattcagaagggacattgttgtttcactaattctgtaaaggagagcagcggcatttacttaggccgattccccattctctctttctgtttttaaacagagacagatcttgctctgttgcccaggctggagtgcagtggcatgatggcatgatcatagttcactataatctcgaactcctggtttcaagtagtcttcctgccttggcctcccaaaatgctaggaatacaggcaggagccactgttactggtctgttttttttccttaaatacataggcaacttcctcgattgtctctcctttattggcattgagagataagcacaataatgattgttaagatggaatattatgaaggctcaaggaatacttctgaaggctttttgtctatgaagtacacgaggtttcttaatagtttggcctctggcaaaaatggttttattgtagtttcatccttgttgagtcaataattaactgagtttgattaaagctgaattttcctaagtatgaaaaccatgtgggcccttctctttcctcgtgatgcacggtgatagtgcgtatctaacacttgaaggtgtccacgctggccctagctcagtgagatggctttgctttgggggggtgagggggcggaggtggtggaaaggcagcaagctacgatgttcttatgtgtgtggccttgcttctggtggtggggtggcacacatgctctgtagtctttctggatgggtttggcccacgggagaccccctggctgtccaccagcccctttgtgatagtctcatagtcttatttgtcttttggcttgtatcccacctgttcactttttaccatagctaacctttctaagtggtcaggtgggactcatggagattttccgttctttggcaactagcagcgactgcagattactcatcagctgtctccttgagtccacaatgccgggcggtggacgggcttcctgcctcctggcccagggcccctttgccggctcttagtgtagagcactagttgtaccatctggtagttgtttgtgcctgcgactctcttccctattaggctttgactccttaaggataagaaccatgtcttattttttttaatctgtagctccagtatccagcccaggacttgacaccagcctctgtcaaatacatccgtggaacgcatttgtaagaaatcgaggccaaggcactggaagtcccattgtctctggatgctgagaccttgaatttcatgccatggacccctcccttacattccgtctttaatgtgctataaatagacattcctggccttgcctaaataggattaagtagtaccaaatggtccttaccgttctgaggcctcactgagactcattttgaatctttaaagaaagcagtagagggatggagaagaagtgggtcaaaacctggtttctgcctgtgggaaaatacaaaacaacacaacagcaaagcagactagcatggttcaaagcacacattgaggtttttggtgtgccattctaatgcatgagctcattttgagccaaggatagctttttggtgtagaattttgccagtcctacggtcaatgcagtactaattgtgtgtgtgactttgtgcagtggggaaaggtggggctttaaaataaaacagaaggtatgaattgcttggcatttgctgtggttcctaagtctccattccgcttgccaagattaaattgaattattcccgctgccattcagttttactctgcacaaaatacagccaacatttttgcatttctttcttccttcctccttttcttctttccttccttccttcctttttcccttcatctatctttgttccgcttttgtttgtttttttttagatcgctgcatgctgccgcgttgggttaaccatggtagcattttaccatgagaagccatagcaagatgtgccaggtgcatgctgctggaacacctggctgaggctccaacagcattttcctatgactgagggtagggtaggtagatgactcattacaatttataaaatggggggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgcctgtgctgggcctgctaggagtcgatattttctggctcaaagaagttccaaaagaattcaaagccagtgtgtctctttctctggacggccaagtgatgcaggtaccacgcttaggtctgctggtgtttagcttgacttaaaacccagccagggaaatatgtttcactttgctggggtgcaggtggaggaggctattattcttaggcatttaacagtgaagaatgttgggcagggcagagggtcagctgaatggcagggattccaggtctcagttaatgcccacaaatttctgaactttgaacataaataccctcactgcaatacatgtttttctttctctctctttctttctctttttttttttttgaaaaacttttttggagcagcacctgcatgttgtaaaaacacaaaataaaaaaaaaataaataaaagcagaccccttggttcagatatctttgtttgtgtaaatgttttggcattctttatgaaaatcttcagattttcaagagcttaagatgacctcctctagccggctgcagcagtgtctaggtatctgtgaatgtgtaagaaattgagacagcctgcaaaatagctcacccagcttttctttaaagttccaacctttttgctggctctctttcaaactgtactgctcactttgggctgtacgttagaaccacctgagaagttctttttctttcttttttttttttgagatggagtcttcctctgtcacccaggctggagtgcagtggtgggatcttggctcactgcaacctctgtctcctggcttcacgccattctcctgcctcagccttccgagtaactaggattacaggcatccgccaccatgcttgggtaatttttgtacttttattagagacagagtttcaccatgttggccaggctggtctcgaactcctgacctgaagtgatccacccacctcagcctcccaaactgctggaatctgagaagttacgtgaaactagcgatgccctgggctaatgaaatcaggctccatggtggggaaggatgttgcggtggggttggggtggcaatgaaaggtgaaaaccactgtggtcccacctgcccatcgtcagatttcggttcctctcagagttaacgtagaaggtttctgggggcatggacctgagtcttatcccctttgcaaaagtaagaattgtatcgtagcctgactcagggttttagccaacttctctggatgctaatgctattctcttctttatacttgtcttccttcccaggcacacatccactggagctttgcagggcctatctgcccttagccctccaatatccttttcattttctttaatagttttattgatatataatgtgcctaccatataattcatctgcttaaggtgtacaattcaatggcttttagtgtattcagagtttgcatccaccatcacaatcagttttagaacattttcattaacccaagaaaatgaccccttagtcatcaccccaaatacctcctctctccagttcctggcaaccactaaccaatctacttgctgtttctatggatttacctattctgcgtacctcatataaatagagtgatatgttagtcgtctcttgtgtctggtttcttcctcttagcatcatgttttgaaagtttatccctgcgacagcatctaccagttcatcatttctttttgtggctaagtaatacgccattgtatggatataccacattttgtgtatccattcattagttcatggattttgtgtctattatgaataatgctgccatgagcatctgtgttgtccacaagtttcagcatggacttctgttttcattccaatatcctttgatgacatgtcttggcagtgatgtctatgacactgggcaagtgtcttaaaatgttgtgcatcagaaaaaagtcatcattgccaaggccagcagatctcgaaaagggggctgggatacgttggtgatttttttcatgctctacttacagtatgactcgtaactgttaatggctgagctcctccttaggtgaagaaggaaggcaatggcgttttctattctgggcctccctgcttccagcgatagcaaggagcgaaatgagatgctgtctaagaaaggaaggtgctgcgatctttgattactacacagcctcggcagtgtttgtatgattaatgagtccatgtttcagacgttcccatttaatgtatttgagccttctaacaacattgcctttcatatgttgctgactgtttttgagatttatgaggcctaactcgcaagcgatgtgtgtctggattaagagaacctgagaatctctatttatgtctgaccccaggaaattccctttaagctgcttatcagaggtgcatgctgagagcatgatgggaagatggagtcttccatccgctggtaaaatctggaatctgctctcatttcattttcactgaactgaaaataaggtaacagaccctcaggtctacctataagtaccttccaactgttccacttttgtaaatttagttcagataatacatatgctgaaattcctatatcccccccatactccagatcttcagtgtggaatttaaatataattccttattgtaaaaaaaaaaaatttttttttgatcaaggtgattttgataaactaaatgcatctttaattttactcacagcaaagcgattctttattttctctctaaaagcataattgatgtgccatgatctttgtctttgcatttttaaaactgaaagaacatttccacaccattagaaataagatttcttcttaaaaatattcacaaggtgcaaacacttacatgtgtatatgcatgatttcaccaccagggggcattgtggtttgactgtccagttaaagagcctgtgttctatcagtttacccagaaactagaaggcctgcgagtatttctgattccttccaagaaggattcatatctggaagagaacagatgtcgactctttttcctctctagcaaacagtagtgttgtcaaatttgctaaacttagccagttgaagattaacatgcaatatataatatgcatgcgactaagtgtacaataaatagtaaatcacatttttatgctttctctgaacttggaagctgcaagttatgttttttttattccctgggtgtgatgaaataaataacattcaaatacatcttaaagatgtcagtcagggggaaaaaagtgcttggcaactgtgtttgatagatttcttttatgattaattctcctattaagttttaatgacttcaaagatacaaagctagaaactacaaaactaggcatggttaataaataactgaaataccaggtgtatagaaatgcatctgtggaaaaatgaaatcatgtattctctaggatatattaggaaatggctctttggcaagtctagagggtaaagtatccctgaagggggaaaaggtttaaaaacagtaaactaaagaagattgtttttctgaaagaaattcccaggagaaaggtactttctgagattcacatatgtagattacattgttatgaaccaacatttataagcaagcttgatctctcagaatgcgtttgtctatctcagattttcaagaatcctcatacaaattgtccagggtttccacctcgcagttttcttccagggttgctatggcatggaaagtacattgctattttgttatgtaaatgctcaacagactggctcattccagaagtgggcgtcgtgatgccagtgtcttcgtaatactatctttctttcccctttagcacccagaacttatgaaatatgactcggtttatcctgaacacatctctgtgcatcggggaggatgggagaattaattccagtttctcaattgcaaaagtgaggctggtcatggggcttggaaccacgccacggacgcatgaagcctccccgtttacatgccaaatccagagcttatgcatccgtgctcagggctctctgtggtaggcaacagctggattatttactttctagaatatctcgagttcttaatctgagcagtttcgaaaccaaacccacattaattaatataaataatgactgggaaacgttgcaggactccccggaaaagaatgtataaattgatgtgtttttgtatatgcttatgtatatgcctttgtgcacgaaaggagataaatggtgtatttcacacagttccttctcctcctctaagggatattattgttcctgaatttttctgagccgccgaagcacaatagggtttagagcgttcacaccaggcagcccccactcttcagaacttcaaatctaaagatcttttaaatacacagaacttacttttgaaagctgtggcccatcccaaatgaattctaatcgtcagcctctagaatgcctggagtgagaaaacagaatattgttcttttctgtttatattatttcatactgagttaatacacttgccaagactccgaggcagcttctggcttgacaatgccttctttaactagcctagtttctagaataaagttcgggtccaccaggccctctgagtggggctcaggacactctgagatggaagagactggagaaagccaatctgtttctccctgaaaatcatcttacttttttaacgcttcgtacctagatttggcctgggcagcccagggagactgttcaagcactggatacctagactctgctgggctctagagaagtgctgggctacagcgcccagtgccctacctcttggggccagccagcctcaccaaaaaatcacgcttctggcttgctccaaactcaggaagttgctgggaagtctggctagcaacaccctcattcccagtcctggccatgcctctctgctctccctagcacagggagcatgcaggcttaaggctggaagaaaccccaagcatttggccaggaagaggcaactagttccagctggcccacatactacactttaaaaattacccagatgatctgattctgtagagagagtgggtggagaggactccagggccatggaggaagattcggcctttctctccctaatcatgagcaatgtgatttggagagagaaggacccggttggctctgcaaaccgcatttccttggctgaacgccagaggagagaaatgatccggcaagaagacacaccattccccgtcagccccttcccgacccttgcacccctggatcttctgctgagtatcggattggtctgcgtccaagagctcctcgcttggccagcaggggctgcctggagaaggggaggacaggcttcgagttttttgggtagtgacttctgtggacgtgaaaagactgcaccagaaatcggaggcagccctccaaacataacttggcctcttcgttctccctgtggacacacaggctgtgttctcctggccaagagtccaagcgtgtttttggcgcgtgctgacactctatatcgcttttgcttcggaaacgaatctggtcagtgacttagccactctataaaaatgaagagcagagctcgagtgcttataacacgtcatttttacccaagacagagaagaaaaacgaaagagagcctgagcattcctttgactccctccacccccggaaggtatattcagagtctccaagactgcctccgcccactcacatgtttatggcccggtgagaccgcatcctccctttctatatctgtcccttttctggatgcagggacacagaatcccctaagtgggaagagctttggagtggaggctgttcaaagttctgtggtgattaattattacctacccaaggtctggtcattgctatacttgagttcttttcaggctcaagatctctacctttttgtgtgtttttttttttttttttttttttttttttttttgtacagagtcttgctctgttgtccaggctgtagtgcagtggaacaatctctgtatgctccctgcaacctctggctccaggtttaagtgattctcctgcctcagcctcccaagtagctggaactacaggcacctaccaccacgcctggctaattttttgtatttttagtagagacgggatttcaccatgttggccatattggtcttgaactcctgacctcaagtgatcctcccacctcagctgcccagggtgctgggatcacaggcgtgagccaccgtgcacgacctcagggtcccttctaacctgtgctgttgtcataaaccctggaggagaagcaagatctttctagcaggagcaacatcatcccaaataaagtgatagactttgatagtgttcttctattcattcaaccaacagagaacaaatgaaaagaatcaggagtctattgaggagacagaacatgagtgatttctgtgtgctgactatatttaaagacaagattagcagtaatatataaacgtaaataagaatttttttccccagccaagaaccatagattggacttcacattcaaaatgtaaattgtgcctaggaaacatcaatgcttattttaagcaactgacccttgggataaaaataaaaagtcaaaaggaaacaaacaatgttgctgagaagtgatagaatattctagtttatatctcagtcattttacagctctggcatttctgggtaacactttagaatacttccactccggttggtccataaaaagctgcctgtgtttttatgttttgaaaatacacgcagagagacccactgcatgtcctattaggcatcttatccttgagtaagcaggcatgcaacatcagtgtcacacacatatcacccccatactcgacattctttgagaaatgccttggtcccgtctccagccagatcagcattgcacctcttggcatgcgttcttacctgttgaggatttgcttgaattataatatggtagaggaggaaacacagtcttactgtgccgtgtgctgagcgcagagccattctcagcatcctgccttgattaataaggcgtgaaagatcctccgaattcgcacctgttcagacaagcttgtccaacccatggcccccgggtcgcatgtggcccaggacagctttgaatgtggccccatacgtatttgtaaactttcttagaacatcaggatttttatgcacggaccttttatgcatggactgtggtgttttttgatttttggttgcgtgcgtgtgtgtgtgtgtgtgtgtgtgtgtgtgtgacggagtcttgctctgtcactcaggctggagtgtagtggcatgatcttagctcactgcatcctctgcctcccaggttcaagcaattctccgtgtctcaatctccctagtagttgagattacaggtgcccaccaccaagctttgctaatttttgtatttttttagtagagacagggtttcgccatgttggccgggctggtcttgaactcctgatctcaggtgatcctcctgcctcagccacccaaagtgctgggattataggcgtgagccactgcgcccggccttttttttttttttttttttttttttttttaacgctcatcagctattgttagtgttagtgtagtttatgcgtggccgaagacaattcttcctccactgtggcccagggaagctaaaagattggacacctgtaaacaaaaacaacacagccatctagctgcaagacgtagctaattgctctgcagaacagggttggccagcctggccttgatgtcggagtgttctctagacctcacacccagtccctattcttaggttttatttctcaaaccaggttttgcctgagaaattacagcaaatgattcagagcacaatgatgttgctcatttttgataagtagttgaaagctgatggtgccctccatttcaaagcaacagaagaaacgctggtggtcatggagaaagagttgggaagcagagcgtgaatgccgggatctgcagatctgagcactatgcctgcagccgatgtctctccacagggctgatctggtggctggggtgcccctggtcagaaggggtgattactgtttcctctctctccttggtctctgtcaaacctaccaactcttttcaggaatgcagatatttaattatcttctgctgttacatctgcatcatgtattggctggctgttcaaaagtatcctctctaggcaaataacgagatttcgccagcaggatctcccgttaaaggcgtgcatgtgtggctttgtagacacgtatgtgtgtgtgcgtgcacacctgcctgcccttgcacagtgggcactgtttccagtgtgcagtgaggccctcccttcgtgtagaacaggacaggacaatgacaaagttattcaattaataattgaagcttgccgggcatggtggttcacgcctgtaatcccagccctttgggaggccaaggcaggcagatcacctgaggtcagaaattcaagaccagcctggccaacatggcaaaaccctgtctctactaaaaaatacaaaagttagccgagcgtgatggccagcacctgtagtcctagctacttaggtagctgaggcaggaactcgcttgaacccgggaggcggaggctgcagtgagctgagtttgcaccactgcattccagcattggtgacagagcgagactcagtctcaaaaaaaaaaaaataatataataataataataatcgcacctcaatactccgtagccattttaccgcatgtgactattagctgtgcttttgcggttatctacgtctgttgtgtctatacggtggagtatttgcagacgctctgccagtgtgcaatgcttcccagccctgcattcagggataccaacttgggtgctgaaaagcagcgatggcaggactatttacaccacggaaacaggcaaaaactactgatcaagccttcactgttttgtttatattgtcttgacttagaaagtgattgcaatgttaataatgcagattaaattgaagcgtacagtgcctataaaccattacattatgaatagtataaaaaattgaggaagccgtgtggctcacaaattcagcactttgggaggccgaggcaggaggatcacttgagcctgggagttggaaaccagcccaggcaacatagtgagacctcatctctttaaaaaaaaaaaaaaaaagaaagaaaaattagctggcatggtggcacatgcctgtagtcccagcttctggggatgctgcagcgagccatgattgtgccactgctctctggcctgggcaacaaagagagatcctgtctccaagtctgtctgtctgtctgtctgtctgtctgtctgtctctctcggaaatattccttcagtgtattagtaaagaagttacttaggagtcacttatgcccttgaagagtgagtgatgtatcaaaatatgtctgtctttattgtttcactttcatccttctttttttggagatggagtcttgctctgttgaccatgctagaggtggcgcgatctccactcaccgcaagctccgcctcctgagttcaactgattctcctgcctccgcttcccaagtacctgggattatagacacccaccaccatgcacagctaatttttgtatttttagtagagatggagtttcacccttttgattggttggccagtatggtctcaaactcctgacctcaagtgatccacctgcctcacctcccaaagtgctgggattacagtcgtgagccaccgtgccggccactttcatctttctgattaactgaaaagtatcaagcaatacttacatgtaactgcactttctcatcaactgcaaccataatttagctatggatacaagagttgggcacaaatccatgaaagcattgagtgagaatcaattggctctgtgggatttacaataaagaatgttgtttatttttatttgtaaattgtgtgctacagatccttcgtatcagtaaaatgtatgataaacatatgtgtgtatattcacacacaccctttcattttggcaggagtgtttgttaaacatttaccacagcagtggattcacttccatcagctgctaactttcaaggatgtttgaggatgcatgacctgtgcaatgcacctgcttcggtgcctggcacagagtcgcaaagccacaaagatggtgcttgttggttgtatgtgttgtttccatctgatatcaccattgaggggagcaagatgacatgtgcctaccccacgtgtccagcagcaaagccacctggcatagtgggctgctcagcgtgcctggttcatactgcgtgtttatagtcccagggtgttttcagagagcaaaagtcctttatgattagcaaattgcaggtcctcccctttctgatatttacagcccttgcaaccgcctgtacaaaaatcgggaaaaggcagaagacggctgtcattaatgtaaaagcagctggttacctccccctccccagcgcacacatcacctcctagtacaattagtcaccatgtcttttcccttccgtcaagccttttagcggagttcacagggatgccttcggtccagacactatgaccgttgacgaaggatttgaaatattttgagaactctgaaataatgcacaccagaaacgtccagctgaaaacaaaaagggaacaagatgacattttgcaatcccatgcacgttgcaggcacgttgaatgtgaaggtcagtagtacttcagagggcaggcctgttgcccccaagcctgttgcctaagaaatgcccaggccctttgaacaaaatggattcgagtgattacagcacgtcctcacttacatctcccaatatatttcttgttattctcgttgagtactgcattcagacagaggttgccaataaagtttattgtaggagctaagtgtcaatatctgtagtaccccccgcctagggtgctgctaataaaatgccacagatagtctgggagaggcatgaaaatttgatggcaaattgatttcaggttcatcttgaaatttgtcctcagctggactcgatacttctggcagacatgggatggcttttgtcagaagggtctgctggaatgagacagagatgtcttgatctgaatattaaatacaacatgctgtttatgacattatccgtttactgctaaaatacccagctacttctgtttacacattcttctgcgttgaatgggtaagatagcatctcatagatccactttacatatgaaaagaagttgtatcaaacttgctgggcatcagaaataaagggttttagagacactggcttcaaacacaagttattccatccaagattctaaacttagcaatgcaacttgcacttaattttaaaacgctggaaaaataatgataaagattgtgtgatcaagtatagcagccctgtggtgtttcctcagaatggtgtattacagaaaaggaaaaagccatatacatggagaagaaactcccgatatttaatattatcaattgctggttcctgtaaatttgcatttatggatcacattataaaagcaattactcttatggattgttcatgcagaaatgcactatgatgataatatacttttaaaagtatatttatttccagaattcaatttgtaagaggtttgagggaaaaataatactgagttttgagtgtttctgattttaaaaatgtgttgagtagaattaaacgtgttcaccaaaacccattttatcactttaaattattgggcaattaattgtatttacttagcattgaatgcatgattagaaatggaatttttaaaaaagcaatactcaagtggagtgagttcatttgttcattcagcaaataggacttgagtcccctactatgtgcggagccttaaaggatgagaaagatttctgggtgggacttcaatgagactcatttcgcaggttttcatgttattatgtatatgtggtaaataattaattttttcacaagtacttgcactagtgatgctaaaataagcttgactggcttgtaaatcaatgaaggttactgttgcattgctttgaaattgaatttaaaaacagaaacagagcagtccctttgcttccgaatgcagccctcccattggaatcactttggaagaatctggatctgcgtgttacccagtcttacttttcaggcagtcccaggcaggaaggcccattagtgaaaagagccctgcatatgctgtgggtcatcacagctgctgctttgcacatttaggagatatttgtggacctttcattaggacaatttttatggcccgagattaaaagttaaagttaagtagtaaacgtaatgaacatgtgcctttggagattccaactggtttgtattttcattctctccgttggtcatggcccattgaattttgatgatagcattaaaacaaatgcctcaaatcatttttggaaggagacaggatatgaattgacaaattaataaaataaattatacttcaaagatgctaaattatctcttctatgtaagtaggaggctctcttttcagatgtggaatttgtaggagcttgaatattctcaagagagggtatgggcaacatttgataaaagatgtaattattgggtcgtaggaaataatgattgagatagggtatccactgccctggtgggggaatcagtgaggctaggaatcactggaaaatgacattccttgagactccttcaatgggtagagtttgctttagcttttcatgtatcttactgtatgatggttgcttttgggttgaattccaccttgggttcaattcaacatgaaagttaaccttttggtgaaggaatgatccaggggaaatagtaaaatattagcctgtcctccaatacaaattgcctgtgagtcccactgatacttacaaatatacagaggtggtgtaaaaggattctgtgtcaaaactattaatatttgagaaatacaatacttatcagagcctttgtatgtaaatgtctcatatacccctctaagaaggggagcgaatagtattttccaaacttacgtcaccacttaccatccacctgcatactttacacgtcttggaatcaaccttacagggaacacttggtcgaaaaacagtgttttctaaatttatattacagttcccactccccccccccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacctattctgttaatagaatgactcaaaatcagccaaccccataaatactgctcaagcatttagaaagactttctctatagaggcttcagacgtcagaaaaaaacttagagagtgactttcagatacagcaacctagtctatgttatagaacattctaaaaagagcagattttaatatctttcctcccacacttgctttgactccctcctttagtaattagataattatgtataataagcacattaattatgtgcaacagctgccattgagtgtgtgcatgtacaactgcttgaaaacagcttgtgagttcactattaggtccatgaaatttttctccttggcaggttttcactattagtttgcttgacaaaggatagatacattttccatgtgtggaggtaaaagcagtgcagtgagctaaaaagttagcaaaggtgaagtggtcctaatctgcggccctggtacacttagataggcatcattgcctttcctctgagctcttggtgctgataacagcttccttgaccgataagtgtaccagatttccttacctgtcccagggcaagatagcaagagtttcttgatgcatttaaaaaatgcatttagtgttggcaaaaggctggcaatttattattaagtggaataagcagtttaaaaacagtatgtacagggtggttttctggctatataaacacacaggcattgaaaatagatatacataaataatgttactataatttgtctgcctcccttctctcagaaaagaccaatgaattatctattatgtgccactcactatttgagtgctgggaatacagccccataaagtgaagtttcatatatcaggtagcaagatggccatggtctgtgttttgagaatcacaggcgtttttgaggctcatggctataatcccagcacttggggaggccgaggcaggtggatcacctgaagtcaggacatcaagaccagtctggccagtgtggcaaaaccccacctctactaaaaatacaaaaaaaaattagctgaacctggtggttcacgcctgtaattgcagctactcaggaggctgaggcaggagaatcacttgaacccgggaggcggaggttacagtgaaccgagatcgtgtcactgcactccagcctaggcgacagagcgagaccctgtctcagaaacagaaaataaaacaaacaaaaaaatactattccatagctgactattttctgaaatgattttgttacttttctaatgagaaaaaaatagatctcgtgtgtggagggaattgaagatgtaatttcagactctgcgtacagctaagctcatcgtagttacttaactaacacttaaggaattaaatggcatatctgtgtttgagaggcacactgagatgagacaccagctctttttatttatttctaatggtttgcttggtgtactggtcatttccccggaagtgtgcaagaagaggtaggtgacttgcatgttgtctatgaacgtttttagaaacgtctggtggaaccatccgggcatcacatagctatctctgtgcagagccaggccggatgcctaggtgagatggaaagcttccgtcagctttcttgccggcctctcctcgcagccgctcccttccacacctgccttttcacctgccagactgcgcgttgcccgttgccctaggtctgcgtgttcagcacttctgcaacagtttcttctgcaaaggtaacttagcggagggtacagggtcttcttccaataagtcagcaccttcagttaaaaaaagcaataacattctccaatcttggcagtctggcaaggtagaaagacacctgaaggtgaacatctttggcccatgtgaaattttgttacgtgttgttaggtttcatttgtctctcagtcaatcagtcaatcaatcagtctctctccttccatccccccttgtcccccttttctcttctctccccttccctgctccctctctttaaggttttctcacagattaagagagtagcatgtgctcatcccaattattgaaaccgtgcaaatgaatagcaagaaaaatagttcttggcgtgcccctttctttccgcagtgcccaggccagaagtacctgctgcccaagaccacagctgacagcgccccgggagtccttcacactcttctctgagctcttccatccttaaacagacatctatgccaaatgcagggagggtttgctgttggcttttacaagaacactgtcctgttatgcctgctgctctttgcttggttttccctggacggtcacaaacatacctccaggtcaacagttaaagagagaacccacttcttctaatagttgtgtaatattccatactacagatattctgttatttatggtagctagatttctattcatttttaattcccatgctcagagctttccagacatttggaaacattttagaaaattgacatcatctcttcaaatatctgaactcagatttcctctgtgatgttggaatctttaaaatatcatgcatacttggcctgtttctacaattttgttccccagccatcgttctccattttgcacgtgtattgtctcctcctattcctctgtacccttcacacgtgcctgcagggtatatacttttgcacaggcaaaagtccagctgaaatgatccttacttagcataatttaaacgcgagggtttcctaatgctccttccatttaaataattcaaaaatccgtggcaaggtacctgaaaactactaagagaagagaggtgttaatggacacatcattgaggctgaagccaaactgtgtgattctgtctgcagttgagaactgtaagaaaaagatcaagattaacattattattattggtgttacctcatgtctgtacctttttggagacttgggtctgtttcccgagaaatcatttttcctcctccttgaaaatagtgaatttcaagtggttttaattttaactgcattatttgtttgctttatatagtttttaaagttttatgaaaaagtcttccatgtgttttttatttatgaaatcggggcagccatccttcaaatatgaagcaggtatctgagaatactaaaatcttacagtgcattttataggagtgtgaatgatttttctgcaattgacatatcaaggagcttatcatctattattaagttaccttttcctgaaacaaaatatttgtcagatgtaacttggtacccaaatgccttttcttgctaaactaggaactgtcacacacacccacccacccacccctttattcttggttctctcctatattttgacatttgaagcatccacagaaaagtaatagaatgagcaattgaaaatcaccagaactgaaattatttccagctatgtttaaatatgaatgtcttgttcgacgcttcgcatatgtatttatggctgtgtgatatcattatggcatcctaatgaatgtctactgaattatgtgggattcaacaggggatacaaatggatttgaattctgtaactgtcatattgtggtccggagagggtggaaactgaagtatccctctgcgtcgccacatctgtcaaaagtcctcagcgctccccgcaatccatgtctggtggaagcgcgaggtggtgaggatggaaagggcatgcgttgacttcatgttgggacgggtcttaaactaaacacatgtcacgttatggagctgtttaccttggctttgaggtttatttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggactgaaaagagaagtaacagtccttggtttgtattccagcccccaccttcctatgtctttgagcttggtaattagatgcttggagcttcagtttccccatctgttggatcagaacggcagtatgtgctctccagtattttcataagagtcacatgaaatatgtacctacagagtctatcactgtgctttttaagttggggcttaatatgtggtagttgttgctgtttttgttattattattattaatgttattttttgtttgtttgttttttgagatggagtcttgctctgtcacccaggctgaagtgcagtggcgtgatctcaactcaccgcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgaccacgcctggcccataaatgttatctttatataacatactcacagctcccttaggagtacttttgtccatttctacacaatggaaacttataattttagccttagcaacatgtatttactgggcatctagatttcatttatttaagaactttttattgaatgccgattgttcagcagccaccatgcaaggtcctggggaaccagtgggcagccacacagagaaggtcccaatggcaccagaacaaggccagcttcctaggaggtgtctggcttcaagacagggatttcctttagctgggtggtagagaaatggattgcctgtgatttcactgtgcataaaatgacctttcagcccttaacctgcgacatccacatgtgttctttggtactcacgggtgttatggttcatagctgtggtcttctgaagtataggaaaaggcagcttacagaaaaaaacttgcttgtttactgtcttctgagctgatttctcacctactggcaagtggataggtctagtttttgtttagctgtttttctaatttaatcttatacatgagacagctatagatggatgtatagtctttgaagtggggccagttggctccgtctattagctgtgtggcttttgtgcaggtgacttgtggcccccggcctcagggatctcatctctaaaacgaggctcttgatgttacctgccttacccagctgtgaagattaaaagggttttgtgtgttaaaggacttgcggagtgcctagaacccaatgagggccacagagcttgctccgattgctttcctgaaggcagtaagcatgttgctctggtaatagtcatcttcacggccatcattttgatcacattttggcttagtttcttcctctaccctcttcccacgtcagacctttccatggaaggtaaaacatgttaacagtctaatgtgtttccttctaatttttttcttcatttatattatacatctatgaaatatatatatatatattacatatggatatatagacatacacagatgcatatttagggtgtgctatggttagaaagtttgcatccccccaaaattcacaggttaaaatcctaatcctcaaggtcgtgacggtactacaaagcaggacctttaggacatgataaggtcctgggggcggagggtactaatccccatgaatgggtttagtgcctttataaaacagacccaagagagaccgttatccattttaccatgtgaggagcccacaagcaggtgccatctatgagccagagtggacccttacccaacaccacatctactggcccctttatcttgaacttccagcccccagaactgtgagaaataaatttgttactcataagccacctaagttatactattttgggatcgcagcgtgaatggactaaaggtttttgagattcttttttcagtagtttcacctaataaaacatggaatcattctacgcatgctgttctgtattgtagtatggttttccacactgagaacatactgtgaccatgcagtcatttcccagatggaacttattgagggacattcacttagtttcgaaaggtttctccctccactcccatcccggccacagatagtgatgcaataacatccttgttcgcatgtccagtctgaagcttttattcctatgggatgagttcccaggcataggattgccaggctggactctaaattttgaaaatggatttttatcattctgatggattacggtgaagagagccaaagtcttgatagaaacactcaacgcagtgaattttttagatgtaaaagtggatggtacttaaggatacgcacattagaaggagtaatttgaccagcccatcacagtattaattgattttcatgtctcgaagacttctgatttcgttttcgaggctggaaaggcaggtggaaagcccatcagttttacacacatattttgcagacaagtattagaaagtaactagcctgcttttactaatggttctgtggaagaaacacagcttgaataaatgtcgtcttggatgctcagcacagattggcagtggatgtcaggattgtctggtgggaaggctgctgggactcactctagactgggagtggggtggggtggggcagggcaggacggccctggctgattaataatgtttgttatgaagtctagggtacgtggggagagcttcatgaatccctgcattggccacccctgtaccacggccaatgattcaccctccctaaatcccagggccagatattagaacatctgtgatgaggactgattttctgttcgtggcctctggaagtccagtttttctgagctcaggggagccttggttgtatcttataggcaagagacgaatttacattttgccatggtgttaacaagcaaaagaagacaaaagagctcaaaatagacagtggcgtgctggggtcaggggtgctggtcaccagggcgagcagttatgggtgaagggctgaatttgcagggtcaaggagattgcctccaggccccttctggaaacacactccctgagccttgtagaattgagttgattctgtttaactgcccagtgaagaaatgacttccttgctttaaaacatttgacagctgtcttatataacttaattcttcattccagtggcttttggagcagcctcaaaagtcattttatcttcttggctctttgatattatttgtagtaatttatttaaagtaattagagacgggatcttgctgtgttgcccaggctggtctctaactcctggcctcaagtgatcctcccacctcagcctcccaaagtgctggaaataaggtatgagccaccaagcctagccttgatattattttttaatgggggtgtgtgggtgggtggtgatggggatattccagcagaatatcagaaacagagatgaggaaggcagagagagctcaaagacaaggctcaagttcatattccaacgccagtacctgccacctgtgtgaagctgggctaattatgtgtttaggtttcctccttcgttaaatagagttctacttatattacagggttgtcatgcaagttgatgaattaaatacgctaatatatataaattctgagtaagtattaaccaaagaaatggaacatcaatattggttcccagtctagttcacaggtgttatcaagatggttacctttctaagtgtctttttatttcactagttccaaaagagtatctctcaaaatattaggtagtatttagtcaacactttaacacataacttgtttttttttttggcataagaagcccatgtgaaaacacagttgaccctaagcctatgaaaaatgacttgtgtgtgggactggggtggctcataggagaaggaggatattcgtctggatttttactggtatgtatatatttttgggtactggagatggggacagtgagtatttgaagctcacagcaggcccattttgcaagttttcaggaaactgaaattcagagagattaagtattttgccatgaatcactttgtagtaagtgggagagctgttgcaaacccacgtctgtctacatccacagcctgtgctcttttcatatacaagggaatatggaggagaagggaagtgatggaaggctttaaaaaaaaaaaaaaaaaacttcagaagctgatttgagatttattcatctttggtgtactttctttactaaggcaggttgtagactcatgaaacctagaaggagttgaaaaataagggttaggattaaaaaaaaaaactagtgaaatcaagacaccattttgcttaattgaaggcttgcggaacattaaagcacaacaaaaacctaattctttgagtgtttctgaggccaagccttttcccacaaggcactgtgtacacggttctggaagctctcctctgtttgcacagtagtcactcatcctgctctcgggctctgcctgcagtctcttcctctgtctccgatgtcactcttctctgtcttcttcagaagctgtcatatgacctccagatttctctttgactccctgtattaccattagaagacatctacactgggaaattgctcagttcctgtttttgattaatattttatcagccgcaagaggaaatggtattctatagcaacactaataagtaattgagcagatgagatgctcttgctagctttggtaaaaagtcggggcaaggttacaacagaggagctctgatgagacttgggatgataaagtcaagtcgaatatctggtagggttaaaaatctaacagtgggccaggcgcagtggctcacgcctgtaatcacggcactttgggaggccaaggcaggtggatcactcgaggtcaggagtttgagaccagcctggccaacatggtaaaatcccgtctccactaaaaatacaaaaattagccaggcatggtggcatgtgcctgtaatcccagctacctgggaggctgaggcaggagaattgtttgaagctgggaggcggaggttgcagtgagctgagatcgtgccactgccctccagtctgggtgacagagtgaaacccatcccccaaaaaaataaataaataaaaattaaaaaacctaacactggtacgagaagaaattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactggatcccctgctgtacccagcaaatgctgagagccctgcttcccctcttgtattcaaatggctctataagagaggaagtagtacagctatcagtaacaatgccatccggtaattaccgaatcataaatgtttggggagctgaaggtcacgggcttagtagcaattctagtctgatgtttgattccttgtgaattttaaatgcttgtactctctatctgggtgatggtgttttagttgccagtggacagtctgatggaggtgggggaagagttattcttccatatttatttttctccaccttgggtgaaaaaacttcgcttttcgtaatgtggtacagtgtgtgcttctgtaaatggaaatggtttcagcacatcacagtcatgcttccctgttgaaagatgctccgttttcccgcatacatgatgtccagcacaacgtctgatttatgagagcatgaccctgggggcctctggaacagctgctcacacactccctttaggaggcccaggctctcaggggaggcccatagtgcagctaggagctagagttttaggatgaagaaattacaggtaagaacacagccccattttaagaaataccagtgatttctgtttttccttgttcttctttccctcagtattttattaacatgtgctactatacaaatacacaattcacttaggactctgtttcgtgtggatcacatgggagctttcattaaattgtggtgattccaatgtgagtggttatcaagtcaacatcaaataacatgaagtgtgttttagtcggcaaacatcactttgtaattctctgatgtgtttgggttgattcccttctttctgctctttttctctttataaagtaaacatttttattgcaaaggtactgctattgttagtttctaaaggcacttgtcatggtgtgactaatattagaagcagacacagccatgatgagcaatactctttttttgtttatttttgttgttactgctgtaagccactttcttctccctctccattaaaatgcaacttaattggtaaagtttagttgactagagatttcatttatttatttatttatttgtttatttatttatttatttatttgtttgtttgagatgagtcttgctcttttgcccaagctggagtgcagtggcatgatctcggctcactgcagcctctgcctcccgtgtccaagtgattcttctacctcagcctcccgagtagctgggattacagttgtgcaccaccaggctctgctaatttttatatttttagtaaagacggggtttcaccatgttggccaaactggtctcaaactcctgacctcgtgatccacccgcctcagcctcccaaagtacttggattaaaggtgtgagccaccgcgcccagcctgtatttatctttttaagtaacaaagtattagcattgtgataaataatatttaatatatagtaagggaggtcaaagtatgaactattttgattttttatgggttttttttttttttttaaagaatgcgttgattttgtttttctttcttttttttttttttttttgaggcaggccttaggtctggcacccaggctggagtgcagtgacgtgatcaaggctcactgcagcttccacctcctgggctcaagcaatcttcgtgtttcagcctcctgagtagctggaattacgggctcatgccaccacacttggctacttgtttaattttttgcagacatagggcctcactatgttgcccaaactggcctcaaattcctagcttcaagcggtcctcctgccttggtctctccaagtgctgggattataggcatgagccactatgcccagccaaattttgtttttcttttctttttttttttttttttttgaaatggagtcttgccctgtcccccaggctggtgtgcagtggcatgatctcggctcactgcaagctctgcctcctaggctcatgccattgtcctccctcagcctcctgagtagctgggactgcaggcgccagccaccacgcccggctaattttttatatttttagtagagacggggtttcaccatgctaaccaggatggtctcgatctcctgacctcgtgatccaccagccttggcctcccaaagtgctgggattacaggcattagccaccacacccggcccagattttcttataaagtcaaatgggagatacttgtttgcaggaaatagttcttttggttcttacttttccataaggattgagtctcaaaatgtctggtagcatccactgcattttgtaggggacaataacaaagaagatgccagcaatatcttctatcttttccaacattattcacctctcccacccaaggacaatggtgggctggacagagcattcaatgaccgagaatctaccataagctactagggccacatcttcccctttcttctcccccaggtttgtcccatttgtactgactctgacccaggttgtcatgacttgagactcactagaagtttcagaaagatgcacactgctttaaaaaaaaaaaaaaaaagggcaaggggaggtgtgagaagaaagtataattctttttcttctaacgggagatataaaaatcatataagcatgatttatcatttgattggaacattgtattttatggttgcagagcacatgtatcatcctatctgcttctgacacccagtaagcagctctggcttttataattttgatgaaagaggtttcctaacagtatttcggtgtgcatgctcacacaccagccctggtcatcagtgaacagattcttccaggtcttcattgtagcggaagaaagtgagatcagagatcccgaggaagggcttcagtttcaccagtagtggagctagggagtagcggggcagaagccgcaggaagtcagtgcaggacgccggaggccactcctaattgcttcatgtgttgttgccgtgctgatgaccttggaggcgctgctggtcctggatccttgcgaccttttcttccaagaggaaatgtggtgctgagccccccttccactggctgtgacaaagaaggacccctcatgtgggggcctaattctagtgaatccccaaaggtacatgttgaaatagggaaaaggcccaggtgaggctgtctatgtaatagagaagatccattgcaaaatgaaaatatggggttctagccaggggcagggaacttaatctcccttttccatgggcccaacacctgaatctagggcaaacaggtgtcccccagattggatcctctgctctaggacacattcttgtcctagagcgggttgggcaagaggcttttctctcagtcaccagccccaaaccctgtggtcttgccagcccaggacgtgtcaagactgcagcctttgctgacctgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagcgagggcaggtgcaatggctcacgcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcgcttgaacccaggaggtgaggttgtggtgagccgagatcatgccattgcactccagcctgggcaaaaagagcggggtaaaaaaacaacaaaaaaatgatgtaggaatgaacagatgaacaaccccacacaacctaaggacgactttgaatcaattcttctaagctggtagcagaagccacctttccatttgacttgtatctcgctctttttttctttcttttttttttttttggagacagagtctcactctgttgcctagactagagtgcagtggtatgatctcagctcactgccacctctgcctcctgtaatcaagagattttcctgccttgggcccctgagtagctgggactataggcatccaccatcacacctggctaatttttgtattttttgtagaggtggagtttcgccatgttggccaggctggtcttgaattcctgacttcaagtgatgagactgcctcagccagccaaagtgctgggattacaggcatgagccatcgcgcccagccagacttgtatctcttaatgagtttaactacatttaaccatgtatgtgtcagtcctactatgcaccttacagctcactaaccctgtttaataatgtatgttgttacatttaatctttatggtagcctcatgaacaggttcttgatcaggagtgatattgcctgccagggaatgcatgtcaatatctggagacatctggggttgtcagttcaggagggtagaggataggggggaaaaggtgctactggcatctagtgggcaaaggccagggatagtgctaaggatcctgcagtgcaaaggaccatgcccaccacaaaatatcagcagtgcccaggttgggaagctctgtgccattgtgcaaagattcaaggtggctatgtcacaggactggtacatgtcctttttttttttttttttttttttttgagacggagtcttgctctgtcgcccaggctggagtgcagtggcgtaatctcggctcactgcaagttctgcctcctgggttcgtgccattctcctgcctcagcctcccgagtagctgggactacaggtgcccgccaccacacctggctaattttttttttttttttttttttgcatttttagtcgagacagggtttcaccgtgttagccaggatggtctcggtctgctgatctcgtaatccgcccacctcggcctcacaaagtgctgggattacagacatgagccaccacacccgccctacatgggtattctaacccagtctagtgatagtccaacctcctgtactatgagtaattagcaaagaattaacagcagaagatcgctctcaccaaagcccatccagaaagtggctcgtattcaaggtgctaattagggtgttttgttgccagtaaaaacatgagtcagatttcatgattgattcatgatgactttaaaattaatgctgctgttatcatacaaagtagtggtaagtggaggtaagagaatgtttttgctttggggtactaagtcatcgttataataaacacacagtaaacccatttatctcaggcttaatgctttcttgtttcttctaagcacttcttaggtgcctctgggctttttaacattctttggcagttgtaatttattaattgatttttaaatttggccggtgaaaatgaactttaggtaggggtttgaggaaaatgaaaaggcctatttgtttttcagtggctggttcttcgtgttcagcattaaggattggtagaaatcaggcaacctctatgtaacctcagccatcttggattcccagcttactcacatcatagatggagagtcagttgtttagaaaaaaactttcttttttttttctttcctttttcttttcttttctttctttctttcttttttttttttagggagggtctggctgtattgcccaggccggagtacagtggcacgatcttggcttactatagccttgacctctctggctccagtgatcctcccacctcagcctcctgagtcactgggactacaggtgcacactaccatgcccagctaagtttgttcattttttgtagatacagggtctgactgtattgcccaggctggtcttgaactcctggcctcaaaggatcctcccacctcagcctcccaaaatgccgagattatgggtatgagctactgtacccgaccaagaactttctattatatagattttaattaaaaacagtcctgttgagtggcctctttatcaaatgcattctcacataacctcatagaagtgagccctcttactgaattatgtggctggggttcttgggtatgttttgttctattttctggttggtggttttctttctgtcgggtcccgtgggctctttctggacctcttctcagaatgtttttcgttttttttattttttgagatggagtcttgcactgtgtcctgggctggaatgcaatggcaagatccctgctcactgcaacctccgcctctcgagttcaagcgattcttctgcctcagcctcctgagtagctgggattacaggtgcatgccatcacacctggcaattttttttttatttttagtagagatggggtttcaccgtgttaggcaggatggtctcgatctcctgacctcgtgatccacccacctcggcctcccaaagtgctgggattataggtgtgagccaccatgcccagccctcagagtgttttaaaatgcatactattaaatacctaggattataaagggagccagctatacttacatatagttctctctgtgaccctgtagaatgcactgaagcaaaaataacaggtaatgctaatcataaagttttacaaatctcctgaagagtcttgttggtttccgtgttgatgaagcaggaaatttccctgacccctttgcaggcaggaagtggagtgcggatgctggaactagctggctgctttggtgccagtagaggtgaactgcactcacttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgccatccacggacggcttaagtgttaacagttcagtggagggtcagcgtgacagccttttgcacccacatctgggttcttgtccagtgtccaggaggaacgaggtctcatgagcaaattttaaggatggcagatgtgggggattttattgctgatgaaagtggctttcactgggaagataagctaaaaagaagacaaagcaggaaggtaattttcccctggagctatgccatcaagctgttcttctgaagtccagccgcttctctccaactgtggtctctaatttccagctgcttctcctcttttcttcaatgtgccagcggagcctggggtttttatgggtacaggattgggggcaggccgggccatgggtggttgtggaaaaggcaatatttgagtggaaaaacagggatatatgttctcactttgggccacagttccaggcttgaggatggggccctcaccacggacctgccctcttctgcccagaatttccctgcctcctgtccctatcattgatacctgcaattctttgtacatatgaaatttaatatggtgagattggcatctagctgctgctagagatagtgctcataataatttttaacattgattgagtgtggataataatccaggagctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgctgattactttttgatttggtttggttctttggagttgtttgcatttcatgagtcttggcatctttttggtagagaaccttgctaggttctcacaatgtagaaattaagcagaaaacagaggtctcaatttgccttttcagcgtgaatgcagactcttacattcagtgctgggagtctttcttgagggacagtgagagcgaggaagggtttccattctccgagatggatggttgcattagtatttatttcctttttgtttttccttaggatgagaaagaaggcagtggagcccttttccttaggttagaatggttctgttggttgaattgtgcaccctgtttggttgaaacaattggacagtaaggatgtgactattattgttgctctctaatactttattatgtcataccaaaaattatcttttgtattttgctaccagttcttttagtttctcttacatgtatgaagttggatagttagaatgagatgaaaataaatgggctgggcgtggtggctcatgactgtaatcccagcactttgggagtctgaggcaggtgaatcacttgaggtcaggagttcgagactagcctggccaacatggtgaaaccctgtctctactaaaaatacaaaaatttttttgtattttgggattcggtttaggtgatgtgtgtctgtaatcccagctacttgggaggctgagacaggagaatcacttgaactccagaggcagaggttgtagtgagccaaacttgcacaactgaactccagcctgggcgacagaggaagactctgtctcaaaataaacaaacaaataaataaataaaaattgtttaaacctgccaactacaataactttttcagtctctttctccctttcccaccttcccaaaagggtgggaaatttttaaagtaaagtaataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttctgttataaaatcatgtttttattgaattacattttaatattggtatcactttaaaatgaaaatgagtacttgcaaaatgtatttttgaaggagttgggtggtggtggggggatgccattttggcaacagatgacttcggttcaagtcctctctctgtctcttacttgctttgtggctttagaccagccacccactcagagccttgaaatcctcatctttgaaatgaccatagtaagttcctgcctaggctctcccctgaagctgaaatgcatgaacatgctttgtaattttttttaaggattgatactagctagggtgttgataagaaacagcaggcatagttactgggtgattgagaagagtttaacaaaagactgtattagtctgttttcatgctactgataaaggcatacccaatactaggtcatttacaaaagaaaaaggtttattggacttacagttccttgtggctggggaggcgacacagtgatggcagaaggtgaaaggcacatctcacatggcagcaggcaagaaagaacttgtgtagggaaactctcccttatgataccgtcagattccttgagacttatttgctattgtgagaacaccttgggaaagacctgcctccatgattcagttacctcccacctggtccctcctgcaacatgtgggaattcaagaagagatttgggtgggtacacagccaaaccatatcaaaaaccatttataaaactctaagcagccttaaaggaaaccaccaagggaccaaggcctgatgaagcaagagtaggagggaacagatgcttggatagggcaggtgagtcacaggctgatgggagctgccaccgtcagtagaggtcctgatgacctgggagggtgggagccagacagatgggagtatcctagcctcagttcctttccatcctcagaactcctcccagtgcctctcaatggctaaaccaaccaaaggttggagctcaaggaagctcctgaggctatctttacaggtcagccagttgggaacagagttgacggagaggggacaggaggtgactagatttggaaggaaaattagaaaacttttggccgggcatggtggctcatgcctgtaatcccagcacttttgggtcagttgagtctaacataggggtgtccaaacttttggcttccctgggccacattggaagaaaaagaattgtctttggctgcacataatatacaattgttgatgagctaaaaaaaaaaaaaatccccaaaaaatctcataatgttttaagaaagtttatgaatttgtgttgggccagattcaaagttgtcctgggccgcatgtggcccaccagctatggtttggacaagcttagtctacaggttcttcaagaggggcttgagcatttgaaagacttctagtgggagagatcacaaggtacaactagaaaatcctgggctggcctgagaggcagacctgtgattattttgctctttgaaagttgtccttctgcacccattttccccagacctaacctcgatttgtgctccaggtctgagcagaaatgttattccctccagaaagccttccctggatgttgagggatgaagttgtaggcccctcccgaatgcgtcctcagaactcgctggttctcgtcctcgccctcagcatacttgctcattgtttgtttccatctctatcatctctgtgagccctttgaggatggatgtgtgtccatcttgttaacagttggctccccagtaaccagtacagtgccagatacagagtagtaaccctacattctagcgtaggcaaatattctagtatttgccaaaactagaggatgaatgagtgatgggtaagagagttctcagaaaaatggatataaacaatattgtaaatcatatttggaaaataaatattagaatcattgaatccctgagttatagaaaaatttattaatagcgctatctggctactttttaaagtgtggacatcctcgatgtattagctatgcatctgtggataggaggcttacccactctgagtcttgtcaaataccaaacacaggaaaacaatatcttcctgagaatgttgtgaagaatatatcatccagtcagagtgaatcagcttgcccagtgcttggcatatagctgctcaagaaatattaggcattctttgttattataaatcccctttgtattttaaaatcctcatgtatcactgaaacaaccaactgaaaaccattgagaggctcatggtgaaagaagacagacagtgtaatttccctggaaactcaattttgattcagacgtccacagcatctcatttctgcctttaaaaaatttcaagagtgacattttggcatgactggactcacaggtggagaaggtatgacaaacattctggaaatcttggaaggtgaaatatagggaagatggcccctatggaggttcattgtcccccaccttattctaaataatgactttcttaaaactacatgttttgggggaatgtcctgcaatattgctttacatctttttatttttttatttcattttattttttttgagacagagtctctgtctccaggctggagtgcagtggcacaatctcagctcactgcaacctccacctcccgggttcaagcgattccactgccctgatcagcttcctgagtagctgggactacaggtgcgcgctatcatgcctggctaattttttgtattttagtagagactgggttccaccatggtggccgggatggtctcgatgtccttacctcatgatctgttcgtctcagcctcccaaagtgctgggatgacaggcatgagccaccgcacgcagcgtattgctttatattttaagactatacactgatatccccgagcacccaagttcctgtccgctggtagaattcacaaagctggttttatgtctccttctcttcctcttccagtgttgtcttttccctgcattgagatagcattgcatggagatccttgtactcttcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgatgccacggacctttgaaatatttttttgaaaagaaggcctcccttggctgataccttctgactgttagtgaataaaggaagtttaaacaatctcttccctgtaatcattaatctcgtcttctttgttacaatgtatgttgtggtctttgttacaatgtatgttcacgaattcctagaacactgttcccgttggccatgggatcaggggaagagagaaggaagagagaaccagacacaagttggagggaatccatctccagtgctgctcagaggtatgacctagagcaaggggtttaggctttcttggactcattttcctcggtggtgaagtggggataatttattgacagtggaccgtgaggttctgcgcacaaaattcgttgcatagcacctgatacacacaaagctttcaggcaaggttagtttcgggtatttccagccttagtcttggctgtgggagccataatggagttgttcagaagtttacagctagtgtttataaattgcttgccatggggccttgtatacagtaagcattcattaagtgttccctcctattatatccttaggtttaagatacaggcaccacaacataaaccacccccagagtacacatgcatgggtgtaatttggtgccattctcctcccttttgcccccaccaaaatgaagtttttagtgtaaatgtcatgtagattttaaccaaaggttgattggagggtctgagtttctcagctaaatgaaggcatgaggactgtatccctcctgaagggtgtgatcagttccatgagaaagaagctgcgagctgtggggcatccaagataatgtaatctgccccggggtcctgtgagggactggccgacaaggcaggctgaatgcagccttgcccactgagctgggttctctctgctttaggtcctctctggaggtgaagagggaagtccgctgattgtttttctcttggtgcaacttcgcaccacccttacatatcccagtgtatatggtagccaaggacagtactgtttgagcctcccccattaagtgtcaacattgaatcaatgcaatcccatgcaaagaaagctgagcatgggattgtgccggtttagccagctaaagtgtggtctctgatgctgatcatgactatgaaaagggaaaatggaggagaatgatgacgaaggaggaggaggaggaaaaggtgacttgcctctagctgatgtggattatttctcttttttaatttccatgtctgtgtagcttcatcatagatctcagcttaaggacaatgaaagtcgtttattgagtacttagtatgtgctggttgcagagccaagtcttttttttttttttttttttcctccttttttgagagagagagtctcactctgtcacccagactggattgcagtggcacaatctcaactgactgcaacgtgcacctctcaggttcaagcaattatcaggcctcaacgtcctgagaagctgggactacaggcatgtaccaccacactcagctaatatttgtatttttagtagaggcggggttttgccatgttgtccaggctggtcttgaacacctgacctcaggtgatctgcctgcctcagcctcccaaagtgctgggattacaggggtgacccaccacacccagccagagtcaagtatttcaagtattagagttgtctgcctgcctccctgtctccctgccttccttccatctgtttgttatctgacttaatctttgaaataacccaatgatacatgatatgcattttctaggtagatagatgaagggttaggaagatgtaacttgtcctaaatcacgtgtcttctaagcggtggaactgattttctcactgactatagatgttgagcccattaatgtgatacctactgccttttaattttaaaagttctcattgttttatcgttttcatcattatcatatgatttacctcttctcttgtgtcttataatccgattggtcatgctgacatactaaaccatattgtttgccactgggaaccaattcatctgtgaaaagtcatacagataggctcgaagaaagagcttggttgtgatgttgttgttgtgacaactgtctcgggggctggagttagagccagggtcccagctgccacagttcatgtaggggtagaccagtgcttccttttgggtgatgaggaagctggatttggcagctggttttgtctggatttgaaagggaggtaatcaggggtgtgctgggagggccagaacgatccacccacgtgttggtgccacccggcagtggaaaagcctctggcctcggccttctccggaaggttgtccgcggtgccagtgagagctgcttttcaccttacagcagccccggcctatctctcaggaggcctgctgataatcagtaaatgaaattcacctttccccgattcttgaaaacggaaaagatgagggttgaattatagggcaaatcatgaacactgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccaaaaaaaaaaaaaaaaaaaaaaaaaaaagcggggcaaggggttggagaatgttcatatcacattattttggatgtctggggttgcacctggaagctcagatagcaatatctaggcacggctgccagcgctctatacattgacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctcctctttaactgaacaccttccagacgagcatgctctgaactcctgaactgctcattctgttctctgagagaattgctcaagctgcagtttatcattatatgcctccaaagactttgtgtttcctatgtttgacatcgagatagaatttttcataaccctttactagtaataaatttgattgttaagggaccaggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagtacctatgagatgcatttgaaaacttaccttgtttatatgtttcttctgttgcaatttcttccattacctggaatagctgctttggacggcaaaccaagcaatgccctttcacagctgtgggatgaatggggaaagaagtcttggtaaggaagcaattcagagaacatggaagcatctcatggcagcagtcacaattttgtgttgcgtaatatttcaggaacttgcaaccctgataacttgtgcctgcctgtctgtaggcctttaatgatgttttattgaattttggttttcccctagactttgcagtgcatgacacatagtaattgctcaataaatatgtgttcaactgaactatggtggttaggttagtaattagatgcacagacaaaatcacaggaatctgcgtgagccttgtcctactggtaaaggagtcttgtgaggattaattgaaataactcgcaaaaatatccagctctctgtttccctgctaggggctcttgtcataggagccattgttgtagccttagaaaacatacagcattattttagggggagaggttagagtagaattttaaagagtgcatttctcttccagtaagcaattctgcatcgataaaaagtggagaaagaataagtgaaaaaatatttagttaattcttgttgacagaagtaggacttcaggtccacatatatttcattgtagagtgcacacatgcatttttaagaatttcccgattctcttccacgtgtggacagattggcacatatgtgtgtgtgcaaattgtacttgcagtggctgcctgggaaatgaaatttctgcaccttgccagagcatgttttccctctaaagagaggcagctcataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatcagatccagtacatatttataaaaccacacttacatttaaatacaggcctttcccatttcacagtgtttctagctcccctttccaatacatctctctctctctttctctctctctctctctctctctcacacacacacacacacacacacacacagccaaatcagacaccaatataaactgtagagttaacattctttttccaccctcacactttttttagctccgatctgtgttcaatttctgcctgagagagtgatatattcatatatttaggtatagttagaaaaagcaaaatggtaacaatagaatcttgatgggattgatctcctgcagcaaggagcaacagaaaaaaaaaaaaatggaatcaagaacccaggtgctttttataggttaattgtgcagggttatcatgtatctctttaaaatcaccatcttgattctgagctttggttctacacattagaattgttgcctgggcctggatttttccccttgcatgttgcgtgtggtagtccagcacatttgctgattgcaaatatacttgtctcttctcatgggcattactagtactcaggaaatcattgatgtggggtaaaatgagaaaaggattagttttattttggacagataaacaacatgtcattttaccaattgctcattaatgctgatatttcccgtgggtctctgactctgaaatctgcatggagtggttacaccctgggcttgttagctcctacctgagctctgagtttctgtggatttctataggctcctgcaaattttatctagtggatattttgttaaaaaaaaaaaatggggtctcattctgttgccccggctgcagtgcagtgacatgatcataactcatggtgacctcaaattcatgagcccaagcgatcttcccacctcagcctgagtagatgggactacaggcatgtgtcaccatgccaggctaatgtttaaaaatttttcttagaggtagagcctcactttgctgcctaggctgatctagaactcctggcttcaagtgatcctcctgccttgagctcccgaagcgctgggaccaatagagatttctctgagaattaggtcccccactattaataaggtcattgtcagctgagttggggaggtggcgtgggtagatacaattaatttagattttttaaaaggcttttgagaatattcggagaacctaatatattttgagacctgacatttattttaaacgtgaaaagcaatttacaaaattgcacatactctataaatacacttctgttataaaaatagacacgtacggccgggcgcggtggctcacgcctgtaatcccagcactctgggaggccgaggcgggcggatcacgaggtcaggagatcgagaccatcccggctaaaacggtgaaaccccgtctctactaaaaatacaaaaaattagccgggcgtagtggcgggcacctgtagtcccagctacttgggaggctgaggcaggagaatggcgtgaacccgggaggcggagcttgcagtgagccgagagcccgccactgcactccagcctgggcgacagagcgagactccgtctcaaaaaaaaaaaaaaaaaaaaaaaaaaaaaaaaagacacgtacacagacaaatgttctgacagaaatacactgagatatctacagtgcttgtctctggataggatagggtataatttaattgtttatagttaagttaatgaacttggccagacagacctgggatcaaatcccgcctctatcatgaattggctgtgaggtgtgacattgaaaaagtgatttagcctttgttcccctccaggtccttatctgtaaggtggcagttacaataatacccacctcccagggttatatgtcaatgggttaggcacagacctaggaactcagcaaatggactactatgaagtattagctttttactgtttctggttttctgatttttgtctcctgttgtgaacatacgttgcttttgtaatatgaaaaataaaaaataaaagttaaatttgttttgtttgtaagaatcagttgaggacagatgggactatttgcatggattggtgtcatgtttgaagtcagttaccagagggtttctttcaacagagtataccaaaaaaaaaaaaaaaaaaaaaaaaaaaagtaaattgcacagaccccagcttaggacctggacttaatcttcatgatgtttgtaaagtaatacttcttggagaaacctcccaaatttctatcgacactagacatctcaggatttgaaatgttaagctaacagaaattgttcatcaggtgtatctccagccctccgtaaacactgccggatggatgaacctacgtaatgatctcctggtgccattttcctgactgtagatacttgggtaaggaggagactttgactctagatgacatgatgtaccctgtgttctgcaagctggagaacatcatgtagaatctgaaaattaggagagagaggcaatcagaagaagacagagtggtgttgcagggacctgcagtcagcctagtcccccagtttgcgtttgaatttggtcccagattttttttgtttttgttttttagtagttaaagctgagagcaaaccacattgcttactattgtcagggaatgaaaactatgcaacagaagccgatgtgcagaggtgaccgtgttcgctggaattgaacttaagcaggttcctaccgcacagatccacacaggagggattgcgtaatgcacccagcagagttgtgctcaactgtgattttataaaagacacagaaacacatattaaatagacaattcttctatcagccctctaaactggcataaccttgaatcataattcaatgaatgcatttctgtgagaagtgaaggtaataagctccaagtgctttcgtttcctttctttctttcttaatgcagggaaaattgagatgggattctcagttaaaacccaaacgacgggcctgggggttgtcacaatgtgatccctgaggatgttagccccaatgtctttctgtagccagaaccaatagaaaaatgagaggaggagagtagaagcagaatagcaaacaatttttcctttcatggtctacctgtgtgactgtgtatatgtccagaaggggatgtggttggggaagggcatagtacacatatttgagcagagtacatgtgtttcatttcttgctcatacgacatgtccagtgtgggctggcatgttcttctgcacagtccctgagggacccggacttatagagtctgtgatctcacagctgctacatctggcacagatggccttcttgatctccagttagggcgagtcacaacagcaattaaatggtttggtctgaagtgtcacgagtcgtttcctcttggctgcctactggctaggccagtcacgtggccctgaagagggtgggaatgtctcatccccctgtgggcttagaagaaaaccagaggtctgtgcacactatggatttttactacaatgatgccctttcacatacagcgagaaggattaagaggtactgtattgttggttgataaagtcaaacttgtgaacagagcaaaagggcattgcttggtcattgcagcttccacccatgcaccttacacagaagtttgggccctaacatggaaacttttcaacactggccaaattctgtttgaagcactgtattgagcataccatatgctgaaagacttggaatgcaaaaacctaaggccaagggcacttctcaatattaaaccctcagttgtaatggaggcatcaagactataagacccaagaccttaacttttgtgctccttgtcttgtggagggaacatccatcctcaaaacagaaacctgtgagatcccttgaatatactgacaatacactgatgagaattgaatgccccataaattgcatctcccgcagggcctgataggtgccctgtcttcctgcttatgactctgaaaccctgtttatttgtatcaaggacggttggtactttaatcatcaataaactaacatctcaacagcctgccataaatttcttgtcaaaaaaagaggttatgattagaatactgtgattaaagagaatttgtagatagacttacatccctcagtttcaaagcttctagtagtagggcttagaggttcctagagtaggaaaagcctagccaagcagaaacccatgtttttgactttcaggatatttgtgaattaatttacttgcatatattggccaagatctagcataatctcttaatattcaatgaataaaaaattgagttttgagagcaaatattttggtaggaaatagagaactgacactaatattctctctgactataattgtaaaacagtagatgtctttcaccaagcgctaacattatattaattattaataaaatccaactccttaataatacaatcatagttaccatttattgagagcactcttctgaacattttgcattctttatttaatcttccctacaaccttattaagtagacattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccattttttaactcattgcaatgcacagtgggttaaaatgagatgattgaaaatgagatgtggctgggcatggtggctcacacctctaattccagcactttgagaggataacttgagtccgggagtttgagaccagcctgggcaacagagccagaccatccatctctacaaaaaatttaaaaattagctgggtatggttgtgcactcctgtggttccagctactcaggagactgcggtagggggatcacttcagcccagaagttcaaggctgcagtgagctgtgatcgctccactgcactctagcatgcgtgacagagtgagactatctcaaaaaagaaaaaatgagattatggccaggggtggtggctcctgcctataatcctagccctttgggaggccaaggtgggaacatcatttgagcccaggagttaaagaccagcctgggcacatagtgagacaccagctttacaaaagagagagagagaaagaaagagagagagattatttctagaataagcaaaccaaacgtgaattaagttttcattctcattttagtgattctctaagtacatacccacattctgattccctcagcactttaggactgactgattagcagtaactgccctcccactggtaccactgtggccagggagtgactgcaagggtcaaaacttttgttggggagctgtttggactaagtgaatgtccagccccaactcagggatgttgtattggttctaatctctgcttctgaggaaatggttacctgcagggcgattgtggcctgctcctcgtgggatatattgagatggttccttttaatccatttcttttaaaaaaaaaattctttttaaagagatgggatttcattatgttgcccaggttggcctcaaagtcctgggatgaagagcttctcctgtcttagtctcctgagtagctgggacgacaggtgcctgcaaccatgtctggcttaaatccatccttaaacaagttcaatgttttatttccttcagataaaatgagagtggagagaccacagtgatgcccaggaatagtcatggttggcgattaaatagccattgagtctctattctgaaacaggcaccgtgttcatttgctatggctaacatgacaaaataccacccactggggatattaaacattagaaacttactgtctcacagttctggaggctggaaattcaagacaaagttgctggcagggtctctctgaggcctctctccttggcttgcagacggccgccttcttgctctgtcctcacgtggccttccgtctgtttcttggtgcacatccctggtgtctcttcctcctcttataaggacaccagtcctcttggattagggcaccacgcttatgacatcatttaacttagttaccctttcaaaggctttgtcttgaaatacagtcacatggagggttagaacttcaggatataaatttgagggggacgcagtttagtctgtaacatgctctatgctgggcacaaggaatgttatggtggataaggggaaaatggtccctaccctctgtcagttttttatggaagaagaaagacggtctttaaagaaatttacataattaatcacaaaaagctaatactatgacaaagaatgtaagttactaatacagcttagaacagatgactctaaccttgtgtaggagctagagaaggcttctctgaggaggtgaggttggaactgaagcatgaaagggaacagaagggggtcaggcaggagaaggcttgggaccaggaggtagagaaaacagtagtgtgatcagaactttaaggcccggttctgtatacaacaggtttcgggacttgaaaggcagcccacattgagtgtaactagaaagtgagggcaagagattgttcaaaagaatactggacccagagtttcatcactttgttaattacatctcatattgtgggattgcaattaccttgcccaagaaaagattatttacgattccattgtttatattgtttgttgaaataattaattctcaaaacttctggatacctgagactcagctaggaacttatttttaaaatataaattcctagtcccactccctaaagattctgagttagtacattcaggatggggtctaggaatcagtgtgtttaagaagtgcatcaggttcttctggtactgattgtccatgaaccacactttgagaaagctccatctaaagagataagttactgacgtgtgttaccagagagagcctagaaaacctgggcacaacagtagttgttaagaactaccagacctgggccaggcccggtggctcatgcccgtaatcttagcactttgggaggctgaggcgggtggatcacttgagcccaggggtttcagatcagtctgggcaacatggtgaaaccctacctctacaaaaaatagaaaaaattagctgggcatggtagtgcatgcctgtggtcccagctacttgggaggctgaggttcgagggttgcttgagcctgggaggtcaaagctgcagtgagccaagatcatgccactgcactccagcctgggagagtgtgagaccttgtctcagaaaaaaaaaaaaaaaaaaaaaaaaaaaaaaaacaactaccaggcctgttggaatgtctgccagtttcaacccacggggatagggtgagatgaacattgattgagcctttacattggagacactataacaaatgctttgcgtacatcagctctttcaaattaatacaattctactagagggggcactattagtatccccaatttacagatgaaaaaaatgagggacagagaggttagatgtgtatctaaggtcacatagctcacaaacgacacagcatgcacccaaatgccaggtttcaatgaccctgtggtgaagtgtgattgctggcatttgcctagtgttgactgtgctctagacactgtattagttacaagtgattctacttctcattcattaggccatccagaaagccttgtgctttagtctgtcctggctactataacaaaatatcataaactaggtggcttataaacacctgaaatctatttctcatagttcttgaggctgggaagtccaagatcaagctgctggcagattgagtgtttggcaacggcccactttctggttcctagatgttcacctccttgctatgtcctcatatcgtgggaggggcaaagggtctctctatctggcctcttttaagcccttaacccattcatgaaggctttgcctcaatgacctaatcacctcccaaaggccctacctcctaatatattatattggtgattaaatttcaacatatggctgggcgtggtggctcacacctgtaatcccagcactttgggaggctgagatgggcagatcacttgaggtcaggagttcgagaccagcctggccaatgtggtgaaaccccgtcttttctaaaaacattttaaaaattagccgggtgtggtggtgaatgcctgtaatctcaggtactccagaggctgaggcaggagaatcacttgaacccaggaggtggaggttgcagtgagctgagatcacaccactgcactccagcctgggtgacagagcaagactgtctcaaaaaaaaaaaaaaaaaaaaaaaaaattacgaattttgcgaggacgcaaacatttaatccgtagtactgatgtggatatgatttgagctaagactctgctgttgattctcttcaaaaacttggcagtagcccttggatcccattaattgcattcaacagtcatgtattttattaatttttgttcctaaagaaaaaaaaaatccagattgcttagaaaataaatgtgactcacgcagagcagaatccgaattttctaagtgatgaacatgttaacatattattttaatctaaagacatcctatccctgaatttagggggagacatttttttaagtaaggtttatttttaaaattgttttgcaaacattttaacagtacatcactgcctcattggatgaatcatatttttaactttcacttcccatcaatttaaacatcatctctcaaggaactgatgggccggttgactctaaatgattttgcctttcatgcagtattgttccatccgcctgccacagaagtgattccaggtcattccaatttatttaattaattttggagatgaaattattttgcccaataactagaatgctaatgggacttagtgtaatggtttagttcaggtttgttggtttgaaaataaacgccttcatttcaatatttgccttttggctgcagcccgttaactggtcacatgctgtaacctcattaacatcaaggcttaattgtaagttaatgtgcacctagtttttgtaaagaaggtttctatcttaactgccaagttttgccccccaaatatagccccaaactggcatttccaacagatggatgggttggtgtaatataattcatgcttttaaacatcatacttttatcggtgccttgataataaatatttgaacttatttttagaagttagaataaagtgaggaaaataaatctcagctctctagagtgtcactgtggtattgagatttgtggaggtgtactacatccgtaattgggagagattgccggtcgtaaaggagggacaatagaacctctgtagaatcaaaggcagaattaaaatctgcatgttaatagctttcctgccagccacgaatagattcattcttcacgtctcagatatataaagcttatttcaaaataaattctggggagcgttcaacctgattgaatctgctgtaagctctgttaatatatttgttcgagtcacttgcactcaaaaggtttttagacagaatatcacttttttatattattcatggtaatgtaattcccccctttaatctcttcagggtttcccattcagtcatgatatgcggttcagagaaagttggatcgaccattaatcatgctatctcgacttctgtgtgtctcctttttgtccatctcttaaatcagtcacttggcagcagcaagacatgtggccactccagaccatttgatcgaagagctcttgttaggagattaggctgctaatctgcaagcgagctaatggaaatcattctgggcaaggaaacaaaactgaacaacattagcaaaatcactacatattataggaatcaagtacattctgaacggcttaatcctacagtttagatatgaagcctaagggtaagatgaacgtcttagatgatctgagatatccaaatacctgtaacaaacatttgtatggtgtatgtagggcaggaaccccatcagaattggggaatctttaaaggattttttatttagccagataaaataaacaaggacagagttgactgagaaaaaagaaagaaaaaaaagaaaagtcaggagaggaggactgaaaattcccatcccacccccgcaacaatgaagggaaatgcctaggttgaaaacacgcaatacacattcaataaatgttcatggttgaatgaagttacctggtagggatttaatctttatttcaaaaagagtggctgtgaatctttaaaaatttctttggttctttaacattctcttcttcactaaacccaaattaataattccttactattgtcattaaaagttctcactggatcattccatttatactcagagtaacaaagcaaacccaattatttgagagacactgaaatgaattttgagtctagaacagcatctgcaaactttgcaaaggttcacatgataaatattttctgctttgtggcctacaaggtacctatcacaactactaagctatcatgcattagtgaaagcacatagataatctataagccaatgggcatggttgtgtgacaataaaactttatttagaaaaacaggtggtagactggatttagcttgtgggttgtagtttgctggcctctggtcaagagcacttgtttgtctgggagacataatttcaaaaatcattttcttttttgattttcatggttttagaacatgatattttctactatggatgaatgctcctcttttgaattttcatttttgtctgacataactcaaagtgcttgctttgggagttcttgttaaccctgacaattcttgtcaaatatcttactcctgggctgtgctggggatggcagcagagtggggtggttggatgggaaggcgggaaagagctagcttggagatgatacgcttttccatccttgaataacttgggaaaaagtcaggagtgtggaatgaagaattggaatataaaggctgagggcggacctaattttttttttaaggattaagaaaaaaggagtaagagagatggtatgacttatcacttggctggggactcagcattaattgataaatccactgtaaggaatgcatgacactgtcttttgaagaaagacattgcatgttaggattctgagtaacagtcaatatattcagtgaaacaaatacctaatatattccatgaaacaagtatcgtgaatatattccatgaaacaaatatcatgaatatattgtgtgaaacaaatatcgtgaatatattccatgaaacagatatccagtatattccatgaaacaaatatcatgaatttattccatgaaacaaatatcgtgaatatattccatgaaacaaaatactgtgaaatcataccactgatttttgaagaaacctaatgaaaacagcatgctcctatatcttttttctgggtgatctttagatatctcgtcttccaaacttttgtgtagcattgtctgaattttcccaagaaaggaggatgttgatctcctatttatttatatttatttaaatttttaacctttacattgacccagtgttgtaaggaaatgggagaatattgccctgatgtctgggaaattgggactcccatcctacaattcaagtgttggaatgttgcagggaggctgggctaaggtgttctgttcctgtctctggttcaaaggaaaggaatagcctagacctaaaggattctgtctggtagctgtttgctcttcgcgcctgtgctttgaatggtgaataccctcggcgggaggcaggcacctgatgccactgcccccgccccacctgcccccgccccgtttctcagatcacacaggcaggctgaggagcgcttaacaccccagcctcccatgaagcatcctgaaaaagcagactttgtcttcctccatcagctttgtttgtcctctgccgagactccagggacatgattgctcttcattttacgctcgagatcaaaataaacagaaaccactttcagctttcccgttccagggttaagtgcccaagcaggtgttgtttctgttatgtggtttgcagtgagcaaaaccaccccctcttacctgtggcagcaaaggcagggagactttgagacctggggagggctctctgctgtgttaacagaactggctcttggttggggggtggggggcacccattcttggcttcttataacacttcctttctcatgcattacctggggctccctctggaaagaaaatggtggagaggttactggcctgatgacccagggacccaggcagtccttacagggacccagaatttcacatgcaaatgtgacctccaattaaagctggacttgattaaccccatttcccctcaaaagatgatacttgtaatgccgttccgatgaggccgtctcactccgtaaactgtcatctgatttacacaaagccatctgcttccatacggggtgttttatttgggatccaggaggggagaaggcgcatctgccccctccatagcatctgaatcttaatgaataaaagcactgacacttctttaaaagggaatagcgtgatgctatttacagtttatacagttttgtaatccagctccatgctggatatttaccgtcagtcatttgaggaagttcacttctctgctggttttctgagtgagggagcgatgagtagaggagcagctggagggtccaggagccccctgaactgagtatccggtgggaggtcagatttccgcattcagaacgagagctcatacggcatccacgcgtgtctttctcatgcatatccccagcccgagtagaagaggacttctgcatctctgttagttctttctcctcctaagaaaaagcagattttaagtaacttatcatttgttcatttaattactcattctttattccttcttcattcattttccttttctccttcctttctccctctgttctctctgttttaacaggttttattcttattgtggtatggtaaggccaagatgaggaaatgactgctattgcaaagatggtttgttactcacagatccatggggactccacatgccacagggagttacctgggaaagccccagggttgggcaggaggcagagggagagggggagaactgtcaagagttttgagctggaagctattatcctcagcaaactaacacaggaacagaaaaccaaataccgcatggtgtcacttgtaagtgggagctgaacaatgagaacacatggacacagggagggaaacaacacacactggggcttgtgaggagtggggttgggggagggagagcatcaggaagaatagctaatggatgttgggcttaatacctaggcgatgggttgataggtgcagcaaaccaccatggcacaggtttacctatgtaacaaacctgcacatcctgcacatgtaccctggaacttaaatttttttaaaaaatgtttttattgtgattttcacaggaaagaaggggccaggcagggtaagcaggcttaggattggctggcttgggtcatttccatgggctctgggacacaggggttgtctttaggtgtctgacccatggctatggggtgattagggtaggtgggtgtggcctggagttcgagcccaataaagccagtggtgagggtgtggctgtgaattggttggtttgcatttgaactgtggttaccagtgagctgtctactatctctaagaatccgctagagccctgtaaagaaagcctacaagggagcaggttttaggcaataataagtgagcagtatggcgccctaatagaaggagggatgcctgtggccaatatacacggctcaaagttgaccatgatagagaacctttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactcccacagcttggtgcagagagaaaagtgtagaaaggtcgggtgtcatacagcagagggctgtgatgctctactgaggagtggaagtgtttttctgagggcatcaaacacgccgtcaagcagggaggcaacaaatctgagttgttccacagatactttgagtgcagtacaagttggtaatgggtaacaggctaaaccatgtggcaccccttccctcttatcagcttcttgctaccatgcagaaaagtgctgaaggtggcctgccctaaggcagtagcactagagcagggatggggaggacttggtggccagatgcatgtggacatgatggaaagggaagagaagaactgtcaagattttcactatcagtggtataagccccgtagtaatatgcctagtgttccattattggaacactaagtatgtgggaattatttatatcctaccgctcaaagccatcaccaaggtctgatcgtgaaaattcaaaaaattgcaacctgaggcataaatgggttttaagctccatacagtaaaacctagcatatgaaaacagttctggctgatgggttggtagaagtgatagatatagatacatacatacacatatatgcacagtaatagatataggtaaagaccttgatatatgtacatatattgtatgatacatatccatgcatatacgtgggtgtacacacacaggtacacacaaatatatatgtgcctttggacaagaaaaaatccccaggacagtctcatttggcttttaaaatgctgcagttgaataggaccgtagaggtggcctaaggcagccttccattcagggcacgcagatttggttcctcagctcccttcttctctatttctgagtcacgtgggctgcacctatctgtcagaagcccactgcccacccagagcccctgactctgaatggtggcccagtgctttctgaagacagaggtgggacctggtgctggagacaatccattcctttcacaaagactgtaagccttacccaagcattaattttgctgcataggcggcctgttctcccacaaagcactgagtaagaagaaaaggggcccggataaaccagcagggcctggcagacaacttctggctcccttgccatttaaggtcccgaggaatgtggagacattggtgggggccagggtgggtttggaaggacggattttttcctctttgtctctatctctctttctctctgtctttttctctttctctcatagttaatgctatgattttgtaaaaaaaaaaaaaaaaaaaaaattctagtttctcagaatcctcattggaggcatgtgtatatttctaaatttaaatgtattctcctatactgtccggggaaaggaagcatttttcaaccaaactgaaagggaaaggtactcttttttattctaatactcacatttcccaaaacatatccttaatattgtacatttggcacagttattgttgaatacttggaaggcgatgtgtatagcatacagagctgcagctttggactttgtggctttaggtaaattacttattctctttgcacctcagtgtattcttctgactaatggggacagtagcaacatcgatgtctcggggcttctgtgagtattcatcaaggtaatatatgcaggccagtaccacattccccactaaaggagtgccacttttttttttttttttactacttgcattattgttgttgttgttgctgtacgtctgaagggctttagtcctcttatgagcaaggcaaaagggacaatgttcaccctttggactggaagtaagaagcccctgcagttccaaatgactccacatttggaatgatttcacaaggagtgcaaaagaagcctcttgtttgactttgcccacaaatgccagaggaggactcttctgagccatgccaataagaaaaatgagaatgccagcttaaataaatgttatcacaatctctgcagaatcgtgatgtctccgattcttaaaagtgtctactgcagggtatttattattctgtgataataataaatcgctgcttatgaaatgcaaggaatcgagtgtcatggaggggaggaagggaagtaacagggagaagaactgtgagagatggaggtccagccaggcccgggctattaatcatcgccctccattatttcctgaagattcattcattgttccataggtacctagagggtcaattagagaccacagacaggctttttcaaagacgcaagagggtcaattaggccctccttataattttctgctttaacagcaaatgccagcctatcgtgcatcagatgcaagggagtttggaaataaacagggtactttccctcctcctctaaaaaaaaaaaaaaagaaaaaatccaacacagagacatggagacagtcggcgattgggaacgcttggcttgctggctgtcaggatctggttcaaggaaggcaaagggaattttatcaccaactgggacttgagaggagcagagttcttctggtctcagagcacggggaacggtcagggaatttgtatgatggagcaccctgttcccatatctgagatgattcatttatcttgagtgccatcttaactacaattagagtacaattataaagtatctacaatggaaatgggtcttgaaatcaatcgcagctggaccggcgtgcggtgagttgccgtgcccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattctcgcacctcagcctcccaagtaactgggattacaggtgcccaccaccaagcccggctaagttttctattttcaatagagatgaggttttgccatattggtcaggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtcctaagtgagaagcagagatgaaaatgtggaaggatgattgtgagaagtccacattgctccatttggacttcctttttgtagtgggctattagattttgcctctgcttgtttctgaatacccaagcttgctaacacagggaaagaccaattatcatgattattattatttaccttaagacctgattctacctatctatgatcacatagacatttggaagcaaagagaaatgcttttcatgtgggaaaaaccaataccaacttcagtgatattatttctccgccccccgcaccgggctcttgggaatatctcttagccctcaattgtcacattcattcagcagatgttagcacgtgcaggcaccattctaggtgttggggatacatccaaaaacaagcaggaaaaccccattctcttcatttctggaatgccggagcactgggcccatggagcccgtttcacttacacgtttttgtcgtctttgagtttccaagaagggagtggcactatagctgaagaggatgaccctctatcacagcctttgctaaaaccactgaaaactgtcttatttttcattttgcccggaaatgcgacacataagtgcattcctctagggaaggatttttttttttttttttttttttgagacaggagtctcactctgttgtccaagctggagtgcagtggcgcgatgtcagctcactgcaacctccgcctcctgggttcaaacaattctcctacgtcagcctcctgagtagctgggattatagtcacctaccaccatacccagctaatttttgtattttttagtagaaacagtgtttcaccaggttggccaggctgctctcgaactcctgacctcaggtgatctgcccaccttggcctcccaaagtgcagagcaggaatttcattggatttctacactgctgctttttcagagcctggaacagtgccaagcacatagtcggccctcagtgagcatttgttgactaacttaggtcacagatgtggggctgtgattctgaaggccccggctcattcttggctttcagagaggtttgctttcactcctgggcagcagctgccctggctgctgccaccaccgccttcccggaggtcagctttattttcagtgtttttgcccttccgatccctgggtaagaagtaagaaaatttctagtgcctggagtctccatcctcgtttcccagtcatatcctagaagctgcaaattgctggcttgtggatgtctttggtttggcctgctgaagtttgttttggattttttaatgaaataaattagctgtgaacatttaaaacttgggagacatcccatcaaaattgggatttcctgcttatctcgacaaagcagatctggcatcctttgcctgcattttacatttggctacagttggctggacttgagcagcggctgcccctctttagctggggcatgtgccctgtggtttgccatagtacccatcaggcctgcttcactcattgtagaaatggcctggcctcctaggcattggagatttctgttatgctcattcatgagcttgcctgcttacacctagctgttgtgttggttctcataggtctccctgattccagcctccaattcactgagctggcctctgccagtgtcacttctccccagtcttggctttgatcaagcttggaaaggcctggcctttgtgttgtcacattcttctgcctagagtatgccttttccttcaccaaaccaagtggctctttcggaagacttgcctgaatcctagaccccttctctctacaaccttcagtctgagttgggtaccttgcatcctcctttgttcccatactaacccctacaaccatggtcattttgtggttatctgtttaattctctgctggctattccaggctgtcagctccctgactacaaggactttgttgctcacaatcatatccacggcatccacacaagatctggccgctacgtggaaggacacatagttccgtctggcttggagcctagcttgggagagggacagtagtggggaagggtgagcttggagatagagctgaccttcccaggtgcttcagcagttacagcaagattctagatcttaccctgacagtcacagaaagcactgggagcgtttatgaatgttgtggtatctcacataataaggggaccatgcatgtattttagaaagagccctctggcttcagggaagaacgatggatttgtgagggtcaggactggtagcaggtgggctcctagaatagtcccggcaagagatcatggaggccagagccagggatggatatagactaagacatgcctgtagactgagtgtcgaggagcaagtagatcaaattctagcatgagactgggagaaagagatgttctccagccaatggatttatgaaatgaatgaactttttccctttcctcccaagcattgcctggatcaccttgttaatatggtttcttattaaacgtgctggaaaaaagaggctctaagtgcgtatgcttttaaagcaacactattagcaaatggccactggcttcatttttcctgtgcatatatttttgtgtattccgggaggattttcttttctttttctttttaatcctcctcctcaagggaaacattcttctcacaatagcttcctggtagaaagttctaactaatgactttaatcgtgtgaatgtattgcagaaatggacaggacaattctcagcccattcatcttacagacctcaagtgaacaggcacaaaacaacaggctccaccctccttcccccctctatctcatactttacctcaatttatgacttggcttacaatccgttgcagaaagcctagctccccagcttctcctgaatctacgtttttctattttgtctgaactagccaaggtctctggagtttgctgttatattgcttcagagaaattagtgacattgaaaggctgttgtcttttttagtgtacttttggttgttaggagaaatttacaaggccatttttttctcccgtctctgcagttcaggagattatattagaaaatattctatacaaaaaatatgcatagtagggcttttctccagctagtagctcagaataagtcagtactactgaaacaggtaccttttgtggaattgattctgaaatctgtttggatctgaaatctttctttcttgcctttgagtaagatacggcagagaaaaacaattacactagctgctggtctgtatttactggttagaatagaatattattaccatcaagaataacattagtggccaggtgcggtggctcacgcctgtaatcccagcactttgggaggccgaggtgggtggatcacctgaggtcaggagttcaaaaccagcctggccaacatggtgaaacccccgtctctactaaaaatacaaaaattagccgggtgtggcggtgcatgcctgtaatcccagctacttgggaggctgaggcaggagaatcccttgaacctgggaggtggaggttgcagtgagctgagatcacgccattatactccagtctaggcaacaagagtgaaactctgtctcaaaaaaattaatgataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggagaaaattttatttgaaagctgggattgttgcatgctgcagaatttttttttcttttgctattgctgtgtaacaaatgaccacacacttagcagttcacattcacatcttgtttattaactacaattctctagatcagaagcctagacacaatgtgactggcttctctgctcagggtctcttggggacaaaataaaggtgtccgctggaggaacatcctttcctgcatgctctgtggaagaatccactgccaagctcattcaggatgctggcaggattcagatccttgaagttgtaagactagggcccctgtttcctactgacttctgctggtggctgccctcagctcccagaggcaacccacattccttgacttttggccccctgcatctcaaagccagcaacagaaactctcttgtgcatggagtcccctcctgctttgaatctctctgactttccttgactttgatgtctaggtctggatttcaagggctcagaaactctctcatgcatgtagttccctcctgctttgaatctctctgactttccttgattttgatgtctaggtctggatttcaagggctcacgtgatgaggatagtttctttatcttaagggcaactgatgtggagtcttaattaacactggcaaaatcccttcatgacagtacctagagtatgaattgactcagtaactggaagaatgcatgcgtacaccatggaccgggaatccgggaggccaatttagaattttatgtatcaaagccccatttttttttgaataacagaaaaaaaaaagagacctgatatttggagagactttttcaaaagcagaaagtttaatataaaagaaagggggtaattgaagaagatataaactgcaaagaaaggatgttaggtagagcgccttatagggaatcagaggttttattacaggcagacacggcttcacctgtgagccgagcaagtgattttgcctgcagagaagaacgcagggttccttctatggctcaggatcttcagttaccagcagtggaagtgaattgaaaatagttggtctcttgagtgacctgatgcaactcattatcttctctgtgccttaacgtctctatctaatttcccattaaaagtaacaggaaaaagcgcaatgacttttgcaccaacctaacaatgggttgacattcaggattgctataatgatgaagcaatggcaaatggagtctttgtttttagccccgtggaggcatatgctgggcactcaacaaacatcacttcccctgcccttttctcagatagagttatccaaacaaattggatgctcaactctggatttgatccaagctctctggaaatctctagcttctcaaactgtttcgtggtggagtgccttttgggcacaggagaaggaaataagagcctcgcgaggtttgggaatgctgcctctagctctcacactgcatgcagaattcctactctgagagctcactttatctcaaaaacccatgcatattctgcatctactctgaattccgcagtgttgtgtgttactatacgatctagtgttttcgttgcttacaagttagattcacactccaggaatgtatctgttcccacatcccctgatgctgagcataccagagttaagggaggcaagcaaggcccctaacctcccaggttcatggaggtacccattctgcacttgttgaccttgagcttgaggactccataaatgtctgcccttggcattgcacgtgcctccctctgggctgaccctgctgggcctgtcacttactcccattggagaggcctgtttccatacatagctctttgtcagttgctcacactcggtcaatacttgccttcctttgaggccatctgcactcactgacaatctgatcgctcccctgaatggaggtgaaagcatgcaagctaggagttaagatctttaactcagggaagaccctgtctatggaagtgctgagctcttcagtgtcatcacagaaaagcatgagcccctccctggtacggagtcatcacatcccatagctgagcgacgtcggagctccacgatggggaggtgacacatagtcagttaattacataaagagaacttgagcaaactcttactctgccatatgctgtgcagatccctctgaaaagctttacagatgttcttttttttttttaatccctccccctatctttctttctttgcacccacgatgctctgcacttcaagctaaatataatgtatctgattttacagcatacatactaatcaggtttgaaagttgtcttgtgaggctttaaaaagctagccaagagcagtgcgatttctccaaaaggatgtctgcaatcaagatgattacatgggaaaataaatcataatttatattgctgaaaatgtcatttgcaaaacactttgacaatactttcctttcagtctattttcctgtgtatggggtaagtgttgcccttctgcaactttccttttattttatttatttatttcttttcaatactctgaatatcactggagcagctgcagattcagggcagtatggggtggttcaggaacagaactgacaggtattgaagccaaaaattgaacaataacaacgtaggagggagaatccaaagatagtatgtgttcaggatacgggcactcgtgtgggtgaacacacacacacacacacacacacacgcttttttttttttttctttttttttttctcctattgcaatagaacgtaaaggtagatttttagaaccaaatgccttttaggaagctacctctcttccaccctgctgcctttgtgttgaataaactatattaaattatccaggaggaatgattagtgatctgattcattaatatcccttgttattaagaactgtctgtatttgtgtcctggttggcagatattaagtccacagataccaataattaatatctatggttgattgtaaaaatggccaccaattcttccctgtcccctgcatatgtacatccttgcactgtgaaattgtagatctcgccctccaaaggtgaagttcgtttgtccactccttgaaccaggatggcatgaaacttgatttgaccaatgaggcatttggaaacacggcacaagcaaaggcttgaaacgtgcttttatgttggtgcttgcccacttgctgtgctacgaacccttttacttctgggtgcgaacaagcccaggctagccttctgggcgatgagagacacaagaccatgtttccatattgccccagccaagagccaacctacagacgcaactgccttgctgacagcagacacctgcccagctgagcccagcccaaattgctgactcatgcaatcttgagctaaaaataagtagctgttgtttatagccactaatatttgtgatggttcattgcacagcaaaattgaatggagacaatacttttgaaattgactcttcgggagctgttgtaaagaagtaaaatgtgtagtgtttgcccttttcctcagctgtaggcctggtatgcagaagtattcagttatttggtgagtgaaccctcgctgatgccctggctagtgttttctgtctcaggaagcatgaacatttcatccagggttatatgctacagggatattcaagaaattgaagatccttgaaaatctagtctccctcacaaggatcaggtggcaggatctaatgggaggggtagagagtgagtgttaacacacagagaacccaggagacctttctcagaggtctcatatcaagaaaagatcatttctcctaagcaatcaatttctttttaaatctgaacctcatatctgagaatattcccttcttttatctggccactcgggagctcaaaaataaatttctggcacccttcttcctggctccagtaaagtcatacaaccatatggtacctctctggcaactaatttcacctatttccttatttgtttaaaaattttaacttaaattttttcccctcaagatctatttacggatcatcagttttattttttcttttctttcctctttttcttttgctcccttttctccccactcttgactcttctctagtttttatatgcagtttgtatttatccatgccatctgaaatcctccttcctttttaacaagacaagtagaaaacgaaaacaacatcaaaggatacactacacaattgttggagccctaggaaccgagagaagagtacaagcaggttcttgaactgttctctccccagcaactataactggaaggaacctcagtttgtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaacaacacatgcttatcatgttgcagttctggggagtcacaagttcaaaatcagtctcacctggtcaagatgtcagtagggcttgttccttctggaggctctaggggagaatctgtttccttgcgtttttcatcttctagaggcctcctgcattccttggctcttggccccttcctctggcttcaaaccagcagtttaatatcatcacatctcctttactgattcctcttccgttgtcccatcacattctcctcatctggccctctggccactctcttataaggacccttttgatttcattgggaatacccagataatcttggataatcactccatctcagggtccttaatcacatcttcagagtcccctttgccatggctgatgacagagtcacaaatttggggaattagtgtgtagacttctcttgtagggagtcattattactctaccacaaccactaattctggacttcacgttccctcatccatagagcagggataacaatatcctccaggctatccgcggaagtagagaatataagctttatccagggggccactcagtgatgggagtcttccttatgaagctgtcccagctccatctctcaggactgaaatgtgggtaagaccatcacatttttcatcccccgccccccgcccccaacattgactgggcagatattcatacaatggcgattgttttgtctgcctggatggctttaacataataccatagactgggcaggttaaacagcagacctctattcctcacagtctagaggctgggaagtccaaggtgaagccatgggcacattctgtgcctgcctgaggctctctttctggttcccagatggatgcctttgtgtgtcctctcatggcagagagaggaaggggtctggaacctttctcttataaggatactaatcccatcgtaccccgtcccccatgatctcatttgaaattagtcacctcccaaagccccacctccaagtactgtcacactggggcatagggcttcagcatatgaatttgggggagctggggagaggaacacatacatttagtccataacaactatctcacttacctctctactaagtgattcagaaaatagcaagtatagtagtgggagaacatggtatcagaaccaggagagggtcctctggctttctgagttctgccaaaaaccaagttttgctgccttgggcctgtggcttctcctccctgattgtcgctggccttgctgtaaattgtgaggcatccatgtgaggcacaggatggttccaaggaccaactgaggctgtctgtgctgaggctgggagggtgtaagtgctcagaggcagccggaagctgtggtttttacctcccaagactgtgcagagcttccttcttctgtagggagaagtctctcaggacagggctcacaacagtgcagtcaggagattggaaattttagtgacaccaaagtgggctttacttcctcctcctagaattcctgccagaaaggtggagatgtgcaataaactgagcaccgatagagtaccaagaacatgctttttgcacattgtttgattcatcaatcagagtggggcatggctgtcatcagttcagagttgaaagaattgaagatcaaaggggtcacgtctctgtgaatagtattagtaatagcagcagtatcgatagcaatcatagtaattaaaatggaagcaaccaccagtgtaatcatagcagaaactcacatgtgtgtgctttctatgtgccaggcatgaggctgaagtcatacattcattatttgttaatcccaccctaagtgataggtgtattcatcattctcagtatcagaagaagaaactgaggttcagaatgacccagtaaagatcacaagcccaaccctggtgaagggcgtgattggcagaagcccaatttaagcccccatcatgtcctgacgctttcccaaagctgagctgcctgccagggtctttgctcttccactgccaagaagtaaggttttggttgggcgcggtggctcacgcctgtaatcccagcactttgggaggccgaggtgggtggatcacgaggtcaggagatcgagaccatcctggttaacaccgtaaaaccccgtctctactaaaaatacaaaaaaaaaaaaaattagcccggcgtggtggcgggtgcctgtagtcccagctactccggaggctgagacaggagaatgtcatgaacccgggaggcggagcttgcagtgagcagagattgcagcactgcactccagcctgggcgacagaaggagactccgtctcaaaaaaaaaaaaaaaaaaaaaaagaagtgagttttttttgtgtattctgaaaggttcccaagctcgccgcagcctgctattgtatttaaagggtgccctttgctgcgtaactagggcaaagaagaaccaactggctgttccccactggctgtggagagttccagctcatccaccctgcctctgtggctgagtcggggagaaaaggacaaagtttttctcccgcaactgggccaccaaaccagcagagcctccagccggggtggtctcgaggaggcccattaccggctggagtgacagagtgtgtcaagcctgcagctcgtcccgtgtctaatggaacagaaacaagcaccctgctgcccttgttttccagtggctcaccggggctctgcgaggtttattaatcttagcgtataatggaaaatgtgttgccatgtgaaatctagagcctctgttcactactccgcgaattgaaggcggcaggagtctttgtctcatttacacacagtgcctgcgagagactcttagggcagaagaacgccgtcgtaaaaatccgtgcggaatttgaaagtgtgcattaatgcatgtgaccagatggttctaaaatatgccactttcaccaaaaatcatcctctgaaaaactcttctgaacaacatcggctgtgcatagtaactgccttgagtggggccattttagaaaatatatgaggtacgggatgaagatgagggaggaaaatggttcctacttatcattactttgtccctccaaaagcctgcatgcgggaagaaaaatccacccagtgcaagaaccgtggcagtactcagaccatttagaatcactttgagttattaccaagaaattgctaaccactgctttccaagttatatattaaatttttcttttttttaaaaaaaagcttccaactttttttttttttttttttgagttggagtcgcactctttcacccaggctggagtgcagtggcccgatcctgggtcactgcaacctctgcctcctggattcaagcgagtttcctgccttagcctcccgagtagctgggattacaggcacccgccgccacacccagctgatttttgtattttagtagaggtggggtttcgccatgttggccaggctggtgtcgatttcctgaccttgagtgatctacctgcctcggcctcccaaagtgctgggattgcaggcatgagccacagcgtccagccccaacttcttaaaagccagaaacaactggctgttagctgtcacaatattaatactagtgtgtgcaagtaagtttgttttctgcttctgtcttacacgttttacgggctatcagtagatgcatctaataatcctaacactgtcatccttatacttgaggtcttattgtccacttctaccttagctatgtaaacagatgagtaacctactctggatttacccagatagtgctgttaggcaccacacacgatgagattggaggcacctgggtgtcagcctcttgggctggctcattacaggccactctgtctgaggaacactcaggtttgcaaaccgtttcttaaaattacaggatacctagggacctgttggggtgggagggaagaaccctatgggcagaaatgtgactttctgtagcaaagatgtactgtttcccactgagaagaatcaaaaatagaaaagtgcttccttgtctctctatattgttattaaaacaagtagatgcattttcattgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgcatgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattagtgaacgttttcatttataaagtgcttcttccttatcttgaaccttttatcctcttcttattgaccaaagagagggcatatctttgggagctgctaataaaccatattcgtaatatgatgtgacctcatcgacaggctgctgcttctagctcatcatcttccttgatcataaatacccatcggtacctcttgtcacatggtgctcttagagcttcctctttgaatttcacatgtgataagagatggtttccatcctgaagagcttgcagtgggatggttatcggaaagattaaaactctaaaactaacaggtggatataaatataaagaaaatacagtattttgttgatttatgttcatataacttctttattggtaaaagggagacaggtgagaatacaggaaatccttgtggccttgtttgccttttttagaaatttaactttgcaaacaaactcaggggaaactagtgaggtggaaataaagaatgctagactacgggtctggggcccaagtgttttattaatataaaaacttgcgtataaatgtccagtttcaccaccaaatcctttctgaaacattggtagtagatgaactaatgcaacaatttatttttctttgagacaggatctggagtgtggtggtgcaatcataactcactgcagcctcggtctcctgggctgaagcgatcctcatgccttagtctcccgagtagctgggattacaggcatacaccaccatgcctgcctaattttttttaatttttcttttatagagatgcagtatcgcttgttgctcaggctggtctcatatgcctggactcaagtgatcctcccgcctctgcctctcaaagtacagggattataggtgtgagccacgaagcccagctgctgcagttactcaaccagcttcctactagaagccaggcgtttctcaagcttctgaagacacaaaggtgaaccccagacaagccaggtttacagagtgtgcatttcagtgggggagccagccaaaaaatcagtaaacaccaagataaaatatattccagtggcgatacattttcagaaacaaacaaacatggcactgggctggaaatgaatggcaggggagaaggcgggcggggcaagctttggaaagcacgggcaggtaaggacagggtttcaaaggtgagaaggagctggcagtgtgaatagccaggggaaaagtgttttgggtagaaggaacagaaagtgaaacggtgccctggcaaggcaaagattattcattgctgaagagactatgttgcccagatgacttgttcatgtaatctgtgatttttaaatttagaattgaggtttgaagggaagtattgctcctttctttatctgcaatgggaaagcttactgtagttacttacagtagaagagaaatgtacatttctgaaaatccactgaggaagaaaggggcagtgatgattctaaatgttaataatgcagacagcctttgctttatgtatcaatttttgtaaatgtgttgcttaaatagatttttatgagccagtaatggtttagaaaggtaaatgacttgcccaaggtcatacacccagtacacttgggagccaaaattcatcatagatgactttgtgaaatgtcccattaaatgtgtatatatatatatagtgtgcattacagcttaacagacacacattcatttgacacattatgttttaactttattaataagtttttgtgggcataggtcttgttttgccaacttgacatgtggattttaaagggcaagtgccttagaatacaaactgtcctataaagaataccatattatcgaaaggatgttcaaactcatcagttagaggcgttgcagttggctgggtgcagtggctcacacctgttatctccgcacttaaggagtccaaggcaggtggattacttgaggtcagaagctccagaccagcctggccaacatggtgaaaccccttctctactaaaaatagaaaattagccaggcgtggtggtatgtgactgcaatcccagctactcgggagggtgaagcaggagaatcgctggaacccgggagacaggttgtagtgagctgagatgtcgccactatactctagcctgggcaacagagctagattccatctcaaaaaaaggcattgctgttaatacaacaatgataagttatttcacactcaccagattggcaaaacgttaagtactaaggtcataacaagcactggaaggatgtggagaaatagggaattttatgcattactgaactgaaacagccattttggaaaatattttggtattacgtaataaagtagtacttagcaacttatgcaatttggttcctataaagatgccttagagaaactgttgagaactaggaaaagctcaggaatgtttctggtgcataatttgtgatagcaagaacctgaaagtcctccaaaagccgtctacaatgaaatggggaaattaatggtggcacattcctgcataggagatagcagtgataatgggtggataccagaacgtgcatcaacacagaagaatctcagcaacataattcaggattaaaacagcgtttacagctgggcacagtggcccacacctgtaatgccagcactttggaaggccacagtcggcagatggcttgagcccaggagtttgattccaacccgggcaacatactgagaccccatctctactaaaaatacaaaaattagccagtgtggtatcatgtgtctgtggtctcaggggtctcaggtacttgggagactgaggagggaggacctcttgagccgggaaggtcgaggctgcagtgagccatgattgtaccactgcactccagcctgggctacagagtaagactctgtctcaaaaaaaaaaaaaaaaaaaaaaaagcatttacataggagaatatatacagtatgattcaatttatagaaagcttaaagtataggcaaagctaaacattcaggatatttgataaaactataaagaaaaccaagggaatgaagaatgcaaaatatgagctagtgttttcccaggtgtgagggacggggcatggttgggaggaaaacagaatggtgccatggcgagagatacacaggggaggtattggaaagttctgtttcttaaaatgagtgacaggtacctaggtagtcattctatatgttattaaagtgtacacacattgcttatgtgaagtcttgttatatgtggcacatatcacataatctgaaagaatctgcttcctgtagtaaaaattaaaaaaattatagccgggcacggtggctcacgcctgtaatcccagcactttgggaggccaaggcaggcggatcacgaggtcaggagagagaccaccctggctaacatgatgaaaccccgtctgtaccaaaaatacaaaaaattagccaggcatggtggcggggtgcctgtagtcccagctgctcaggaggctgaggcaggagaatggcgtgaacccaggaggcagagcttgcagtgagccgagatcgtgccactgcactccagcctgggcaacacagcgtgactccatctcaaaacaaacaaacaaaacaaaacaaaaaaggtttaagaaatgttctagtaccttgaaaccaaaataggtatcagatacttggctgttttgttttttcttcttagccattttgacctgtgagattttatgtgatgaaaacataagaatgtggtattacaccctgtgatttgaattttccatactccattccattctatatgtcagatgcatcttcctaaaacacacctttgtcacatcactcctctgctcaaaaacattcagtggctccctgggccctctgggactaagtttataatgctcagcttgtcattcctttgcccagtgtactctctgtctcactaatttgttcattattttaatgcattttcttgaatacacttctgtagacagccataagatgggtagcaggaatgctgcactgaaccataatccaaagctttcatcaggttcacttgcttcctgtccttgccacaccatctgctcattctcgatctccacttgaacacacttcacattctccacttgtgtatcattcactattcttgctacataaattaacacaaattttgcagcttaaaacagcacacatttattatttcatggtttctgtggatcaggaatctgagtatcagacttagctgggtcctctgcctagggtttcacaaagttgcaatcatatattggccagggtgtgttctaatttggtagcttgactggggaagaattggcttcccaaatcacccagattactagcagactttatttccttgtagctttttgactcggcctggcttcttgctgactgttggctgttggctggaggtacccctcagctcctagaggcatcaacagttcctgaatatctgggcttttcccacaaagcagcttccttcatcaagccagcaacaagagtttctggggcaagttggtcaacaagatggtgtcttacatgcccaatgtaatcatggaagccatgtatacctcatcacatttgccagatttctgctgattaataccaagtcagaagtcctgcacacattcaaagggaggacactgcacaatggtgtgaataccaggtggtagggattatgtggggccaccttacagtctatcagccacaacttgaagtatcttctctcctctttgctgccaaataatgtctctgaagactgtaagacctgaatcctatctaaagttgtcggtggttgcttccttcctgaaagcaacaagaagcccatgaatgtcttatggcctgaagatctgccttcaaagactactacctgtgttgtcacaaatggcaagatttcatcctttttatggctgaataatatttcactgtatatgtgaaccacatttttaaaaatgcatttctgaacctgaaggacattatgttaagtcaaataagccagacacagacagacaaagacatatgatctgactaacaatgtggaatctgaaaaaaccaagctcatagaatagaaacagagagtgagaatggtggttgctggggctagggggtcagtgaagtggggaggtgttgatctaagggttcaaacttctcgttaataataaaccagttctggagatctaatgtacagcatgagtggtgatggatgtgttaattaattcgattgtgataatcattacacaatgtatatagtaatcaaatcattactttatagaccctgaatatattcaatatttatttttcaattatatatatatatatatatataaatatatatatatatatatatatatatatatatatatatatatatatatatatatatatatatatatatatatatttaaagctgtcatggaaagccttaaagttaaaatacgaagatttttgagaaaaactttgcatattttaattgctgtctggaatcctccttcagctgggatgagaaaccatctctgggttagttctgtccctggaggtgagggccagacaacacatcaaaactgactttttattttttttcaaagttgttaagactatctaagattcagatctccctaatactgttcctagttagtatttagaacgtatttgtttagaggatactagcctgaaatagccctatctccaggttgtctgatgcgatgaggatgtggtgttaatcttacacctacccattagtctataaaactcctgagggatgctcaggaaaccaaaaaggatgtctgcatggaggacaagaaggcacaaatcgtctgatttcaccccatcctaagatcttgtgacttcagctttgttttggactggggcattggatctcccacatgccctctcttaagtcgtgcatttgacgcatatttaataagcacctactgtgtgccattagagaccatgatacagttttgaaagcctagcctgaataatggatgacaccctcctaaagccacgatttggtcttgattatttttagcactatgaagaaaaatttcattaaatcacaactctatttacttttaacccaacatggtgaagttatcaacatataatgcctgtctatactttcagatggaaaatgcctagataaatactgcatgggacatttttaaacatgtaaaaaaatcaattttcgtaaggttacatctttttacctctttatataaaacatgctatattaaaagagagattaaattttaccctgtggagtaaaatgcaaacacaaaattatttttttcatttttcagagcatgtactggattatcatttatttatgaggctttttttaatctagaatatatggaaatcttttcttgaagcacaatataatattgaattgggaatgttgtctgacagtttccctcttaccgttgcatagaatgactctcctgtatgaatttttaaaagaaacttcaatatgctatgcatttgaaagggaagaagtaatcaccataatcttgaggtatcttttaaataggcttccttccagttcttctatgtttcaccaacttttctacaacaaataatgcatctgtgatttttcagaactcacaaaatgtccagctttctttcttttattcaaaatttatacttcataattgaagttcacctcccaaaagacatagcttggtttagcatagagctatgatgtgttttctctttgttccttttgcacactttccttgtctggaggcgttgggcttggatccttcattcttcatgaggctgatgtttttccatttcggtttccttaagtggtgaagctgcacaaccatgaaagcagtgaccacataaaaatgctgctttgaggcctggtacctcatgcctataatcctagcacattggatggcccaggcaggagcatcacttgaggccagaagtttgtgaccagcctgggcactatagtgagaccctgtctctactcacataaaaatattagctgggcatgatggctcataggtgtagtcccagctactcaagaggctaaagggggatatttcttaagcccagaagattcagactgcaatgagctatgattgtgccactgcacttcagcctaggcaacacaacaagaccctgtcccttaaaataaatgctgccttgggtatcttaatcctttctcaagattccttctaaggctaacatttctttgccatccccacactaccatctgctcacttttatatatcttgaccattttatttttcatcccatcttcactccatgtaattagttagctattgctgcagaacaaatcaccccaaaattcagtgattagtttataggtagccccatttcacccatctcattctatagctcaggttgaaagttgagtcatgaattggggaacattcttctcttggtgtaaattagtcaccagtgtctcatagggttgggctgaaacttaacacatcccatcactttgattggctaaagtcagttacataaccaagcccagcttcagaagggaaattgtatgccttacaaggaggtgagaggatggaaaatgaatatttgctgaacagactttctgtccagtttgttgtatttggtggtggtgcagggcaaatatatgtttaaaaccttgttcagatttttagctttcttcagaacagagcttttaaaactgagcatttgtcccctaaattccagcactgcggccatgagtaaagggtgccctgaccacgagcaaatcatttagctggctcacctttcatgcaaccttgaattcaccaggaaggaagttcatgcagccctgggtatgatgccctaattttgagccaagccagctagagttcaagtccaaaccattccacttcctagctttgggacgatgaacaatttacttatgctttctgggctttggttcctaaattatttaaatggggatgattacatacattcatcattttcaccttctcaaagaccttctggacaattccccaattcatagctctgggagacagtgtgttgacactctatttgaccacatcttcctagcagtcttgcggaaggtgccactttgcgaacgatctgttgctaggtaatgtcaatgacatgactttcagtttagcacatgtacagatgaccttgtttgggcttgtgccgttggtaattcagtttcaggatttccgtttgacagaatatattcaagggtggtttcttgctatcagttgtacccttgtggccacagtttttccagataaccaagactcactaatattttcacaagaacatttgtcacctaggtccagatttcagaggaaaaaagtataccgccattgttcttgtataaactttataaaatatttggggaacatcactagccacctgcttccgaaagtacttagatactgtgtcatcttaatacaagacactatgcactaattaagctgttgttgatgcttttttgcctttttgacaattaaaaataatctcataccactggattagtctcttgcctttcaattttatgtttatatacaaatatatgtgcataccaaattttatatatatatatatatatatatatatatattttttttttttttttttttttttggtcggagtctcaccctttcacccaggctggagtgcagtggcgcaatctcggctcactgcaagctccgcctcccgggttcacgccattctcctgcctcagcctcctgagtagctggcactataggcgcccaccaccatgcctggctaattttatgtatttttaatagagacagggtttcaccatgttatcaggatggtctcaatctcctggcctcgtgattcacctgccttggcctcccaaagtgctgggattacaggcgtgagccaccgcggctggcgaaaattatatattatacacacaaacatacacacacgcacacaccaaatttaaaaagacagatacataggcagttgttatgcagtgtttgaaataaatttattgccagctatgggtcatttggaaaaagatcaatatgatgcatcaacataacaagtaaatggaaatgaatacaaccgcatggttttctgaaagcacggtttcctgcgcggcttccagaattgcatccctgacatttggaacatgtgttacatgctacagaacatctgtctgtgaacaggttaatgggaaaggtgcatctctacaaacaaatattacctgtaatgctgttgtagctttgttgattgttgatattacttatgaactttcttgcttttcagaaaccaccaccacaaaagaggcagtaacattagtattacattatacatcttaggcatttttttcctttgcccttttcgtaggtttttgtttgtttgttttttcttgtcagccacttcatcatgtttggtctctcgtctttggctgtgtttttctgtttctagttattgtgggtgttaaaaatcactttaatgattcagcaataattaggaagtccctatttgtgggtgttactttactaactaccagggatgaaaaggcaggttttgctttgttattacgtcacagtttcgtcaaggagataagtacttaaattgcagtagagtgtgacagcatatgtcgacggtgtgagtgatatggaataagagtgagacagggaggcagggcaggctccaaaggcgaagagatgtctgagccaaattgaagggtaaactgagttcaccaggcaaactgaggaagggtactcaggctgaaggatcatgggaggggaggagcgtgagttcctcttaagtgaatataaaccagggggtaggaaacaacatgagatgaggctggcgagagagaaggatgctaggtgaggtgctgtggtgcgccagagactgcggaagtggctttctaattaagaaacagaagccaggaaactcctgtacttcaaggttttggagtgggaaagttgaggaaatgtaagagatcatctctgtctctatcacattaccgacggagaagtgggataagaactatgtgtgttttcacttcttctttctttagagaaaacaaatatcatctgccttgctaggtagttgtgagaaatgaggagataatatctttaaatctcctacggtgatacctggaacatgatggtgcttgggaaatgtctcttcttctgaaatgaggctgcctcgaagactcactggaacccaagcaaagtgtctctgcatttcactccgagccatcgacttctgttctgaatgttaaaatgcaggtggctgtgagggagtcttctgagtcatgccagcgtttaaggcgcttgctcttctttgtgcacattcctgcttttctcaaagcctattgaaagcaagggccatgtttgctgttttctttgacagaggaaattttttttttttttttgagaccgagtcttgctctgtcacccaggctggagtgcagtggtgcaatctcggctcactgcaacctccacctcccaagttcaagtgattctcctgcctcagcctcttgagtaggtgggactataggtgtgtgccagcatgcccggctagcttttgtatttttagtagagatggggtctcactatgttgcccaggctgacctcaaactcctgcagtacagtattgcaccttcctcggcctcccaaagtattggaatatccggtgtgagccactgcacctggcctccaacagaggatttcagtcaatgctgagcaccaattacagattgattgcctctgtgattccaggtaaataaccttgttgtggagctgagtctttcatcaaaaacaaggactcctggcagatgcccagaggcatttataagcagtcccatcacgaacaaattgccaaatgcaaggcctgaacaaaagacacagaaaggatttctttatcgtaagcacacttctctacattacctttacaatccaacaactctggtattagtaaattatagaaacaacttttgtaacactatcttgtttgcagagtatatgaaaaatttgaagttaaaattcagctccacgaatactgcagtggtgagaaaatggcgacaaagattagtcttctgtgagaagtctgctaattattcttcatttaataatgccatgtatgatggccttcattagaatgaattcttctcaacacctatgcctctttcacctcagacatgccttctaattttctttggtagtgtctgcccacccaggtggtaatttctggtcataagtctaatttagtagccagctaaaggatatctgtgaacccttcgcaaagagtaatctattgaaaaggaacaacaaaaaagtatatctgtgaacttattaaatgactttaatcatatgaaaatcagccatcagccttattagagtggttgattttttttttaatctaagagctttcttggttattttctgttcttaatcattgttgtatatccttaatgcgcaggacatgacaccgtataacaagtgttttaaaaatatttacaattctgatcttataaaggaaaaagttacatatggtcctttgaactaattgctaaaatgacactacattaattagataattaagggtcttgagcatgtggctattgtattcattgggctggaagccaaccttttctatagctgagaaaatgggttagcataattcaaaattcaattgctgtaccctttttcatatgaatagataatacagaatgagccttaaatctgggttggaaaaactaacaggaactggttttattttaattgagttttaaagcacttctaggccatctcattgtctttatagtttaaccctttgaagttgtgactgccaacgtgctagtcttgtcgtcttacacgttaatggtaatgatctttttagatttattgtgaacctctaggaatgttttttttaaccagtaaatgcactgaaacatggaatcaaagtctctttcccgtgggccccttttcattgggaataaatgctacccatagattgaagtagtttataccagtacattttttaggtgccttaacttaccaaggttatttgtcaggaaaattatctcttgtaacaccaggttccctacctttagatgacaggacttaatacaaaagttttccccataccaactagtagtgtaagttgatttcatatccttttatttcataaagttttgcttatcgggtttgtcatcctctatttgaaattaaaatgtgtggtctcgagatgaccttaaagtatctgacccccaaatctaatcactcctagcatctgtgaaaattgacaaatatgtcaggtataacttggggcatcaaaacattgttttaaatatttcgtttgtagacaaggcaaagatcattttcaggttagtcctctgagaaggaacgctgggtgcagaagcatctttggtttctctgctctataatcggcactcattatctatgggtttatacgagcagaaaatgtacagttatatgttcagcacaagtgaattattgattggatttacggccagaagaatgttcctaagtggtcaatacatggccaaagtgtgtcaggtgaaggtaaaaatcaagtaagatctatacttttgatagcaattgctgttggattatgttacgcttgtcatctgaggttactgttgaatatagataaaaatgttaattgtattaatttagacaagaatgtggcttcaatgagtatttcttacaaagtgggagtatcaatttttcttaaatgtagagatttagtttttcaaaaattatattttttatatgacctgacgttgattggcttgcctacattctcttttggtgtatgatgacagtttaaaaattcggatgcattttgcacagaattaagacgttatgtgcaatccttgtgtttctaattatatgttgatcaatgacacctttacaaaactgtcatcagtctattggtggttgattggtccaaccttagcccgatacctctatctccgcttagtcattcctggtgggtgactgatgacccctgcttaacagtaaacttgttatgcatagggttgttagaaaagtcttcatcaatttgagccaaactgtggctcccagctacttccatcaggggtccttattccaccctttgattgcaaaatgccctgaagacctggtatgtcttatgtcagttacaagaggcccttctagtgatgtaccgggaacctcctatgggaaccagagctctgctaattttggggacaagaaatgatgaaaagaagtgccttgttcttggggcatcacagtctcatgacagagtgcatgttgtcaaatgcgcgtttaatcttcttaagctcaacttcatgcaagagacctaggaattcacagagtgaagatgatttctccattcccttctccgagcagagctcttgaagaagatgggagttaggagaagtgaatcttttgttttcgaagcctttgtccttgtgagtctcttaattggggtgtcttgtaatgcaaagtctttaaagatgtgtgttcctgaaactcaggaggctgctctatcccatggttcaaccaaagaaccagggccaaagcagtgctgaaggaacaactgattctcttggccctccttagagtgagggtacaactggctccaaaggaaatgttggcacttccagagtaattctgacagtactcagatttgcttcatgtacccattctagaaccttacctactcaagtgtaagatgagatgccactgtggtatcttcaaaggaatttagaatcatgtcttaatggctccattaagaagaattctttttctcttttctctgaaaagcatcccaggtcataaaatgtaatgtgggattgtaggttttgtgggaagatgcacttggcagcaattccttgagaggaggccttgaaatgtcagggtcccccattcatcttcccaagctgggattgacccagtgataacataatgataatgcagctgctttcaatgtcaagccatcaggcagcgggttgggggggttgcttggcccaggaacccgtgccctgatgtggagttggtaatctagagggttttgagttaagtgcttttgacatggaaaatcaggagccaagggcgaagctgccttttaaatgctctttctgaaagagtccactgcagatgtaattgagcctctcaggtgaagagctttattcgagcaaagctggttagtgttgcatacctgtttgggggaatattttaggcatcctcacaaaactgctatgtgacattgctgaaggtccccagcctccttgctcccaaacacttcaagaaggaaaatgctgttgcagaaatgttgtctaagctttaccattcagtgtggcccagatcaacctgtcccttctttttgtgatcacagtgtgtaattataaagttatttgtgtgtttggtttatgtcttccacactggactgtaagatccatgagatctaggaccacgtctgtcttgatcatttctccttctctaagactaacacaaggcctggcataatcattgtcatcaccatcaccatagctagtatttattgccatatacagttatgtaaaacattgtaagaagtgctttacatcagttattcccaaccatggagtcatgagtcaaagatggtcaaattggccaagatgaaggtgtttgcattttggagaccaagcacttgaatccataaccccaagatgtgactttccaggcttgggatttcgcaacacgtcgcttaatctcttagcttacattttgtcatgagtaaaactgaaacagtaattcccatgtgctgagtttgctgtgaggattaaagacaaggactgttctaagcccggcatataacgggagcccattataagtgaactgaggtgttattttaatatataccttttaaagtttgagtgttaggcatgctgttgagtgaaagaagacagactgttaccagaggacatattctgttctatgataccacttgtgtaaacgtgaaaagcaggcaggaattttccatgtgagagaagtcagaatagcagttagcttaccagggggtggtgatcttaaaggggcaggaaggagccttgtggtatgctggaaattttccattcatctggtgatgtgatcacttggccgtgtgcacgtgtaaaagttcaagctatatgcttaatatttgtgcacgtcggtgcgtgtaagcaatatctcaaaacatttgagagaatttcccattcattgacagaatttttctcccgcctcggtcaaagcacacagtgggttttcccaacaactgaggtgcctgagggttgggtgccaaagaggcagaaaggccgagatgaccgcttgacctaattccctattcagctgaggcctccacccctggcctgttcaaaggcagttacggatcttttactcaaaacctgaacctaaaaagaaattctttagccatgtccgtgtgaactaaattcagcgtcagatgtacaaggctgtggttctgaccacccccgggctatttctgaccacaggacagcttaaatggtgtggcccataaaatgtaatctgcaaactcaggctgaatgttgatctatttagggccaagagaagaccaggccttggcagcagttctccctgaggtaggatcttaggtcgaatggagaccatcaccctggctgccagccccaggaggctggaaattcgttagcattctttatctttggggatcggccacttacttgtggggttgactcttacagcctttgaccacctcccaaaagctggattcactgatgggcccccaactcaactttcactggccaaagtacttggggttaatttagcaaaccccaggatccccagagggtccctcggtattgtggttttctcctcgcttccaccttatagtggctccaccaggacctcttgactcagccagcactccttctcaagtcacttcgcagcacaatccgtttgttgttgctgttgttttttcttttgttttgttttgggtttttttttttgtttttttttgttttttttgtttttttgcctaatttgtgcttggcttctccacagaggcctggttctggtcccttcccctgcaaccccaaggcagggggcagattcccgtatcatggtgctccttggcctgattctgtggcctttatattagaactcaccttctggaatcttttattgtcttgttctctcttccaagctgcgcatcttccttcccttcagaggtttggtgatcagcgtggtggctcgtttctataatcccagcagttttggaggccgagactcggggatcccttgagcccaggaggttagagaccagcctgggcaatatagcaagatgtcatctctaccaaaaaacaacaacaacaaacaaacagacaaacaaaattaggccaggtgtgatggcttatacctgtaatcccaacactttgggaggctgaggtgggaggattgtttgagccccggagttcaagactagcctgggcaacatagcgagaccctgtttcttaagaaaaaagaaacatttaattaaaaattcagaattggaagttgcattgagccaagatcatgccactgcatttcagcctgggtgacagagcaagattctgcctttaaaaagaaagaggtttggtgccaggacgccatgaaataattactctaggtaacctgaggctagacaaacctctccatgtctcagtttccttcctggcaaaatggggaggtaaggccagatttcttctcctttagttttgtttttctacttgaattctatttgtcatcctctgtacctaccacctgccagttgctgtattagatgctgttttactcattgtctaattgaattctccaacaaccttgcaatacgcttgttatctccattttagaaacgagaaaatggtgactcagattaagaaacttgctcaatgtaaccaagtcacaattttaatattaaaaataatgagcatttattaagtgcctgttgaatgtgtaggattttgctaaatctttcacataatctcatttcatctttatcatagcccttatggtgaaaatgccattattctttgacatagaggaattttgattcaggaaggttaagtaatgtgcccagtatcatctatgtataattgatgggtctataatttcagactcaggtttgtttaagtccaaaaatcatgccattatgactgtgtaccatgttgcatgccttcatatccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcaccctgttgcccaggctggagtgcagtggcgtgatcacagcccactgtagccttgacctcccaggctcaacctatcctcttacctcagcctcttgagtggctggaaccacaagcagatgccaccatgcctggctaactttttttttttttttttttttttgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaataaaatttcagagaaagcaaccaaagggagcataactctgataagaataataaaaagaaacaattcagcaactctcttacagatttttatcatcatcccattcataattgattccaaacgtgcatgaatctttcaagataagtgtcttattgattatcctgaaaacaagcgatcacttggtgtcctgagattcgctcactgccctcccctgattaccgtaaacagagatgttgatgagaagaaatgtcactttctttggtgttggatccataggacattttgaggaattgggtgtggggagtggagggagtgaagtgacccagatagggaggtgcttgatggcttgactgtggccttcaccttgctttttgtggagctggatatagacatttgttggccagctaatactgtcttgatctgttatatgatccttaggccaggactttttcctggtaattgtgcaaaatgtcccagtgaatgccaattccttgctgtcaggaaacattaagtttcctaagtgacatcctttttctgcatgtttacttatggttatgtaaatcaagcgggcctccccattggaaatgatggcagtggttacaagggacttcacctggtcttttgtagttgtggcaaatagataagatacaaatgtgacctgcaattcagttcagcattatgaagctgtatctgctccctgggtggtggtcacagccctgctttgtggccctaacccttgccttcctgctggcgggccttgcacaggtgcagagagggggttagtattggcaagctaattggataaatggtgaagtttcccctgggtggctccattgctccaggtgaagctcttgaaatactctgtagatgacaatagcctcaaacttgaacaggttcttgcagttggcaaacagaaggagaccagactcataggttttgggtgcggataatggataatctggctattgcatttaattcccagcctgatttattgaggctgcctttggtgaaatattgatttatatcttggggggccaggatggggctactctgtactcagatgaggcttgctctcaggaagttcttgttcagcagcaaaaatctgccctgtttgggctctgaaagttatttttgtagtggcctcacaagtttcttgtagcaggtcatgaagaggaatgaaatactataatcacagagcttgcagaagctgcctggaggaccagttagtctattttttgtacatgaggatactgaggctcagagaaagtgaggtcattgagtcacttgagttcttgttgagtgttctttcctgctgaggtgtcctaggtgcctcttaatgcctttaacatctgctaagagtatgtcacttattgacgtagcatcactttattgagcagctactatgtaccaaacacttagcatatgctttttggcattaggagctgaacccagagtggtctctgtggagaggtgcaggtttacccagggtggtggtagtggtgatggggtggtagtgatagtgttgatagaagaagaggaggaggaggaacttctcaggaagaagtggcagttccctcctttgtttcttatctctactgtttagcagccactctccaaagcctcttgctgggaatgtggccatcatagaagtaaatgagacatctctttcatctgcaccaacctccttattaagaccttatcagttacctgtagattctcccactgttgtacttgtttctccctcaaccaattgtattttagctctcaagttttggcagggttgagtctagtatttctgttgggatccggggagcatatggagtgttgtttgttattttttagagtttcttattgcggtaagtgctcaggagggaacagagggagaaggatagaggaaaagcaaagcaaaacaaaatagaaaagcacaaatgaagaatatttagtccattctgtattagtcctccttgatggggggacacatgccagccaggttacctgattcatctagttgtgattttattgacagtcatttctaccttgttggtatccgcagaggttgtcttgaagggggctgatgccttctttcactagctttatgtggctggcagttctgtcctgccactcttttcctcatcatctcagcctccctgcccatggcactcaagagtccaccttggcagaacctgcaactcttcagcgcctccctaatgaactccttgcaagggcccttggttaagttacagtagagaagtggttgcttaagcaagtagtttccggtaaaggcataaagatagcccataattgggtgataaaatacctggattgcatctaaaaataaagacttgtgaaggtaaaactgtagcttacagtgtgcgactgtttaccttcttttggtttcttctcatttaataggttggtcatctctctgctggctttttcccccttttttctcccttctgtagaataacatgtggaccattaactatgatgctacttcttagctgcaaggggggaaaaatggaaaactccaggggaagagggtctttacttagggagttggcatttgttggaatttcccaagaacatttcatgattagtgacaggttatcttctagtttacctgaaggctatggtcactcaacaaattttgtgttgcttcttacgtgtcacgcactgtgataagtcctaggattatagaagtcaataagctatgatgcctatccttaaggagagaaacacatataggataggaaaatagcttgccatgtctgatagatattaggcattcagtctctctctctctctctgtttattatagatagaaataaaaaaattataaatagaaatttatttctcgtggttctagaggctggaaaattcaagatcaagatgcagacaggcttggtgtctggtgagggctgctttctatccttcaaaaaggcaccacgttgctgtgtccttatttggtggaagcaagtgtgttgaatattctaagaggaatctgaaagtgttatagtattaaggaagacagatccaagatggtggcaatggtcaagaagggtgcgggaagaacccttcaactctaatattatttgagctgctcactgataaataaataggattttcccagttggggaagagggaaaggtttttagggagcagattagacaagaaacattgaaaacacaaagtgtatttcttgatacttgttaacactaggtgttgaggagacataaccaagttctcctgcagtttgtgtgttaaggcagatggaaatgtcttgtaactcagtaaaacagtttagaaatttaaagcctttggagagagtaagtattgagaaggcacatctctacgttgttgacgtgaaggagttgcaaggtcgggtagatgggatcagtgccaggtctaatgggcttcatttgcaagacctaatttctagcagatcatggtgtaagcctcaaatgggaggtgtgcctgggatggttgcagaggagttgttaagagctcagactccagcgtttagacaacaccagctgctacaaaggacactgtgcatttctaaatctgagtttctgcacacgtatggaggagtaatatggcacctcctcatttggttgagatgctctggggtacacgtacaaggcgctcaactcacggtggctccaccagtatgaaaatgtgttatctgccctagtctgaagtacagaagtcaggtggtgagaggtgacatgccatgatgtggttctgcttctctgagattgtctgtcagcttttccctcagtttcacccccctttctccctttttcaagatggttttagcacttccagacattataaccagatagcctattgctagagaacaaagcaccttctcttcctatatgtacctcttgggaacaagggaacctttccccaaagcccctcaacacacttaggctgacatctccttgaccagaactgtatcaaatttacatagcctcaaatgaagcatctgggaccaccaggattgggtgtttaggccatggaagagtaacagcccagtacacaactgtctccagtggccagcacgtagaccttccctcacactttccactctctgcatcccctcttccctctcatgtatctctattacatggagcctcactttatagtcctcattaagagactgtggggtggtagacagataacaatgttaacatcaggcaaatgggttttggatttaggttaccatcatttatcttctctgtaaccttagacgagttgcttgagttctctgagtctcagctgaccaagctctaaaatgagcataaccatatcagtttgtgtttcctgttacagggagaaaagactgagataactaaagtacctgattgagtaactgctctctgaaggtggaggctggactgcttcactggacagggtggcctggggttattctagtgcagtggtagctggtgacaaaactcaaagaagatgtaactagagaaaaggtactcagtgcagcctctgtgagctaccaccactgcctctagttttccagaaaaccaccactgaccactctctgtacagatgcgctcaagcgaccataaccaccagtgttcctaacaatgcgcctattgacttcttatttcaatagatatccagattgattatccctcaaggtaagcatcgattttacctttgtctcagtcaatatttacctctgaggtcaatacgtgtggatattcacctcagctgcagtcaatatccatttcgtattacaatatatgatgtgcatatgtgaaaataaagaacagcatggtacaaaaaaggtctgctaggcaaagaagctttttgcaaagcggatgtgtttttgttttattttttgtttgtttgtttttactgtgtcactttttagaggtcagattctatttcactaaataggacatatgtgtcttctgccaagatgtggaattttggcaaggctagcatgataacaaataaacattcaagcagtcacttaatgatattgaattgaacaccatttctcagaagttcctgtattaaattacaaccataagaacatacacaagcatgcagattgtaagtgtgatgagaatggaaacattccataggacgcagagttattcctcaagcccctggactcgcagagaatcaggtgtatgaagcaagaggaagaagacaagaatcaggaggcaaagagaaggaggaagaagcctcagtggggttgcttctttttatttcttagagccagagctggaagacaaggcctggcatattttggcaggcctggatcagagcctaggtgtgtaaattaggaattgcatttcgctgctgctaacaaggacccaaacatggtggtaaattcttccacataaaacaacagaaaataagttgttttctggccctgggctggggtggccactccaccgtcatcgatgatccgggctccttttctctttctgctttgtgacattgcttctatcttcatgataactcgctgcccagaatgaccaggcagcatgaaaacgaaaaggtggagagggaactaacttcttcccttttgaagagctttctaagaagccccacccaacactactgcttctctcccagtggtggtgatttagttgcttgagcacagatagctgccagggaggctggaaagtacagccttcagtcctagcaccaatgtgtctaggcaaatacaaaagctctttagccaaggaagaaatgacaacgaatatttgggacccactgggagtttgtgccaaaccaggtgtcattgccctccccaccctaccttgctcccctggagtgtatcctgattcttttgaggatcacttgatcctgattttttttttatgtgtatagatgggatttcattatattgcccagactggtcttaaactcctggcctcaagcaatccagccacctcggcctcccaaagtgctgggattataggcttgaaccaccatccctggccttgatactgatattttattgtcctaactgacagttttgtctgcccagcattttcccccatcacccttgtactatcccattttcctttgccatgcacctgtcttcctcttcaggattgatcacaaaatcaaaaccattcctaccagccagaggtgggcacatgacccaggtcagaccagtcacagttcctgattcccggccacagtgcatgatgggggaatgagcatatatcaaaccaggacagtccaagtccttccggggactttgctgccacagttgacagggggaggtatttgcataacttcaccacacacagctaagctggtgatcctgctgcttggcagcatcttcccagcgtacaacagaggaaaactgcctgttgtagttaaaaaaaaaaagagagagagagagagagagactgatacacaaagagaatcagaaaggagtagagatgaaacaaagatagagctagcatgattgcaagctgaggacatacgaggagtccctgggtcagctgggccatacatttgtaagctgtagacaaacaaaaatgatctttgggttccttctttagcaattggagttggaggaggatgaccttagtttgcgtctttgtcccactatcattatatccaacttgtgtaattagaaacactatttaagtctcagtttcgtctcctgtcaattgggaaaatatcgtgaggcggagatgtgagatgtgatcacgtttataaagtctgcggcaagaggatgataaagtcacttctcaactccttctcaactcctcctcctggcttattaatgcccatcctttaacctgtcctctgctttatctcttggaatccttagggcctttttaaccccatatacgaagcaaacctatgtgtatgtgtttgtgtgtgcatcaattcatatggtcctctgcagccttgcaaagtcgattcctgacatttccgtagactgttttttttgttttcagcaatactctccagcagcaaaacccaatccgctcatattcttgcatttgctgcagcaaaacctgacctctctttgtgttacctgagtcttgacgaagaagactgaggaaaggccccccccccccccccgccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaagggatgatagccccagtgcagtggctctgtatttctcagggcagcgtgggacctcagggtttgtcatggaccacacctttctcctttgtccctttttataactcataggctacctccaacttgacacttatttaagtttttatttattttatttagcattcagaaaactctatagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgtggaaaagggacatggcccagggaaccagagtggtttgggaaagcactttgtcaagaggcttggggaccccagggtggaagctgccatgcgcatgaggctgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtgggactagggaagtggcaatggcaggagcaactggaaatgtctttttttttttcctcctttttcctgaatatggaaccaaagcctgtgtttttcttgctcacatgtgagtcttctccttgcttcaaccctccccgctgacagccacaagactcctgcctccctgcagcctgtggaacgtaatattcgttgggatcatacattgaccaaagatccgccatgtctttgcaactaacatactcactcatgacttcacgtggctatgtacaagaccacatctctcaatggtgaggtcctcaatctctccctccccaccacagttagctatcagagatatacggtgtccttaagatagggcaggcagggccacctgccccccagctgaccagtgtggatgtcttgatgatgagccatactcagagtggccctaggatggctcctcagatagctgctggcagaaacctgcactcagtacatctatacatggtgtaatgattgactcaagataattagcatagccatcatctcaaacctttattatttgtgatgagaagattcaaaacccgctttttgaactgttctgaaatatgcaataccttgttgttaactgtattcacctttctgtgcaacagggcaccagaatttatttttgctatctaaaatatcaattaaaaatacaataaaactaaaaagaaacctgaactcaggagagtggaaaagaacttcaacattcaaaggggataagacatatactcagagtgggaaaaatactaaatggtaggaagatgagaagttttttactctttgttgtttctgctcattttttatattcaaaatttctaatcatgtgtgactatatatgtattatacatggtaggacttatttttttaatgtgaaagaatataaaacaaaatacgatattatcttttgagtgatatcaacaaaacaaaacatgatatccaaagtcaccctgtatggttggatactttgggtttgccatcttttcttttgttcatttgtttcatgcaatagaaacgttttgagatcctgtctggctgggttctgctaggcctgggtctacagcagtttgctgtcaaggtcttggcccttcaagagcatgtagtgtggtggggaaggtgtacatcagtgaagaggtaatccaggtcacggtgggatgacacaggctgctgtggcaacccacagcaggaatagccagtcctgccccagcagggcgtatcaggggtgctaaggtgacttccaagattgaggttggcgagatcgtgacaggtgtgcaagatggggtgttccaagactggggacaggacaggtgtgcaaggaccagccagctgaggtagaggaaacctagacctatggaacatgctgatttcaaggtccatttgtggggagaacacggactgtgtcattggaagccagcagggagaatcagttgagaggtaagccgggcctagtagaaagtaagcgaagccctttcattaagtgaacgaagggtgcatggtgagtacacagccatgaaaataaaatgatataaatcagcacggtttcagctgccctcatctttctactgtgatctcagcagtgatggggctggctttgagggttggagatcacacacacacaatcagccagctctccaaagcaagccccacactctcttgatgctatcctcaataaacatgcggtctaaacagtaaccatgttctagctatgcagatgcagtttaaagacaaatcctttgagcctccagcatgcgatcccctcccaatctcattgctgctcccctaccctcttctgcgtagaagcgctggagccaggtgcttacgacctgggtgctagtatctttgtgaaaactgctcctgacctattgctttgtttattttagccggtgcctttgtagagggaaaacagcttagcaagcatttagtaggtagatccaaagtccccaggagctgttgggaagtccataggtgctgtttccattgctttttcattccttcatatattaatcaaggagtcagtcaatcaattaaacggatactattagcacctactgtgtgccgggcactgtacttggggccatatgcactgctgattcattcatttggattctacggtggctctttacccattgccatcattttgtaggcagtgagtgcccgcatcagtgggcgttttatgttgcaccattttctgagcaatgtctttggtccaccattaagcatttgtggccgcccaccccacaatatgctttgctttctgctttcagaaacaatactggtgacctgttttaagaaaagctgaaaagccaggacttagatttttctggaaaccttcaaattaacctcattaagtttaaaattgtttttttctcgttcatctctcttgcttttatgctttccaaacccctaaattgtggtgcctcagtgatcttctataacataagttgatagtcaataattgcttaatgggaatcataaatatgagtttatttatatgtgtatatatatatatatatataaaatatatttccatgaatatactgaatgctaagccctccccactttttttttcttttttaaattcagaaatttctagttgtgtttattcccctcgtcagcatactttatcatatcagagccttttcagacactgtaaaactactgagttatgtttgggtcatgttttgcggtatgccctttaatagtgtagctttagaaatgcaattttcagcctctgcttattagaatatgataaagtattcctggtctatgtccagctccactaatctccagactgcgcttcatgaattaagcatgaagattttagtcaatgtgctttcaaagaccaatgtttagggaatcatggattttctacaagctgagggagaaatctataataggaggaactgattttcaaacatcatattctcaagaagaaatgaccacttctggcccagaaacagaaaatatttcactatcagaattttctagaaccagttaaaaccacattgtgctgttaggtttaataaacggattgtgttttaagatgtgtaagactgtctgtcacgtgggaggatttcaaatgactgcttattttggaaagctcatgtagactgggttaaaatcgagaggggaatgcaaattgaatttataaggtattattaacttcttcctctttccccccgccctggcccctgtgcattttggttcattttgctctgatacaattcagcaaatagccagatatttcttgccatggcgagagcttagttgggggagagattttgaccaggcaggctctcaggtcggtgccatcggtgacgccaacacacctcctggcttggtgtgttttgtggcatttggcaggcaaacgttttgaaaagaaatctcctttcaaaaatcacagcactggttgaagcaggagcatctctccccttaaatgcaaaaggagttaatatgccagtgactacagtgtgcctggaaaggtcactggaggcatttttgtctggggcagcccctggagtcttggcttttgtgcttggtgagaccttatctggcctcttcattgtccccttcatacaaatagatagcttttagtgagcagctactctgcctggcactgttctaaacacatgacaccaatagctcactcagattcccgcctctcaacagggaaactgaagcacaggaagtttcagtgatgcacttaggcaaccagtaagtggcagggtcggcattgaggtcaagactggttggacccctaagtttgaacaatcaaactggactttggggctcacagtttgtttcatgtcaggaaggtgtccgatcagaacctgaatgccagctcaagctgctctcagctaaactccaggggttgctgatggagacttcatcccctcctccagtcccgggatcaagacagaaatgtaaatcacctccaagaatgggtctgcgtcttgcacattttccttttgagaaagaggaaaattctcagctggtctagctttgtctgtgaacctccgggatctctcaggggctttaaattaattaatcaatccacagacattgaactgaatctccaccttgggcttgagactctgcaaagtgcattaaatgggaaggaaaccaaagggcctgctgccctgcccccgccatagcctaaggctgtggccatggctggggaattggcctgtcagttcaatcaggcagcccctctgactggtgtttttcactaagctggccccatggatggccctggtcatgtgtagacatggcctcaggagggccacattcctctcatttccaggcctccccacttaattgttcctgacacagtttggggagaaatgcagcaaaacccaggcctgccaatcaacatttgctcccgagtctcagagcggcccctgaagagacaggttggaccaagggacatccacagatgccttgtgtttaggaagtggggtgtgggcaacagagggagaattgttacccccgggagactgggggtgctgaagaagagtctcagtctctgcactctgggtcttgccaaaacctctgggattgggtgtggtgtccatgttgaggaagggacagtgagctctctaaatgacagtgggtcaaccaccgcatttctaggactcaaagatgccgtgggggtgtattagtctgtttccttgctgttgataaacacatacctgaggctgcataatttatgcaggaaagaggcttagtggactcacagctccacatggctggggaggcctcacaaccatggtggaaggcaaggaggagcaaagtcatatcttacatggttggcagcaggcaaagagtgagcttgtgcagggaaactcccccttataaaaccatcagatctcgtgagacttgttcactatcacgagtaaagcacaggaaagacttgccctcatgattcagttacgttccaccggggccctcccacaacacatgggaattgtgggagcgacagttcaagatgagatttggatagggacacagccaaaccatatcacagggtcacctgtaggttaccgtaaataagagaaacagaccaagtagagactcagcatagctggagggggggccccagatgacggaaacagccccccagctccagccatttgttactgggttgtttccaacagaatcaaggactcggatttttatgtgaagtcatctccattttaagtattcttttctttccccccaaccctccgtgggttaaagcatccatgtttacagaatgaaagatgagggcaggataccacttctcctagggatcatcatcattttgtggggctatagtccagagaggtgaaggacccatcttgtgactgcacagctaccctgtggcatgactgagactataatcttctggattcttcaggaaaccctggtagctgatgaaactgccctagaacgacagcaagacaatagggccatgaaagcataagccctgaagtctggacactgagagaattctaggcttgacttctctgtacagccatcttgggagtgctcaaccctttgaatcggatgtctagaatggactcagatgtcactgtgcaggtgactcacgcctagaatcctctgcctatcgtgacagggagaagcctgtgtgaccctgtggccatctcagtctctgcagggcatctgtagctttggaggtacctgggcaagagactgcctttcctactagagcttctgccatccctctgtcactatttaaagcattgcctgcaccctcaacctcgttcagtttccacataatacctggggcagggatgtaaataccctgattttatgtgtcaggccttcaggactcagggtgtataagtgacatggctcctcgcacagcagggatggagaggcaaacccaggttggcctctctgccactcatatagaactcctttatcaccaagattcctttcttcttcagtgccacctgccttattttactcacccagaaggaagccgggtccctctttgcccctttgggtgtttgtgaaaagcaagttgcaaactctgaattctataaactgttggagacagattctggagagacactcaggcttagctctagaaagaaacgggtaagacagaggaggttcagggcaactgtgttgccttccttgactggtgcatgggaattccccagcagagagaaaaaaaaaaaagaaaggaaaaaaaccagaaaggagaatagaatctattatctccaagccattattcacacacacataccccaccgccattttccaaattgtaaggtctttttatataagcactttccgttaaaggggaagaaatagctttacccgtggtgtaaaatatatactttctaatgtaaatcaagaagctatgaataccataataagaatgtggtagtatattaattgatggaaattgtagagtggaatattcataatcagcagaagtcttttctctggaaggaacaaaggattaagttagggagacagtaatggtattgttagcaggctatttcaatgattttctctgcggaagagtagggaaaggtgacattccaactgggaatattcgactctgcagatccctactcggagtttttcagccctgttttaagtgccgagctgggttttgcctcatgatccaattgttttattagcgaaatcatcatctgtttcattttgctttggtaatagtgcagtgtctgtctaacaataaattatagagtcaggcaaacaatggtttcgtattagggatataatgaaatatcttattaaaatgcagacttccttaggttcctgaaattagagtcttattttaaaatgattctgttgggcttattacacgcttttgaactaatcacactagtagaatctctctttagtcagagcatagaggactgtgagagttacctcttacttcagtattttcccattcgtattttattctcctgttctcttctggatagatctggatagattttttttagacagagtctcgatctgacagccagactggagtgcagtggtgtaatctcggcttactgcaaccttcacctcctaggttccagcgattctcctgcctcagcctcctgagtagctgggactaaaggcacgtgccaccactcctggctaattttttatatttttagtggagacggggtttcactatattggccaggctgatctcgaactcctgcccttgtgatccacccacctcggcctctcaaagtgctgggattacaggtgctagccaccacacccggcctcttctcgatagatcttatttggctgacaacgaaagctgttgtgctggtagcatcatccctttccatgcaaaagataaactgaaatctaaagtagccatatccttccggccaggtttttcaagtggttactctgttctgatcattgtcatgacaggaatagtgaaaataacaataaatcatttttctttaacgatccatttactgtatgctgggcactgcacaaaatggtttacatggtttatcttgtagcgttccatttaagtctgctaagagtagatgctatcattctctccattttacagataagaaaattgaggcttagagaaattgagtaatttttgccaatcctgagacttgaatctccgctctgtcttctgcatacactttttacttgtcattgctgattagctttctctttccatctccctgatcagaaccattctgcgttcttagattcaacaaaatgtaatactccaccttgccagtatctagcgtgttttcagaaattgtgaacggggtggaggtggagtactaactgcaatcagatgttttatttgtttatttatttttccttcttgcgttgctcttaagcccccactcttgggcaaggctctgtgctatgctgttttatgcacatcatcttctaacagcttctctgccacacctggagaagtgccaatatcattttcatggcacagataaggcattggatgctcatagtttaagtcatcaggtggtgactggaggagccagaaggtccctttgggcctgtcctctcaccagcatcaactgcaccaaaaagatctcattctgagtatcagggatgaacgcccccactgggtgatcaggcaaactacatgcattttaaaaaactatatcctgctgggtgcagtgcctcatgcctgcaatcccagcattttgggaggttgaggaggacggattacttgaggccaggagttcgagaccagcctggccaacatggtgaaaccccatctcacctaaaaataaaaaattagctgggcgtggtggcagccacctgtagtcccagctactcaggagactgaggcaggagaatcgcttgaacccaggaggaggaggttgcagtgaactaagattgtgccactgcactccaacctgggcaacagagtgagacactctcaaaataagtaaataaatataaaataaaataaaaaatatgtcctgtaatgaaattgaaagagaacactttgtttcttatctagttggaacaagtggggtggggacagacaagtgactgaccactctccatctgactcagtgtcagtagactctctcaaaaattagaagctggctgacatagtggctcacacctgtaatcccagcacttcaggaggctgacgtgggaggattgcttgagcctaggagttcaagatcagcctgggtaacatagggaaacccttctactacaagacatagaagaaaattagttggccatggtggcacacacctatagtcccagctactaaggaggctgaggcggtaggatcgcttgagcccgggaggtggaggctgcagtgagctgtgatcacgccactgaattctagcctgggtgaccgagaccttgtctaaaaaataaataaataaataaaattagaatctgaattttgaagacacaaattcagatgcatgtggatgggcccaaaatactttgtttacatgtactccaaatgtaactcctggggcacccttccttattttctctaccacaccaatgccttcatggtcttacatcttgtcctcttaaccctgacttctctagccctcatgaatgctttagtgtggcagatgttactgtacatgggccctcgtttattcagcaaatattcatggagcccttgtaccaagcacggtgctgagtgatgctgtgagggtgagcaaaagagaattgtcatctgttaaatcccagaggtccgtctgtgacaaaactttcaccattcttttgtaaaaattagaaaaatacaaaatagtgagtttttcatgagctacgttgtatcaattttaaagtatttcttttaggattctattatttaccctttttcttcaatgttaaataccatttcctttaataaagatttaaaaaagattccttccttccttcccccctccctccttcccccctccctccttcccccctccctccttcccccctccctccttcccccctccctccttcccccctccctccttcccccctccctccttcccccctccctccttcccccctccctccttcctccctccctccttcccttcctccctccctccttcccccctccctccctccttcccttcctccctccctccttcccttcctccctccctccttcccttcctccctccctccctccctgtcttcttccctccctccctcccttctttccttcctttctttccttcctttctttccttcctccctccctcactccctccttccctttttccctccctctctcccttcctcccttcttttctttcctttttaaatgctgattttgttttctttttaaagccctcagttggcaaacttaaaagttgttaagtctgtgttagcctggctagctttttttttctctactagaccttcaaagtctaggaatgcctgatgtatctgtatcctgtgagtttgccacttcatgatatttgatatgtcattgtttccccataattttttcattgttagcgttgtctctccagcctcctgcttcctcttcctctgtctccctcatggtgtgtcttgctcaggcatgtcttatataatcaatatttagtgatttgacttcttaagtccttaaaaaaaaaaaaatccaggtgcaaaacacaaagacagggctcatgtcaagggagggaacctcgctcttctactctcagtgaaagaaaggcaagaccactccagcctattttttttttctttcccttggcccttgtcaaaagggtagccagttttctgttaccattgtgctaactgaagaatggaaaatatgcccagagtttaaaaaaaatcaaccaatgcctgccctttctagagcaacctaattaacaacccaaatgttaaaatttctttatttagaaactcagctatccagaattacaactccgcctctcgtgcttggaggcatagttctttgtcatattcctgagtgtctacagatgatgaaaatagccagttatctttgcccttcatggaaaggataggaagaagctctgatgaagcaatgttggggcactcatggttaaattgaacctttcccctggttaagtggagtgtgtgtgtgtgttgttctttttttccagcaccatatttggccctataattaatatgcaagttcaaatacctcttgcatggagcaagaagctgaaacatgcgcatttgtaatagactcagcatctgaattgaatgggcagctttggctggagtagtactgcagcttctcgaatgcctattgtcaaaatatatactagttaggagacacattctgctacgagggatgccctcccaaattaaagacactgttcagtttacgcttaacatttatggctatcaaactactagtccacaaccaatcatcatggtttcgttaacacagtcaaaatttaccactgggctattattaaaacttaatataattaatgtaaaaacacatacttcttttcaacaaaaactggctctctttgtagtctcttttttaatttggtgcaatcacttaaaaagtttagcacatttaaaattttacatcattttaaaattgtttctcttttataagaaggatgctatttactattaatgtagaagtacaaaggaaacggttactttggatttattcttttggaaaattagaatgtgggctacatgcttttcagaagttgatgaccaagagaagaaagaaagaaaaaaaaaagggtgcttgatgccctgctcctgctatgtccgggaatttcttgtacccttcatatgagcccctctgaacaaaagcaaatcctgttgacctgtcagcttaaaaagacaagaaatatgccacattccgcaggaataaggagaaaagaatggtgcgaaaatcagtgacacgaagttgaatatgtgaacacatccagacaaatgtgaagccagcccgattaggacgactgaaagggcatttccccagaattgcagttttttttttttttttttttttttaaataggggacgctattgtcattcagaaagccacaggctgttctgaaaacaggcaaaaatcaatagcccacttgttgaggataagtgaattagcctgtgttgaatgtaactgagtacctgaacacttgagtgggcagggattgttggggagaaaagacaattgtcttttatgtccacagcggttcacatcgctgattaattatgtccaatgatcatttttgtgcaggactaatgggcagactctgtttttgtttttgtctgtctgcccacaacctggtgaactgaatagagttccccacttctcagaacaatgcaaatggtggccaaggggctgtggaagagttgccagaaatggaatgattcagattggatgaaaagttgattttattaattagttaaaatacaaaatgagaaaacagaaaacacaataaatacacagttaataaaatacttcatattttattataaaaacattaattactttaataaagcggtttatattttcaaatacaatatttaataaactatattaaaaatatatacaaaatagttgtaagaatcggggctcctgtgagtacgtaaatgaaatacgcttacatcatttacttctcttcccttttgtttgtgagtccagagacgatggaagagtttggaaagttgtcagcttatctttgcatatatttgtccaatgataattaagcacaaattgtttcaaaaatctttcaaaaattgttataaagatttttattggtgctaagggctgtaatttagcaaagtcttacacctgaaaccaaccaaagggtcttagagtgtgaactgttgtcttagacccggagaagtctccaaagaatgaccatccgaggcattcagctggcgtaagaggagtgactcatttgttcttcttttttttttttttggctgtctacagagaaggaggatataggggcccttaagagaaaaactggagtagggtgtgtgtgtgtttgttttggtcaagggcagagtgtgctgtgtcagggtgtttcattgcattttcatatttgtcatttctctttggagcgtgtcttttggtgccacggaaaagggctggattttctatcgggtacaataggtacctgcagggcttagggtacaagagcttgtcggggacctgcacacatgtttgagacctgtaaaaatattgctggctctgaattatggaaagaaaatcgcaaagttaaaatctatcaaagtataattaaatacctacaaaacataatattatgtcactagtcaaccgcaacacaaatcttatatcattagatttcagtgatattgaatgtgggagatggaaccattttagtgcatttgatatgatgtgatgtggctttctccaagcctgagagtgcctgaaacccagagaggtcgtacgttgaccatgccacggggcccttcctggtaaatctaagcagaaatacaccatgcatgagacagaacaaagaaaagaactgtgaaaatacactcaggaccaggatgctgatacagtcatgaggttcagcttaaaaggccagtttctctactgcagaataatgaggtctatcctgttttgctttctttcaaagcccttaccatttatgaaaccagattgcaagtctgtttgaatcccccaaatgcctgtgctacataactgtctccttactctgtgctcttgccccaggcagagtggaagttgccttataaagctgcgacttggccacagtgttttccctttcagcagggaaaccggagttctccctgctgttgggaggttcaagagccactctgtgcagaaatgcccagaaagagttaagtgaggtaagttcgtcagacttctgcagacccatactgtggaagggtcaagtgcagggtcaccaacccgttccatcttcctgtcagttggcgtccacccttggtttcaaagggaacaggcattactgacatgacgggacctttacagttcccagctgctcatttggagtactgcggacccaggacaactaaagccggggtcgcctgccctccaggggttcctgggttgaagtatctgttccctccctttattttttctagcctttatagaaatgacaaagggtcaggtggtcttaaattccaaatctgggcacatgaatggtctgacctcggaaacttcctatatgctcgaaacgatttaactagcagcaataaaatctctactctttttatgacaaataatctagcatgtctggggagcatatttgattcttcatatttgggacccttttttaaaggctgagttttattaaaatgatagaaaaattagttattaaacagtatgtcaaatacctttctgtcccaccagatttatttttaaagacaaacattacagaggggcaggggaaggttatatttgaaatctttctatcctttctctaaaatatatttggtgaaaactaggaagtgttgatagatatcattgtttcctgacaggtttttggtgtttgcatcttgaaagtaaaactgccaagttatttttttgttctggtttttgttttttaagcttttctttgataacctcattttcaaggggaggcttagcactgatgtattttattttcttgctcagagaggaaacactgaaatagctatatgcttccccaccaggagagtggaagaatcttgcttttaaagcgatagtcctattttctaagtaaaagtccaggcatgtgacttaaaaaagaaaaaaaaaaatgttttctggtcaagtcacatgcctctgaggtttttttttttctttctttcttttctttttttttctttttcccagactcctcatacccctcctaggagacagtgattccctggcttcaccaggcaggctcttgggggcttcctggtccctgtcactcttaaaatgcagcctgtctttggacatctactccaagtttgcattctgccttgccttgtcagtctgggctatcaaaaatatagtttcgtttggaaaacaaaggggtgaggtgggtccaaagtacaggaagctataccatgcaaatgaaaatattttttccaaagctatctgctaatccctgtgatttaaaaatgtgcgtgtttttagtttctgtctaatttcaaccttttcttgctttagtgattaattaccaggtttctctattaagagcttgtgcgtgtgtagggggtagcatagaataaacaggctcagagcccccacccccacccccctttaagtaacagtgacgcaaacgacctttatttagcagaaggtagctctgcgaatccgctgaatgtccgattgcgatctcgctggaaagactgctgcttcagcaaggtttctttgctggtctgtggcaaggtccctgcttcattttcaaggtgtcctcacttggtgcctttgaagggtttttaatggattcgcttgatataccttccaaatggagtactttgtgcgttaattcagtttgtgataaagatcccttttaccctccttttcataattcttcccagagatatgaagtacactagaaggttagatgtggcatttaatttttccacaaaacctatccatagagggggaaaaaaagattcaatttcattactattcatgtgtaagaatattgaaggtggtatactaaaggagataactatttcttcttctatcaaaggaagaacaaatctgtctttgaacgaggagctcaattcttatttaaaagataaaaggtcacctacaatactcattcctttaaagctatagtgttggggtgggaaggaagctgtcttacctggacatattaattttaaattttgcttgaaaaaattgctcagtgcatttattgactagtctctctgtgtgagttctgaaagtctgtttatatctgttgccccttctcctaaagtgaacccagatatgtgggtatggggtgctagtttttatattaggtctgagatgtggaaaacagaaatctaacttagggatgtatcataatcaaaccgtcggggctaatggcatggctctgatattataaaatctggaggtttggaatgcagcaaactctgggggcattatcattattattattaatagtttgtatttacaaatgtggcattaagtagaacaacgtattcttgcaattaatgacaggaagcctacaatttctcattaagcacaggacagtgagaacgaacggaatttcagagacatgtttcttaacattaaaaacaacaaaaacaacaacaacaacaaaaaaccaagtaggaagcaggcagagttgcaatatgaagaacaatttcaatcatatgttgtttaattgagtttaacaagtaaatgtatatcccagtgtgtgtggtcaccaaagcataatgacaagttgttcatcatttaattagagatttgcttattgaaacgactgaaataggtagttgaaattttgcccttggacaagggagtaatttgtgatttgctacgttcatttcgtgagacttttggtgaaagacatctccttctcatatgtttaggcaagcgttgatgacatcaacctagccttttattttaaatcccctgtcaacgcaattagataatacaaaaataacaaaactacaggaggttgaggatggggctgggggccaaggagattacttggtttgaaatgaataaattgtctatcctaagggaattctttggtgcattttattgtgtgaaatgagcctggtcatatgactgccctgcctccctggaggcctccctgccctcctccttcccacagacacttatgggaggtactggccagctctgtatggccagtactgccctaagcaagaccaagaagcttagtctcaatttcagagagttattttggcaacatatttgggaaaatgatagttagatgctgcgttagccagcctctgcatgattttttacgcagaacaaacagttccaaatatcagtgctttcagcaactcatatatttctcacttatggtgcatgtcgctgatggttggctgctgctctgatctcactccagtatcagcttcagtcaaggaacgtattgttgtcaaggaaaggaaaaagaacagtggtgagaccaaaggatcttaaagtttctactttggaaggggcgtggcattgcttctctcattccattggctgaagcaaatcatgtatacaagccagaagccaatgagctataggaagggtagcaaagaacagaacagccatacagcctagcccacagatggggtcaagaagattcaataggcattggctgaagacttaagacttctcaagcaagttggatcctggtgtgcacctggcatatcctttaggattctttagtgttggtagattgagatggaaatgaggaaacttgtattacctactcctttgggccagaatttgcttacagcacagtgaggaggtattctttggagagcactgtttcccaagagtgattctaacaaagaggtgtaaatggacaagaatgaaaagcaattgcaagggcccttgaaggtttgtgaaggatggcaaagtgacttggatgttgatttctaaaggaggtaaaacttgaaggtagacaagctctttgtgtccatacatttgatgggtcatcctatgaaggagggcccatctcttacggcaggcagcgtggcgtaggcctcagagtcaggcatctggggcccagccttttctctgcaggtgcgggtggctcttggcacatgatgtaggtttttgtttttgttttgttttgtagacagagctcaatcttttgcctaggccatagtgcagtgtacaatcagatttcattgcagcctggaactcatgggctcaagcattcctcccacatcagcctgccaagtaggactacagttgtgcactaccacacctggctatttttaattttagtttctgtagagacagagacttgctgtgttgcccaggctggtctcaaactcctggcctctcaagccatcctccagcctcagcctcccaaagtgctgggattacaggcatgagccaccccacccagcccatgttaattttttcacctacaaaatgaaggctacaatatttactttgcaggattgctgtaaggattagaaccaccgtctctaaggcattcagcatagtcccttagggtaacatgagtgctcaagaaatagtaaattttagtatgtgtctcatttttttccagatgctctggggtcactaccaaccttgcctttcaccctacctgtggatctatgaccctgtccttctcagaacaccactcagtacttctgggttccccaagaggtgcctcttgagagtttgtaggaaactgtgctttagtaactcatggtttctgccctcagcttctcttgcatggggccttcctgcttgctcctctgctcacaatgacaagtgaggactcccctccatgccttttgatgctggtgcccatcaccccgatcacatgaacgtctatgcccaggtcccatttcctgacattcccaacatctctaccttctccgggcctagggcagggatcactctttcagaaacatgagcgtatggaagccccagtgtgttccttgaagtcccgatgcgtgatttgtccccatgctgtgtcgcacttggtcatctggaccctggggttgcctgagtgtccctgttacaaggcccctcctgaaaccagattggtgtctatgagggtcatctgggaaacctacctctggcagaatcgctgtcctgccagtttcctctcccccttacaagggacatttatgctttctccctctacaaaacctgcatgcaaattatctgatggaattgacccatagtgggtgttctccactggttcaacacacctgaattccggattcaagatgcaatcaccactactgttgttgtgtaagtattgctagagatggctgcagaatacctgggaaagctagctaagcagtgactggaggaaggccccagctctttggaacgaactttccagccgagaatgctttccaaaatgggaacaagatcccaaccccttatcagaaactttgggggccggatgtgtttcagaattcagaagttttcaaattttaagaagagaatacactgcgtattctgtgtattacaggggtcagcaaattcacagcccataggccaaatctggcctgtttttgtaaataaagttttattgctatacagctgtacctgttggtttacgtactgcgatggctgctttcagctacgttggcagagctcagtagtcatgacagtaaccatatgcccacaaagcctaaaatatttactatctggctctttgcagaaaatgcgctgaaccttgcatgttgtgtcacccctggaggtagcaccttgtaattaagcacatgaatatctcacatcagaatgaatgaatattcacactcagtgggacaaacaacttctgtcagctgtagactgcttttgccatcaaatggttattgaaagaactatctgtgttgacagccttttgggtttcatacagtcctttccagcttgggcagtatagataaatagatgcacaaagcagagggaatcaagtagaataacatggtttatttgtgtgtgtattgttctgtttttggtaaaatcatgcttatcatatcttcaatgcatcatttattctgagtccacattgctgcctttgagccggggccctgaggtatctcctatactctggctggggtgagggcggcaggtcctctgggccagcccagatccaccctgttcacggtgtgtgtcctgctgggctcacttctgaagctgaccttggggagcagattgaacacctgttgatgccattctcttaatttcaggggaatgtgtgggtctttgagctagagagacataggtgtatggcagatgagggaccaccccctccaccttagtccagttacagggcctcgcctttttgatactaacgctacatgaagagggacggggccaacagcaggctcttccttgacgtgttttatgtacactccagaaatattgacagagttgtctttttgttttggtttttaaatgtttttttaagttaacttctggaatgcatgtgcagaacgtgcaggcttgttacataggtatacatgtgccatggtggtttgctgcagccatcaagccatcttttaaatccattcttagattttccttttccatagctctttgtgatgcttgctttaatcagttgatacatgtttaatcacgttttgctctgggctgtgttatatacagctccctccctaatcttgctagaaggtagggctaatgcattgtcaattcagaaatagggggtgttcctgagtctggggacactctagtgaaattctatgtgtaaaataatttgtacaagtttatatttttagctaaattaaaatactcacattcccattattttttagaggttgtaagctaagtaataacattctagaaactctctgttttttgaaagggcatcaccactgttgaaggcgctaatgggagatcctaagtttcaggctctgctacagacgtcaggtcccctaggagttgggctgcctttgctctcctctccgcgactcggtacctggtgtatagttggctaaaaagaagttgttggggctgggtgcagcacctcacacctgtaatttcaacacgtagggaggctgaggcaggaggatctcctgaagcccagaattcaagaccaggctgggcagcatagcacgacccatctctactataaatttaaaaattaactgggtgtggtggtgcacatctctagtctcagctgcttgggactactagaaaggtaaggcaagagaatcccctgagcccaggagttggaggttgctgcagctatgttcgcaccactgtattccagtctgggcaacagagcaagaccccatttccaaaaaataaatgaaataaataaatacataataaataaacagtagtggttgaaagaaagggaaggaagaaatgctgttttaggaaatcaataggataatttttttttttttttgaggcggagtctcactctgttgcccaggctggagtgcagtggcacagtctccgctcactgtaagctccgcctcccgagttcacgccattctcctgcctcagcctcccgagtagttgggactacaggcgcccgccaccacactcagctaattttttgtatttttagtagagacagggtttcactgtgttagccaggatggtctcgatctcctgacctcgtgatctgcctgccttggcctcccaaagtgctgggattacaggcgtgaactactgtgcctggccaggataatctttaagaagaagataacattagctattcttctcacttcctacgtagaattccctaccctgtgtctttggcctggaaagggtattggtagcaattgtcttcggctttccctgccatgtgtatgcattcccacggccacacaagcacacacacacttttgtggttttttttttaattatataagcaagtaggatgtttgtcttagtttttttgggctgctataacaaaatgccatggactgaataatatataaacaacggaaatgtatttctcacaattccggaggctgagaagtccaagaggaaggcactggcagattcagtgtccggtgaggatttgtttttgatctcataggtgtccatcttgctattttctcaactagcagaggcaactctctggggtatcttttaaaagggcactaatggccaggagtggtggctcacacctgtaatcccagcactttgggaggccgaggcaggtgtctcggtggatcacttgaggtcaggaggtcgagaccagcctggctgacatggtgaaaccctgtctctactaaaactaaaaacttagccaggctcggtggcttgtgcttgtaatcccagccacttggaagggtgaggcagaattgcttgaacctgggaggcagtggttgcagtgagctgagatggtgccactgcactcctgtctgggagacagagggaggagactccatcaacactaataataataaagtaaataaaagggcactaaccctactcaggaagccttcactctaatgacataattacctcccaaagtccgcacttcctaatgttaccactctggaggttagaatttcaacatataaattttggggggacacattcagaccacaataatgttttataatgttccttttgctttaacaagagacacatgtcagatagtagacatgatctgagaagacacaaaacccagcgtggtgattttggcagccttgccatgcatctctaacatgcacatggccagaaaaatagcttggacattctgttcaaccctccacatcaactggtcagtttagtctttaaaaggtgataggcctgttgtggtggctcacgcctgtaatcccagcactttgggaggctgaggcaggtggatcacttgagccccggagttgaagaccagcctgggcaacacggtgaaactaagaatagaaaatattaggtgggcgtggtggcgtgcacctgtggcctcagctacttaggaggctgaggtggaaggatcacttgagcccaggaggcagaggttgcagtgagccgacattgcaccactgcaccccagcctgggccacacagagaaaccttgtatccaaaaaaaaaaaaaaaaaagtgaccacactgtggctttgctgctttgcctaagtatttcgtgaaattgatcgttcattcacaatgctcagtgcagtgactttgccgagcacaagtggtggacttaagaagccacataaagaagcacccacgtctttctctgaggacgtgcttgtgtgtgttctgaggaaagcaggtgatgatccctgaggtgtatcccccaatcccaaactagaagtgagtccccctgctcctcaagcttgcatggcgctcaggtattccagtgggccccgctgcattcttcccagtcccaggaaatctttgtgcatggctgtcttttctgtgccatcttgggcatctcacgcattggccctatccacatgttgcctccagcatcccaggaactccgttaatgtttatttgaatgatggaatgaaggtgtcttgctatattttgacatttctgtcaaaatatgaatctatctttgcctagcatcttttcatgtgcacattgcccatctttataacaaagtgtgagtgggaaaggacttttaatcttcattatattatcattcatatgaataatgttaacaattagtgtttattgagcacctgctatgagccagatgtagtgttcagtgctattcatgtgttcttgaattaaattttcatggcaagcctaagaggccatgactgtccacattttgcctctgagagacgcaaggcttggaggcaggaaatcactcactgaaggccacagcacaaagtggggacttgagtcccgatctcactgattctaaagtccttgctctccaacctctgtccatctgaaatggaaaagcactgacgcagttctcactctggagcttgttttattttgcttgggctgctgtagaaataccacaggtcaggtggcttaaacaacaggaatgtagttcctcacagttctggaggttgggagtcctagatcaaggtgtcagcagggttggtttctctctgtaccattgtccctggcttggagatgaccatcttctctgtcttcacatggtcttccctctgtgtgcgtttgcatccttatggcctcttcttgtgagggcactggtcatattggattagggtccaccatataatgactttattttacctgaactgtctcttaaaaggctctgtctccaaacacagtcacattgtgaggtactgggggtttgggcttccacatacaaagtctgggacacagtacgctctcataagagacctcttctcaacaggatccatgtttgatccgggggaataaagctagagttgctttcttccttgtaatatgtataatgactcatgagagaattccccactgtcttccccacctgagacctgagaggaggagaaggaagcttggagtcgctgccctgtggcctgaattggtcagtgaccaatcactcagacccagctgacaggctatacgcggacaccttggatgtgcccagcatggatcttctccaagtaggaggccttggagtcagagaaaggtgcaactcccactgctgctgcaagaacaaagactttaagatactgaaatttctgggcaaagtttcctcaactcttcatttaagtgttaggccaggtggggtggctcatgtctgtaattccagcactttgggaggctgaggtgggaggatcactggaggtcgggaatttgaaaccagcctggccaacgtggcaaaaccccatttctactaaaaaaaaaatatatatatatatatatatatatatatatatatatatatatatatatatatatatatatatatatatatatgtagccatgcatgggggcctgcccttgtagtcccagctacttgggaggctgagacatgagaatcgcttgaacctgggagtcggaggttgcagtaagctgagatcgccactgcactccagcctgggcaacagagcaagacgccatctcaaaaaaaaaaaaaaaaagtgtaatgcaagtagaaaagggcacacactccaggtgtatatctcaacaaatttgtacacactgcatgcacatgggtgacccgcacccacatgttatacacagaataattacaggaccctgccaacctcctcctatcccctttcagctcctgctgtgatgccacttctaatctcaattttattatacaatttgttaaatacagaagtaaatggaggcaatagtgatagtaaaaagaaccatgtgaattgggcgtggtggctcatgtctgtaaagccagcacttcgggagtccaaggtaggagggtcacttgagcccagcaattggagaccagcctgggcaacatcatgagaccccatctgtatccaaataaaagcaacaaaaaaatgagacatgggggtgcatgtctgtggtcccagctactcaggaggctgaggcaggagaatcacttgagcaaaggaggttgaaccatgattgcaccgttgtactccatctagcctgggcgacagagtgagaacctgtctccaaaataaataaataaataaataaaaataaaagtaacagaaccataggccttatctttatctgagttcctgtagcatgtgcactactcctgattaaccaagtgaaagagaaaatgagactaatctctaacgtcagcttccttttctgccaaatggaagatcatctctaattaataatgagttagaatacctaggacagtatttggcacacagttgatgaggatggtgtacctagtagctaatggtgagtaggatgaataataatactataccttttggtttctgaaatgagaaatctaaggaactggcttaaccaagaagcagcaagctgttttaattgtgctgttaggagggctgtttgttaaggtacagaagaggattggcccatggctttctgctaagaacctgctgaatgtctgtatagaatccctgcattgtgcctcctatcaatcaggtgcttaggtttgacaagtttcctccaacagactcgtgtagaagtttctgtatcaactggaaaaaaccatggtgcttgggacattcaaggccgaaacttggtccctggatgggagaagatagctgtatcattggcagagctgccttggtcatgtaccctctccagactagacactagatagtgggtagggtgggacagttttatgtcctctgccaccttatctgggactcttgtcccctgagaagtttgaaaatttggcacattttagtatttgtcagtgtacttcctgcttcttgatgcacttgtactgcacaagaattgattttcaggaaatatggtttttttttcctttttgcacagcgatgggttagcaaaatgcatatttgcatagaaataatctttagtgagctctgctggcaagtgtgtcaaatttataaatatcactactataaagacatacttttggatatggatttcttcctcagtttatttcttctttcattttttcatgtccaggtcactacgtattgcgtatatttggttggaattttatttttgagcaattcacttacccagattgtgtttctggagattaaagcatctcactgtatttttagttttttctacattgcaatttcaaaataatccaactcaaaggctgttgaaaggctccttctgtttaaggtaaagcctgtggcagcctttaacttcctttctcttctcctgctgccaccttggtccacagtttatctttgaaaatgctgggttttaatgggcagggtatagtgcagaaaccagatggttttaactcacacctgtgaaaatgctggggatctgcgaaacattaaagttaatggccagaataaggctgccaagctcggtggaattgtacttaactggcatatcattctggttaactgaactttccattaactcacagatctatcttttcatgcccccttctaaccccctactcaccacccacccagttcctcctagtgggcagtttgctgctgctgtcttacctcctcatcctcacccctttcacctctcccctggtaactgatttatttttccctcttggagttgcttattcttttcttcttccagttgcatctctccctctacttagatacacatttccattttacttctatttggtagtctcagaacttggcttttattggccagtatattcaatgattcacttgcacctttaaccttgtgttgttctaatcttttttttttttttttttttttttttttttgagacagagtcttgctctgttgtctaggctggagtgcagtggcaccatctcggctcaccacgagctctgcgtcgtgggttcatgccattctcctgcctcagcctgcggagtagctgggactacaggcactcaccaccatgcctggctaattttttgtattttttagtaaagatggggtttcaccatgttagccaggatggtctcgatctcctgacctcatgatctgcctaccttagcctcccaaagtgctgggattacaggcgtgagccaccgtgcccagccttcttgttttaatcttttagacaactggacacaggtttgtctttgaaattgtactggtttttcttgatgttttagtgctcctggatgtccaatgtcattcttgggctagttgaaggaaagttttggctacccagttgttagctgctgaagtttaactgtgcattctaagcacaccagtattttattacatcatacctgggcagcagataattttagtaaaaccttgaaaagatatgactattgggaagaaatttgggattctatcctttttctctccattcttctctcctgcaccaagtttctaagctcgtgattaaataaattctgaccctactctgataaaagtgaacccttgtggctggtcgcagtggctcatgcttgtaatcccagcactttgggacgccgaggcaggcagatcacctgaggtcaggagtttgagaccagcctggccaacatggtaaaaccccacctctactaaaaatacaaaattagtcaggcgtggtagtgtacacccataatcccaggtacacaggaggctgagacttaagaatcgcttgaacccaggagacgggggttgcagggagctgagatcgtgccactgtactccagcctgggtgacaagagtgaaactccatcttaaaaaaaaaaaaaagtgaacccttgtagtttcttcctctgtttgacagatggaccctaagacggccccagtgataccccacctcctggtgtccaaggcctgatgtgatcacccttcccccaccttgaatgtaggtgggatatgggagacttacttctgaccaatagaatatgaaaaagataataggatgtaactgtttagattcggttacactatatggcaaagcaaagggattttggaaataccattaaggtcttacatgagacagattttgagttaatgagcagggggatcctcctgggtgggcctgacttagtaaggggaaaatcccttaaagaggagctaaaataagagagtctctctctccattgctggctttgaaaaagtaagctgccttgcagtaaggaactgcatttggcttctaggagctgagagtgccctaaggaagccagcaagaaaatgaggacattagtcctataaccacaaggaaatgagttctgctagcaacctaagggagcttgaaggtgattgaccatccccagtcaagcctctgatgagaccgcagccccactaggcaactagatttcagcatggtaagaccctggatggagaacccagctcagccatgcccagactcctatcctatggaagctttaagataataaatgtatgtggctttaagctgttaagcttttggtaatttgttagatggcaacagaaaatgtgtacaccctggatagtagacagagactgcatctttctttggcatttggctgcacagcaagttctaagttactcaccaggtttcagaggagagatgggaatttgatgatcttataagaaacctgtactctttggccagacacggtggctcatgcctgtcattccagcactttgggagaccaaggcgggcagatcacctgaggtcatgagttcgagaccagcctgggcaacatgctgaaaccccatctctactaaaaatacaaaaatcagccaggcatggtggcgcatgcttgtagtcccagcgacttgagaggctgagggatgagaatcacttgaacccgagaggcaggggttgcagtgagtgcggtggcagctgggacattaaccaagttgtgaaaggagccatgatgttattagctgagtcatgtcactgcacctccagcctgggcaacagagtcagactctgtctcaaaaaaaaaaaaaaaaagtgtactttttgaggaaagttctatttttcattattttccactatgaatgaagaagaaaataatatacatacattactgggattcatacggacattatttagacacacttccacctacagagtcacatattgtatagaataaaatatcatcaggagcagctcatgtgaccagaatgtggcaaagtctttgctctacaggtcaagttgggacttactgaggagaaatgaggggacttcaaagtccaggttgcaccatccactttatagatgaggaaagtaagaacccacagcatcttgcacgtagaattcaatatatgtcctgcttcttgaatcacattgacctaacaggtcatatgatttccatttgtttgcacaacaactcaagggcaaaagtgaaattggaatttttgcttttgaatttctgaaaccttgttttatttatttattttctaatcttttttttttttttttcgtggaatcatgttcccttcggaaaactccctgggtgccccagcattatgtggtaaaggacatgtatttccaactggcaggggctctgcaaagtttctctgcctcctttgctaaccaaaccctaaataattgtctggatgttccttttattgtcacctctgaaacaagacgaagatttggacggtttgctttagagtgcattaacttctttatcacattaatactgactcatatcttatttcccacttgcaataagaaaaccattcaaatctttccctcacaggacaatatctttaatagcttctgtgtgtttcctatttttggctgtttctgtataaacagactaatctaatagcatactgaacccatctaacttggcagaaattcagaaaatcactcatttctatggcaagctgagatgctgagaagggggaaaaaaccctcacttttattgcagcaagatttttctcaaagttgcctttcatgaacataatatgtctatcatttggaattctccagcaccctggctggaaattatttattgcagaacgacacaatggtgaacgagaaggtattattccctgtacgatttctggcttgaatttgtttgcctaaaggagcagatatcgtatgaacatgattttgaatgctggcatggtgatgaaaggtgatgttcacctggagtctgtacacacaaaaccctgttcattttacctaaagggtaagaacatcatggcccccttcatatcctggttaatgtccccgctgaccctgagttctgcctccatcactggaacaagagcctgtctttgggaagaggtgtcttccctggcactcgtttgatttgtagccgccacacatggcaggtcccaagctgtctgaagtcttggctgccattcctaagctactaaaactttgctggagaacatcaccaatcacgctgagggatcctttgacaactcagcttcatgaggacagctgcagttctgcgtttaggctggggtcaccggggtcgctgccccagccccactctttagcctcagtccctctgtggttcccctgactgagctcctcactaaaggggaggaatccctggagcctccccatccaaggccagcgtgttccatttgagggtaactggatccctgaaattcacccccacacaatccacaacctactactagaatgccatatgcttttctatatgctgttgtttaatttcagttggtacatattttattttttgaaacagacttcgttagaacatctttagatttaaagaaaaatcaagactgtagtaccaagttcccatgtgtgtaacagccagtttatcctattattttaacgtcttatgttatttggtacatttattaagattaaattattgatactgaaatattaggttgtgcaaaagcaattgtggtttttgccattaaaagtaatagtaataataatactcggttggtgcaaaagtaaatgtgttttttgctattaaaagtaatgcggttttacttctgcagtttttttgccatttgccaattacttttgcagtttttgccagtacttaaaagtaatggcaaaaactgcaaaagtaattggcaaatggcaattgcggtttttgccgttacttaaaattgcattacttaaaagtttttaagtaatgcaattacttaaaacttaagtttttaagtaagtttaagtaaaatttgcattacttaaaagtaatcgcagtttttgccattacttaaaagtaatggcaccaacctaatattgttattactttttaccaacctaatattgttattaactaaagtccatcgtttatcatattgccttaggtttttaaaaaattttttacctaatgacttttttgtgttccaggagcccatccaggataccacttttatttattttttttttctttttgagatggagtctggctcttttgcccaggatggagtgcagtggcgcgatcttggctcactgcaacctccgcctcgcaggtttaagtgattctcctgcctcagcctcctgagcaggtgggaccacaggcatgcgccaccacgctcagctaatttttgcaggataccacattttatttaattgtcaggtctccttagcatcttcttggctgtgacagtttctcagaattgtctttgtgatgaccttgacagctttgaggagtgctggttgggtattctgtaggatgctcctgtgttgggatttttatgatgtttttctcatgagtttactggagttaatgaatttcagggaggaagaccccagaggtctgttttcatcacatcgtatcaagcattccaccttcatcatgactcttcactgttgatggtgactctgattcacctggtcaaggtagtgttcattaggtttctccactgcacacttagtctttccctctactttccacactgctgcctttggaggagtgttgctgtgcccagctcatgcttgtggagtggggatttaatgttctcactcttcgagggtagagtatctgcataaactacttggaattctgcatggaatatttgtgtcttctcccccatttatttatttaatcatttatttatatcacggtacactcatggacatttattttatgctttatgttataatcctatactactttatttattttgttgcttaaatttttccagatggaacaatttggtcttcaaaagttgctgctgttggctcctgtgttcttgtgatgtacacacatcatggtgtggtgtgtttttatctttggttttgttttcacttcttttttgctttttgtgcctcctcttccctcttccccccacctcatacatacacaaagggcagcatgctactataatttctggaatctcagccatattcttcttttttttgttttaaataaaaatcatactagagcagtaggcagtgtgggtgagttctcccactttacattttactttgcataatttaggcccctttcaggccactcttccccctgtgccccaggtgtgtttgctaccatacctccccaggggatagccctccaaacctgattggccaactagtctggtcttaaagtcccaaagggaggccatcacaaactactcagtatggagaagacctgaatcctaattttggcttaaccccaaacttgggcgattcagttttacctgtgtcctctctataccatagtttatgacaaggggttttctgtggctggtctccaaggcctcttccaatcttgacattctgtgatcctgtaagtctttgaataatggcccaggatgccaacaagaagtcaccaatgagagttcaggtgttctgttggaaatctttgtaaaatcacagagaaaaggagaagaaaaagaataaagaggaaaaactggacacataaataggaagacaaagaatgaatgtggactggggagagaagagtcattgacagggacaagaaataaataactttgatgcaaatcctgggaagactctggaacaacatggaggcacctatgttaactctatttcattttggaaaagttgactagacaaaaggtgcagagtagagtatgcagtgatttcagggtgttgggctctgacaagatgatgccgacttagacagtgttagtcaacatcaaatgtctggatcaagagaggcaagaatcccgtggatttggcgttggccagaacttgtctggaatcttgttttctgccttgagtgtcacctgttgagagctctgttgacaaactggcatttgtccttgggagagtagcctcaggaccaggggtgaagagttcagtaaactgtgtttaacccaaggaaagatacagggtgtgtcagattttgtaaggattttcaaggagcagtagatagtggccctacagtggaatgaaccttcacaccgaggatctgcttcctttgttggaggtgggaaagcaaaagctggatgcttggaattgtcatggctgccgtctgagtgatgctaccttgagtggacggtttggccaactaaggagtaaggcctctccctcatgtcacattgagtggtgctaatgtttcctgaagtttccctttcttttcagttcagtgtttcagaatctcagccttccagcagaatcccctttgtttgctctaaatatacattcccaagccccgtgtggccattctgatttactaggtctggggttgggggattgtgggtgccgagaatcagtatttctatcaagctcccaaggggacctgatatatacatggagctgaaaagtacccacctaacagacttgccagctccttaaggataagaactatattttcttcctttttttgtatgcctccccatgcaaggataattacacagaataagcactgagatgcctgttgatggatttattccagcaattttttttttttagctctctttgtctggaactttgcaaaataaacaccatggtcactccgtgctttgtgagtgacgtgctagaatggaatttcactgttttaaattcagggttaatttcttgctttcaaatgaattatgaaaggaagaggagagacctttggaaaagtctgaatgttgatgccgacgactagccaggcgcttcccttccagctggtttcgtgagggattaagaggccactgttgtgaatctcccattagtgatggtcccaggccccctcctcattgtgcatttatcttacaagaggcatatttaggagatgtttccgttctattttatctgcagaattactttccattctcaggtcttttatataagtattcccttgaacccgttccaaaaactggatttttaacccaatagaccataactgcagtgttttattgtgcttacatatttcaaaatgtgaatgtaagtagatttagcaaagttaaaataaaatgaaaacttttcaaagggcaccactgctcgcattcccatgttggagttttccctttggggttcttatgccattttaaagactctgaaaacaggaagactttttctcttgggtattttatttttttttcctctgcaagggatggggtcataagacattggtgaggttaggccttcctttgtctcccaggagcacacttgatagcaatgtagggtgaattccaaatctgtgagttagtgccgtatatagcagtgttgtcagtaagatttctcactggcatctctgcttcccctcttgactctcttgaaatcccttcttcaggcagaagctggagtcatttctctaaaatagaaatctgatcttgccaccaccctacttgccactccctgcttaatcccttcactggctcaccatatcccttaggataaaataacaaaatcctttccagggcctgcaagacccctgccaacctctgcagcttactttgtaccactttccccagaaacctgctacctaccctgctccttgccacagggcctttgcacaggctcttgtctctggctagagtagtcttcccatcctgctttagctaatcaactctttctcatcatttaggcttcaaatggatcatcactttctctggggtgcaggggtctttcatataagtatttctttgaactcattccaaaaaagtggatttttagaaatagaaaaaactaatttagaaatagaaaattaattgagttttagtttttagaaaattatctaagaagtagatttttagaaatagaaaattaacgtagatcacagaaaattatccaaactcagttaattttcccttttccagcaactgtatttgtcctccccacttctcttccctgccttctttttttctccttagcacttacaatgtctcactcatgtagactcgaagcttcacaagggcagggattttagtctatttcattgaaaatctgtcaccagtcactggcccagagagagtcctcaaaaataattgttgaatgaatgaatgaatgaatgaatgatgatggcgtgatgattgtgtattcctcatctggctgtaagtttcacaaggccaggcactggggtcctattttgctcactgttgctgtgtgggaaagagttagtacagcagactgtcgcaagcttggctcttggctgcatctgggaacttggaatttaggagggctgtcaccattcccagatcagataaagatggctcactctgtctagactgcttgtaccaaaaatagggctcatgtggaatacctgctttcctttgtggaggctggaattttgttatatgctacagagagggtgcctacgtggccaacttccaataaaaactgtggacactgagtccctaatacatttctctggtagacaatacttcatatatattttcacagctcatttctgggggactaattaaatgcatcctgtgtgaccccactggaagaggacatttggaatcttgtacctggttttctccagacttcgcctcattcaccatttccctgtgctcattttgccttgcatccttttgctgtgataaatctcagccatgagtgtgaccgtatgctgagtcttatgagtcttccttgcaaaccaccaaacctgggttggcgtttcagtgcctgacacagttgtattcctaagacatagttgggaccagacctcaagaaaatagccaacaaatactgggtgaatgaacgaaagaggccatatgcagtcagcccccctctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcatcacatacattatatgcaaatactatacaattttatgttagggacttgagcatttgtggattttggtatttgggggggttccttgaaccagtcccctttggatactgagggacaactgtacaaatcacatttaggagtggatgcaggtcagtcgtgacatctcatccaccccttcctcacccaagattctccgtggcttgtgtcaaggcctcaccacatcagaatatttctgctcatggttgctgagacagagctggacaggtccagcatccattccccaaaacagaactcaaactgacgatcatcaagatattccagctatggcaaactgcggaagaattaggacagatgtatgacttatttcatataaagctaaatcagtttaatttatatgattgtcctttattatgagattatgttcaacagatattttcagtgttaaaatattcttttttttttttttttgagacagggtctggctctgtcacccagggtctagcacagtggcacgattttggctcactgcagcttcctcctcccaggctcaagagatattcttgcctcagccctccaagtagggctacacgtgtgtgccaccgtgcctggctattttttgtagggacagggtttcaacatgttgccaaggctagtctctaactcctgggctcaagcaatctgctcacctgggtctcccaaagtgttgggattataggtgtgaaccaccatacccagccaaaatattcttttcaaagtgattagaagtaggagaagcttgctctctttttattggcacttctgtcttacatgcactttttgatttaaattattctgtcttctatgaaatgacagtgattggaggtggtttatttttttttaagtctgcttactcggaaaaataaaacaaagttgacaacctgatttcagacctcccaattttttcttaaaaaaaataaaagtcttcttggtccatgaaatccagaaactggagaccaaactagcaaattcgcaaggagctgcttgatagaaaaacacttgagatcaagagtcagaaatagctgggttgaattccagttctctcatattaagtgacaagttgcagaatgcccctgtctttctgagctgtttttatatctgtacaatggggttaatactactagtatttgcttccagggattgttttggaggggagtgaggaataaatgatataattcactaaaacacgtagaatagtatttgacacagagtaggtcagcatgcccaaagtatcagagtcattattgagttattccgctacctccgtatttgagtcctttcttttgggctttcctacttaacgtcgcagatgttatttttttgaagagggtgtaggccaagaaaggggtgggagaaacgagcaaggtgttgatagaaccccttagtgtcctcctcataccacagacactctcttcccccacttacttggccaatttttttttttttttttttttggtggagtctcgttctgtctcccaggctggagtgcaatggtgcgatctcagctccctgcaacctctgcctcccatattcaagggattctcctgcctcagcctctcgaatagctgggattacaggtgtgcgccaccacgcccagctgattttgtatttttagtagagttgggatttctccatgttggtcagactggtctcgaactcctgacctcaggtgatccacccgcctcagcctcccacagtgctggggttgcagctgtgagccactgcgcccggcctacttggccaaattcttgcctgatcgcctctccacccctgctacgtgtaatagaaaggtagggccatgttggagagggatccaacatttattatccccattttacagatgaagaagttaaggtggccaggcatggtggctcatgcctgtaatcctagcactttgggacactgaggtgggtggatcacttgaggtcaggagtttgagagcaatctggccaacatggtgaaaccctgtctctactacaaataaaaaattagccgggtgtggtggcgtgtgcctgtaatcccagttactcgggaggctgaggcaggagaatcgcttgagcctgggaggcagaggttgcagtgagctgagatcgtgccactgcgctccatgctaggtgacagagcaagattccatctcaaaacaaaacaaaacaaaaaaacaagaagttaaggattgcagagcataagtatcttctatggggctacccaactaggtcgggacagggcagggatttgaacctaggagctcttggattgcaatttttcattcacccctccctctccacccttcctgtcttcaagcctgagcaggtgatactgcattttgtaccgtatgactttaaaacagaaccacgagttcagaactttggttaggtcctgcccgtgttctctagctaacgcatggcaacgctggtttccaacctttcactgtgcgggtttctgatgagtacgctggcaggcctctggcttcagagatgccactacaaaggtctcctccttttcataaacattgctgcaaggcccgcttctcaagaaagcaacttgtgctacctcctgcgtgcttttatgcttcgctgtgaagtgcaaagttgggctggcaggcctggctttcttctccgacttatgtatgattcatcaagaggactccaggctgtggtgtgcggtgcaacccgggctgtgttcccgagtgcatcaaacggggattgggacctgttttccttcccactcacatgtaggtcacctacgggagcaggggaggaaccatctgaggtgtttttttttttttttttagatttctcattgctgagaacagttccagctctgccgaccaaaggctgagtgtccttttattagtctgagcccctagagagaccaaagaggcaaccctcgagccaactgacagccagctgtggggttggaccctgtttttcatacagtgagcactcttgaacccagagaaggtgcaggttggagatgcagctatatgactctgtaccagagagagacctttttgtacatttggaataaaaatttttagcattagagattcgcttttttgtgtctaaatacaaatgtccaggagaataggaatgccatagtggtgagctaagagcaggcagttagttaagtgtatgacaagtatctcattataaatggatgctgaaatgtccaagtgtggaaatgatacgcttcagctcttatttttaagtcatccttatctctttcacttattccctcattcaggcaccaaaaatgctgtttgactgggagagcaagtggagctgttcaaagttgtagggacagccgggcgcagtggctcatgcctgtaatcccagcactttgggagggcgaggcgggcagatcacaaggtcaggagttcgagaccagcctggccaacatggtgaaaccccgtctctactaaaaatacaaaaattagctgggcatggtggcgggcgcctgtaatcccagctattcaggaagttgaggcaggagaatcatttgaacccaggaggcggaggttgcagtgagccaagattgcgccactgcactccagcctgggtgacagagcaagactctgtgttaaaaaaaaaaaaaaaaaaagttctaaatcagtggattctgccgataaacatcatctggacggaatgaagctgagggccaatagtttagaggctcagcacccgactggagagagagagagagagagagagagagtgtgtgtgtgtgtgtgtgtgtgtgtgtgtgtgtgtgcgcgtgcatgtgtatacgctggtgtttaggtgggcttgagaaaagtgctgactttgtgaacgaggaggagggaaagggtccagagcagtaaagagcctgtaaataaattcataccagcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaaactgtacctcttgccactcaacatctgcagtcaaaggcttcctgactcaggatttgctggggtctggctctgggctattagaattagatgcgtgagaccctttcaatctaaaccttaagtattttgcctgttggacagatgcctggttgtccctttaatccatcgcccaaaaagcctgaggaaggatggcaggtggacttggatctaggccactcccttagatcctgattaggggacctctgcgactgctcatctgggaggaactaggggagcgctaatgtgttgtccttgactgggcaagaagggaaggagaattgtgaaacatgcacaattagaagtcgtgcacctgggttcatatcctggctgggccacttactttctggcgggtggggagggcagacaagttgctcatcctctctgcgcctcagtttcttcatctacaaaatgaagatgttggttatttctttattcaagggttgttgagaggatgaagtgctaaaaatgcttgaccagcattcacacaggcactaagacggtgagtactcactacttagcgctgtcaacatcatctccgtccacatcaatgtcgtcatcgtccttatgaaaagccctgggcatcattttgcccttgagctggatgtccatgttggaaaaacagctagtggaaggcgtgcccaaatctcagaagttggcgtttccttgcagatatcattggtggccattggaggggaaaaagatgctttggaaaccaggacacagagaaaagtgcctcgtattatacagagccaagagaggtcactgtggaagtacagaggaagccttggcctaattgcacggttaatacaattccgtaactcatcctgccaacacgaaggtagatggacggtccttatgctcgctgcggaacactgcctgtgttttcctaggagagacatctgcactctagtagtgattaaaatgcctttgacaggctcttgctattaagagtttctggctccagtttaataaaaggtagtatattataatggaaaccaggttattattgataaggactagacatattagagaccaggttaaagctttgatagtcccaaatgcaaggggagggagctaagggttattgcaaacctactgtgtgtcaattgctctaccagacacctcagagacatcacagccaaagacccccacctttgaataaaccaagtttggcctctctgatatattaatatatttaatcatcagactttcagtgttaaaggagattacagtagaggcatccagttgattggggaatagttgttgcaaatgataagctcttttgaataaactgatactgacttaatgaggttctgctgtgtactatcttttttttcctaatagaaaatagagtagctgccctccccatccgccattctcagtccttttgcttactagtaatgaccctcttttctctcactccatgggaacttttaaaactgataattaatggatttttagcctcaagtttctggaattctaagagggcctgaaaggtaagtgctcacttactgaggtgtgtgaacaaaaacaggcaacctagctcagcaagtaagaatggagtggcatctccccacctgctctggagtcatgtgtttgcttctggaagggaggcaagaggcattcaacctcctgttaatttggttgctccttcagatacgctcttcatggtacagccctgagctgcatcatttaaagaccaattgttaaggaccaatctgagggcctgtgcattagttaaaactccttatctggtcatagagggtggtgtggtttggacgcgttccccttgtctgtgcaattcccaacagaggcaagtgcgcatttgagacaggttgagggttcaagctgtccaatccctgctcatctgcagcacaccaaggaatgtggactaatgaaaaataaactgcatgcatgcaatgcccatcacactgcctgcattttctaatcttcacaataactctgtgttgagaaatattcctgtctgtaatcccggcactttgggaggctgaagcgggcagatcacctgaggtcaggagtttgagaccagcctgggcaacatggtgaactccccccaaccaacgacccttcccatatctactaaaaatacaaaaattagctgggcatggtggtggggacctataatcccagctacttggaggctgatgcagcagagtctgttgaacccaggaggcagaggttgcagtgagccaagacagtgccactgtgttccagcctgggcaacaagagtgaaactctgtctcaaaaaaaaaaaaaaattgtttctggccccacgttacagatgaggcttttaaagatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagcgcggagtaggtgcttaagcccttccatttgaaaggagctttaaacacctttggtggcagctaagagtgtcaaaatggagggatgtgtaggggacctagggcctgggtaacattgtcccaggccagggcctattgtgttgtgtgtgtctccactttccagcctttgggaacgcagagggggacctctgtaattggtaccagcatcccttccttgcagggtccgtccttcctctgagttgggggaaggggtctccatggtttcttctaccaggtagacccagaatcactttcaacttgctcacctgtctgtgcagtgtttgagttcttccctgggaagcttgctcacatcatccacttctctctgggttctccgtaccgctttccccaatccaagctaagctcttctcttagttattctaataactgcccaatatcaggcactaccctcaacactgtttcccatggcaattattttacatgacagtttaaaaaacaggaatgctcgatttgtattcccattttgcagacaagccaacgaaggcttggaggggttgaatggcccaagtttcctaagtggccaggggcagagtcaggatctgaacccaagacataggcccaggagtctgtgtttgttctttaaacctctctattcagttgcccagctcttttcattccctgtcctttccccctctggctgggtctgcctttccaaccgctaccaccttccaccaccattttttttttgtttcctctgcaagcaacatctgaaaggcccagacccagcttgttggccttgggctctgataagatctgtctgcactccttttgtctggcctgtacctgccttttctgaatgaccctgttaattgcaattgactctcatagaatgtggatagcagtgccacttgacaccagactaatgcttctgacttttccatggtgccccagcagcaggctggagggaagggcgggggcggtcagaggagagatagagcacttcagattccaatcgaatacattagagcattagagcttttctcttcctcagggtgctctctctctctgggttgggaggagatgtggcatttctaggaattcacagtaaaatcagaaataattaggagatttcacagttgtagctcctgtgaagattcaggaattttttttttcttctatttgcaagctttagtcctaggcatggaaaaagaactttgaagaaaacctgagagatatcagtgtaaaacaagagaatgattccctctggggtgctggtagtgggggcttaatttcctaaaggcttactgggtatcagggctgctttcctttataatcttttacccgtcttatgggggatgaacagaaacacactttagtgctagaaaagctgggcctaaaagaccagtctcctgtcccatacttggacatttattgttctttttgggcaaggtgaaaacttgaaaccaaaagtctgttgagtttggaagacttgactcccaggatgtacaaagtacttctgcatgtgcgcaaagtcctgtaggcccaggcatcaatgacacatgcagtgtgggcccaggcatcgatgacacacgcagggaagcaacccaagctgggtcagtccttacaaggagaccggcacctgggctcacaccttgccgtatatgacttcatgggaacctcataacagacctgtgggctcagaattattctctcactttgcagatgaggaaatggaagtgcacagaaggaaagtaagagtgtttgagatcctgtagtgggttcattgctgagaataaacccggagttgcctctgggaggacctggtggtgggtgggatggagagagaggcctcccctcagactccaggggcacagattggattttttttttttccagacagtttcactcttgttgcacaggctggggtgcaatggtatgatcttggctcactgcaacctctgcctcccaggttcgagtgattttcctgcctcagcctctggagtagctgggattacaggtgcccgccaccacgcccagctaattttttgtcttttttagtagagacagggtttcaccatgttggccaggctggtcttgaactcctgacctcaggtgatccacctgccccagcctcccacagtgttgggatcacaggtgtgagccaccatgctaggcccagattggcttctgtgtgaggatgaagagtaataggaagatagagtggtgatctaatgtcaactgtggagggagtgggaggcaggtgttcgcagggcacagctggtttcctttttgaatcccacacagtgctggggcagtttcatagcctgtgaccacacagataggaaagtgacacagcaacaccaggcagattcattttctttaaatgaggggttcaaaatagaaacacaaagcattgagtattgagaagaaatggatcttcaggtttggagggaggccgatagagagtgtctggagttgccaacgtcctctccttgggtcatgggtgtgtgtgtgtgtgttttcttcttgttgttgggttttttttttttttttttttttttttttggcttttgcgcctatggtgacttttagcgaatggatactattgaaggaatgtttcacttccaaatccagatctctgacttcccttgaaaatttggagtgccactcaagtcggccgctctgagctagaatcctggtgttcagaattggcaggaagggcacaggggcaaggtataggctcacgtctccacattctgcacctcccaggctcctgccattgatgtgagcgggttcctgtactgcatgaagcaggggtttgcatccgaaacaaccacccgtgctgaatatgtaggtgatacgttgatctgtacagcaaaccaccatggcacacatttacctatgtaacaaacctacacatcctgcacattgtaccctggaacttaaaagttggtgaaagaaagaaggggccgggcatggtggctcacgcctgtaatcctaacattttgggaggtcgaggcaggcagattgcctgagctcaggagttgaataccagcctgggcaacacggtgaaaccccgactctactaaaatacaaaaaattagccgggcgtggcagtgtgtgcctgtaatcccagctattcgggagggtgaggcaggggaattgcttgaacctgggaagcagaggttgcagtgagccgagatcatgccactgcactccagtctgggtgacagcgcgagattctgtcttcaaaaaaaaaaaaaagaagaagaaaagaaaggaaggacagatggaaggaaggaaaagggaagggaaaggaaaggaaccagctgcaaaaattgtcctaactgagcattactgtaacatagaacagctgaaacactcctcaaagctgagaggagggtttgggagagaagcaggctgtggttgtgaacaggtgcctcctccaaaaaaattctcttccttggatttcaaaatgacccccgttgacaacaaagcctttcacgctgtgtttattttttttcaggtctaagtttcccccaggagattttttttttctaaaggaaaaggcagagaagcccccagaccggagccacaatcaaatgcaaatatgacaataggacccatcctggagagaaaaagccttctttttaattagaagcctggaaggacataccctttaattgctgcacttgtagtgtcagggttatcaatatccgtggctctttcattaataaactggcgagtcagaaagcagcaggagtgggaacctctccccacccaatcccctctcacgccccaagctctatttaatcaactgcagactcaatcaaatggggaaaagaacatgtaaatcagctcattcattctgctggccctaaataggtagaaggaagggaaacatgaaagggagccttcatctgttttcctgcagatgcccggctcgtggttaacccaagcaagaggtagttaaacggccccgcagattgccagtgactccgggaatgcctaggtttatgtatggattaacacagtgatagaccctgagtagcaaaagacgaagactaattacctgacagagctcccctccactcgcctgggtcattgaaattaatttctgctttcaagcttggcagaaagcagctgcagaatttcagttcaatacttaaattaacggggagccgaaattatttctgtgcacaggcagtattagaggagtggcttaccaaatagatcttgatcgcagacacggaaaaaaggattattcctccccttttatcaagagccgtaagtccttggaaaatgcaaagagggggaaaaagaagaaaaacagcaacgagtttattggagagttaacacttaaatactccagtacattgagtgtgacatgcctgtgtaggagactgtctgtcccccaaataattgacaatttctctccatctaacaagaaaatatatggcacttttatatatacttgaattggaatccctaatccagagataatttgtgaatatccattctatagcatcccatgttgtcaagaaggtgttgacttactgcaaggttaaggaaatgggtggagaatgtagggaggaggtggaggataaaggataggactaggaatcagagttgggatttgaacccagggcttctgtctccagattccttgttctgtccctttatgctgactttccttttttgctcaaagtctctctccttgcttctttctctttgggctccctgcttttatttcggccctgatggaatctgtcgactttactgagctccatgtatgtgcaccaggtcagattcaatgctgcctaggtccacagtcctcagttatttgttcctgtgattttcgcgccaccaggagccacttgttggatgagatttccgggcaagttgagtctccatgtttttgtcgtgggctactgccagctgagatatggatgaagactccctttcatgtttcccttctttggtgtccatggcagttcccacctcgaccgctatggtatttcttttgcttctgctgaggctgtgtgtgggtgcacatcaggatacctcagtggggaactcagggcgtgaggcacactcatgacagatgcaggaaaaacatctcttttctaactgtccagctctttaggattaggcaatactttaataatcaaccaaattctggaatcctactgccaaattatggcactcatcctacttggtgtaaaatcctgggatgatagcttataatagtaataataagacctgcttcccggtgattctctaaggattaaatcagttcatggagatgaaatacttaaactgtgcctggcacaaagtaaatgttagtgctactattatccctgctgctgttaaccccaactagataagccaagataaggtgctctccattgtttacctgaacaggcagaaaagctctatgcagctatccagacccaagaggatccgacagctctggaacttgtaatatttgcagcatgtcttgccctcttaatgtctaagaagtcaaaaaaggacacgtatgcctagaaaacatgaataattatcatctatcaaatttttaccatgtgccaagcatagtcatatttggctaacgaaaacaacaaaatcaaccgtgacaaggttttattagtaatgaaactgaggcttctggaggatctgtaactgttgcaaatttccagtggctagttcagggacagtgccggggcttgaacccctgtctctgtgtctcccagctcataaggtgtgctaccaagtcacccatgagtagcaattaggcgacttctaacatgtccagctttaaacctgtgacctcaaggcaaatgacttccacatctcattagcactccccagagccttccagccccctgtaggagagggaggttaatcagccacgcgctgaatctgcttataaggctgtttcatgtatgatttttatatcttggctcctaataatggccccgttgtaaatgattgtctcactatgatatacgggttccttaccttctaggaactgatttaaaaggaagccctagacttcttgtgcctgtagagtttattcatatcactctttgcttgctcagcagttgaaatgggatggaggaaagccccctaactccaaaaaaaaaaaaaaactttcttcccagcctgagacagttgccataattagtaacctgcagctcccttgatatcttgatgatactttattaaaacaaacaaacaacaaaaaacacagctgggtgcggtggctcacgcctgtaatcccagcgctttgggaggccaagatgggcagatcacgtgaggtcaggagtttgagaccagcctgaccaacatggagaaaacctgtgtcttctaaaagtacaaaattagccagacatggtggtgcatgcctgtaatcccagctactcagaaggctgaggcgggagaatcatttgaacctgggaggtggaggttgtggtgagctgagatcacgccattgcactccagcctgggcaacgagcgaaactctgtctcaaaaatgaatgaatgaatgaatgaatgaatgaaatactacttctccctgtcctccccaccctaagcatctgatcagacaggtagtgctggtggacagatggacagacacctaccccatatgtcacctccctcctctatgcaaacaaaaattttaattatttctagaatgacttaggagagcaagtcatgtgggatatatagcgtcagggagcgtattttcaaaccaaaaacctgggcccttattttttttttctttttgagacagagttttgctcttattgctcaggctgctgtacagtggggcaaactcagctcactgcaacctccgcctaccaggttcaaatgattttcctgcctcagcctcccaagtacctgggattacaggagcctgccaccacgcctggctaattttttgtacttttagtagagatggggttgcaccatgtttaccaggctggtctggaactcctgaactcaagtgatctgcccgcctttgcctcccaaagtgctgggattacaggcgtgagccactgtgcccagccaaacctcggcacttttatccaacaaatatttatttcgtgactattatgagtcaggcttaagaatacactagtaggtacagcaggagagcatgtagaagaggatagatgtagaaaatcgggacggcatgttaggaatatagataggaattactaaggaaaattgtatttttgtggaattctttgaactcgttactattagtaaacggtgagttttggttctactcttcaatgagtttaagatgaaggaaatcattaaatagtgctttcttttcttcaaaagttgggttgcattgcatagttaaagttctttaaattcttctctaaaccccaaggctaagcaatatacaatctagttacaatggtctgcttgctgttaccagaatctgtcaagctctttcctatcgaagggttttttccatgtactggtttctctcctgcgtggtcttgttctacccttgaggagggtaccacctcctcattgcttagttgtcagtataaatgctcctttctcagagaggcccatcctgaccatctgtgtttttttcctatcaatgctttaacaaatgaccacccatgggtggcttacataccatgaatgtcttctcttaccattctggaggtcaaaagtccaaaatgggtctgtcttagtccttttgtgttgctataaaggaatgcctgagctgggtcatttacaaaggaaggaaatttatttgtctcatgtttctgcaggatgtccaagaagcatggtgccaatgtatttctgatgagggcgtcaggcagcttctactcatggtggaaagtgaaggggagccagcatgttcagagaacatatagggagaaagggagcaagagaggggaggggaggtgccagagactttaaaagaaccaactctctgggaacaaatagagggagaacattaatctagccatgagggatccacccccgtaacctagactcctgtcatcagccacggcctccaacattggagatcaaatttcaacatgagatttggaagcaacagacatccaaactatagcagggtctccttgggccaaaatcaaggtgttggcagggctgggctctgggggcttctggggagaatttgttctgactttttcgatttctggaggccacctgtgttccttggctggtggccacatcttccatccttaaaaccagcagtgcagcgtcttcaattctgtccctggctctgctccttctctccccctcctctccccctttgtcatctttttaggtttatttgtgaccttttagatcctttgtgactgcattggtcttccttgggtaactgcgcatactctcctcatgtcaagaacttacatccctctacaaagtcccatctgccatgccaaataacacctttgcaggtttcagggtagagcatggatgccttttgattttgatttggttgtttttggtagagatgatatcttgctctattgccaggctgatctcggactcctgggctccatcaatcctcttgcttcccaaagtgctgggattataggtgtgagccagtacacttggccttttggcaccattattctgcctgccatcctgtcctaactaaagaaagtaaggtccctccatcctccatcttagcccttctttccttagcctcctaacactcaacgcaatttatatattttaattttttttttgagacaaagtttcactctgtcacccaggctggggtgcagtggcgtgatcttagctcactgcatcccctgtctcccggattcaagcaattctctggcctcagcctctctggtagctggaattacacgtatgtaccactactcccggctaatttttgtctttttagtagagactaggtttcaccatgttggccaagctgatctcaaactcctgacctcaggtgatccgccctactgggcctcccgtagtgataggattacaggccattgtgcctggcgtatatattttaaattttatttttcagtttacttggttttgcctccttctagaactagaacataagctctctgaagtcagggaccatgcctagaatcgccttccttttatctcccatcagccgaaactaactctgctgtgtcacgctgtgttaggctgtgttggctgtgagtaagagaagtctcacccaactagctgaagcgaggtgggttggaggggggatgccttgtggaagtgacaactctaggcacgtaactggctcagactctgctgggcccagatatacagatgtcatcaagagtctttctcttccttttgagcccagctctccctttgtgacccagcaacttccttccccgatgatggccaagccttgaggatgtgaaactgcccagtgccccaatctggagtccaccatcctgggtctagctggggacatccttgaatcagcctctgggaatcactgaaccaacatgagtcacttgctactgtgagatctcagaacacatggatcaggacagagggcagggctgtttccccaaggaaatccaaatgctttacaggaaggggagtggatgctggcccggcccaggcgaggatgaggagtaactgagctgcagaccattgtttagccctccttccacctgggagactggctgctggttctcattgcttctgtgggtctccaggtttctatcattacacagattagcacacggttccatgatcatggacccgttcagtacacaatgaaatcatttgcaaagcaccttggggtctgttagagaagggaatggatgtctgaggtatgctaagcctaatctccatcttctcaaagctccactgccactgtcccgtaagggtgggcagattcctccccattctataaaataacagctaccatttcctgagggcatactgagtgctgacaggcacatcaacatcagaccatcaccttcttatacctcaaaatagtctgcagggtgactcagaagctcctggctggtaagtggcagatccagagatgaaacccagatctaactggacccaagacagaaatttctagaacagaagccacaaacgtgttagctaagtctggttatgtcaagtggaatatttctggctttgggggatcccagctctttttttctctctcactctgagtatttagaggcttttattgctatttttctaaaaggcaacattagtaatcaactttgccaaaaatttcatatgaacggtgggcttttctttctcatttgctttcgcttagtattttccattattcatttggcttcttgaaccctccctatctgtaccccacacttactcttattcacccagaacaggtgtgtgccaccttggagaagatgaagccagagagaaaatcagtcagacaggaattatgttgaaaggtgactgaatacattaccacctcccaggagttgaatgaaaaacggctatttctttaggacgtcaaaccacctttttcctctctaattcatgcatatccctatacaaagacccaaggtggtgaggggctggtttttagatagtctggaggccctctgagaatgcgaggcccttgttgtaaggaaacgctggtgggtgctcactccttcatcaggagccagccggctcccctgcacttactgctttggggaagagtttttgtcaagatcatttttgcagatggttgtaaggtaaacagtcactggtccctaggatatcttgctaatgagacaccaaagatacacatggacaatggccagaccatattttgtcacagaatgccgacccacaagctctggagcagtcaactcagaatggtcaggacttggtcagtaatgcccatttttgctaaattttgtccccacttccaacgcaggaccaaccagagaaagccacatatgctccccaaaccaatcatacaggatgtcctggtctagggagcccacctccggcttccccatgtccacagcctccaatcggagcatactggaagtcatccactttcttttttgtttaaccataaagctttctttctctccacctcctttgagcctctgccaaacacaactgatggtggctgactgcctggctgcaggaagttctgaataagtgacctctatttgttattatttgggttccctttgtttatttttacactagctttgcactaggttaattttttcccacatggcttttcctgtttgtttctttgattgtttttaattaataattagtttgcttatttatttgtttattttttgagagggagtctcgctctgtcacccaggctggagtgcagcagtgtgatcttggctcactgcaaactccacctcccaggttcaagggattctcctgcctcagtctcccaagtagctgagattacaggcgcccaccaccaagcccagctaatttttttggttttttttgtattttagtagagacgggatttcaccatgttggccaggctggtctcaaactctggacctcaaatgatccaaccgcctcggacttccgaagtgctgggattacaggcgtgagccaccgtgactgacctgtttttaatttttttagagacagagtttcacactgtttaccagattggagtgcagtggtgcaatcctagcttactgcagcctgtaggtcccgggctcaagcgatcttcccacctctgccacttgaataggtgggactacaggtgggtaccaccatacccagctgttgaaaaaaaaatggtggggtattactctgttgcccaggctggtgttgaactcctggcctcaagcgatcctcctgcctcggcctcccaaagtgctgggattacaggcttgagctacttccccaggctcttcccccgtttgttaatacataccatgaccttggcctttcccacctcttaggttttgcttactttcccttctgtcctttacttatgactctgcccccttttgacctctgctaaaattatttgttactgttgttatgttattatttcatgtgttaagtctacagtgtataacttgggtttacttatctcatttaacccttaggaaaaccttacacttaaatactcaaagccttgattttgcaggtctgattgatgggcatacagaggaattaaatgaccttgtcttccacatatggtataaggcacagtagtggaagcaggatccaaatctgtgtctgtgtttggatcaacagccctggccaccatcttgattcatttctcttatctgtaattctatggagggaggttccattgtatatttttttctttcaattacagtattatttgtatattggaagcctattgtactttatctgtgtaactgtcgtagcagctagaggctagtaggactggctgaaatgtcagaggaaggagggaagaaaagggagaaaagcaggacaaatgaacgcagattaaggaaaataaaaaagagtgtttggctaacttgcataaaaaggatctcatttttctttgtaacacattactacatacagtgaccatagtgtttctctaatttcttcaggacttactttgaagatgaagaagtatgtgtatccgctttttgtctttcagaataacatactgctgtctgtaaaaatacagataatttctctcttaaattccataagctggagacactgcccctgtttcaaatgaatacagattcattttgtcacctgtgtgaaattggtgtccgtgtgccttgcttcctaggctgtccaccatgacatcagcctgcccatgcaatgcttgagatttgccctgtgactcaacccaaatctaaagcccgagtcgtatgaatccaggacacctgcctgcaaatgcatttttcatgtataggttattcactctggtctttgagattatgtaattagcatatgttgtcatagtgatgtatttattataatggaggtgttctcaggaaaccagatttaatacttttaaatcagaggccaacatggacttttaggaattccattcacagtaaattttatgcgtggtgaaaggttatggaatgggtttccatgccatgtctccccctgtcccacaaatctcagctggcctgcaaaggttccactgtggatttttgccagccagccacgctgatgtagacagaatatttcggatttatattattgcttacttggcacatcttccattggaaatggaatagagaaaaggtggcttggctgtttggtttatgtcctaaaaccttatcgtaatgtgattctccttaacagagggattcgtaagcttaggactgatagagatttggcttttctgctgttggattgatagctccttgactgctgaagccattgcccatctgttcaactgttgtattcacgaggaggttagacccctgacccaaggcccaggtacctggctttcctcagttgggatcagaaggccacaaagttttcttatattttaagcatcaaagtagcaccactgtacagcatctttacttaatctgccctctttcacgtgtgtgcatccctggcatgcttaaacaagaaaggcaaatgagagagagcgagtgagtgcgagcgagagagccctgaggtgccagaaggctgtggttcctttgtgtctacagaaaagatataacgattgaattagactcttaaatatctgtggatgtcaggttgaatacaagcagctattcagtgttttactctggcaggagaacaagtcccctggaggtcagaagccatgcaggtccctggaagtgtgagcagattgttaaaatggtatcaaagatgggctggcatgaggccagagtctatccttgatgctcacctgaggtctagggctaaactcttgcctttacctgttccatgcttagccgttcctgctttttgcctagaacctcagtgctattgctcacacagacccagctcatgtccccaggccatgaccactgcctccccttctcccacctgtgcaggtgttaagcatcagtacataactgaggagtaggagggcagcagcccaaatctttgatgaagaacctctttcgtatcaacttatgctttggaacgagacactgttggatgggaatctggcttctaacaaactgattggttggactcatgccttattctttcggagccttagttttgtcatgtgtagaatggggagtattgctagctattcccatagggagtgagagagagtgtaagtaaaatgcaatggcaggcacagggatggttgccattatcagttacattattatgaggattattttctacctagatcaggtataaggtggatgtattattggcattcctaggactgttttaaaggaagtacctatgaggcctcatgataagccagatgtccagaagccagcttgagaccagggctcctggtcacttaaaagatgtttggggctgggcgtggtggctcacacctgtaatcccagcactttgggaggctgaggtgggcagatcacgaggtcaagagatcgagaccatcctggccaatatggtgaaacctgtcactactaaaaatccaaaaattagctgggcgtggtggtgagcacctgtaatcccagctactcgggagcctgaggcaggagaatcacttgaacccgggaggtggaggttgcagcgagtcaaggtcacgccagtgtactccagcctgggtgacagagcgagactccgtctcaaaaaaaaaaaaaaaaaaaaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcatataagtaaattatatgattggacccaggcataaaacgtgatttgactcccccttgcccatcacagttctggagttcacatatcatttgttactttgaaaaatgaacttttgttatttgattatggtaataaataatatacatggtagaaggagaagaaaatgaagaaaaatttagaaacttggacagaggaaaatgaaaatgttctattaattccactagcatgagataatcactcttaatattttgttgcatgttcttttctttcttctgagtgatagcatttttttcaacaaattgggctcgtaatatataggcacatagatatataattaaaaaaacaagaatttctcatgtcattaaacattgcttgaaaaaacatactagtaatttcctaagattacaccatgtaaatgaattgtattttatgtaaccattccctagtgttggatagctaggccatttataatttggacactattttaaaaaataactcaggcttattttactatttatttttgccttacactttttgtaaaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcctactcctaaaagagatacacaggaagagagaccttctgcttcctctggacactggcgcagcctggactagcagttgccagcttgggtttggacaacctccgaccttagttgaaaatgaccctgtgtaggacagaggagcaagtggaaagaacctgggtgcattgtggcattttagagccactgattcagctgtcctatgggcctcctaacccgaacctccactggtcatgaaataagctgttagtttggtgcaaaaggaattgcagtttttgccattgaaagtgatggccaaaaccacagtaacttttagcaccaacttaatattttgagttgggtttgaatcacgttgtctattacatgcagcaggacacatctctaatcacgcgagaggtctgagcaaacgtcttcacatttcacactgcagatattcttacaaaaggcaaagcagagatccagagaaattaagatctgctcaaggtcgtatccagctttgggaaccccaactattgcagaaatttctgaagtcgtcatattgctacttaaagcaaaatgccttctcctaaatccaggtagagagaaactctcaaaggccagggtctggactcaagatgagcacaggatttagaatcagaaagtgtgagttcaaattgccttcggctcttcacctgggtgggcgatttgaatagagctcacagccctgaaaaccctggttttcagattctttattggtaaatgaagtcagcttagtgatatgagaattatgaaacataaatccctttgtaaaaatataaaataatcttacaatcatcatcgtcatcctcatcatcgtgttccttcacaccagcggtatttatggtatttatcaactaactgctgtgtactatgctctattgaaaatgttagcaatatagtaatgaacaaaacagatgttatctctacccttatggtttttatattttaataaaagtggcagaaaagaaataggtaaaacaataaactgagctctttggagaagaggcccacgttcttttcagattctgatttctccgtgatataaatagttttttaggtgatcacttgtttttaatgtacctacctatctatacctttctctctctctctctctctctgtgtgtatgtgtgtgtgtgtataaaattacatatccagtatgaaacctaaaaataagattttggggcctgtgaatttttttaacctttcttaacctacatcctaattatttgatttgacattgtgatgaaacatactgttgttttgaattttggaaatagaccagtgattcttcagtagggtcgtaaggtcccgtcaatgcagcagtcaaattttttcttggtgggggggatgcatatgtgtatgtgtgtgcatgagtatcttgataatttagaaagattaattaaacattgatcatctatgtgaccacatttaaaatgagcaccaccacatccaaatgtctgagtttacattttgtgtcggtacttgctttggcagaactctgtgcctttccccaagtcttctgtgaccttctcacctggcctgcatcctggtccttatcaaccgtattttacagttaaggaaactcggctcaaactagcttcggggactcgctgtggccataggtgccctaggctgcagtctgagagtgaaactgaggtctcactcccttcatagtctgctctccgtctctgcctcatctggcttctcagggtggtggggcgtgggcactaatttgatttgatcacttagagacaacagcttacaaaatgctaccgagcagtgcctgtcctttctgagaacttgatataataacgttggcttgatctcctcagcctgtgtcttgagggaacaagtaaattaaacaagtaattagatccataatgtttttagaagttagaagatttaaatatatgaatctcatctgagtgtgcagccttttgtctgctgtgtttcctgccaaaagatctcttgacaggaaataaacattaaaataatctttaatcccttgtttggtctattaccattaacaattgatgcactttaattttgtggggttttaactacaaaatggaacggctaagtagtgataattgggtttggaattatacggtcatttatatcaacagagatgcaaggggctgggagggagggtgattaattatttactatttcctggctgtggttcctattatagaattttctgatatgttcttctgtgaacaattatcaccaaatgaaagtaaacaaatctgtgatttgaagccttatttagaagttagtctatatttaggtgatgtgggcttgattttcacagaccctgtgggctgtctgtgtgtgttccttttctcagtaccccagctctgtattcgagcgtggttatctttgtgcatcttaaaatccacaatgcacagcctggggagaagccttggttttgccagggggaaaaaaagagaaacacaacattgagtgaggtctagggtgaataccaaaggtctgttttgaaatgggggtgtgggttattcttctctctttctgatttgcttcagtacagtatgggatggggaagaatcaaaattattatgtcaacatgaggatgaaagttatgctctgttgtttctcataacatttgtgtgtgtgtgggtgggtgggtgtgtgtgaaaggtaggatcacctctctgtgcctcagtctccccatcatccttcggtggtagatcaatgctatctgatgaggccttttttgggatcacccactccaacatgcatgtcctttctctgtcccctcctggtgcctgtattagtctgttctcacattgatgtaaaggactacctgaggctggctaatgtataaagaaaagaggtttaattggctcatggttccgcaggccatacaggaagcccagttagggaggcctaaggaaacttaaaatcatggcagaagatgaaagggaagcaggcatgttctgcatggctggagtaggaggcaaggagcgaaggaggaggtactacccacttttaaacaaccagatctggtgagaactcactcactgtcatgagaacagcaagggggaaatcagccctctgatccaaccacctcccaccgggcccctcctccaacattggggattgcagtttgatgtgaaattttggctgggacacaaatcccaaccatatcggcacccactgagcacatcctcgtggatcttcctggctctccttacaaggggttccttccaaacccaagcgccacaatccttaggcagattgctctgacacagaagactggtgagttctagacttgatgtgtttcatgggaaacaggaagacatttaggggaggctgtagatacacagccgctctgtttagggaaggctgtcgatacaccgctgctctgaccatcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcaattgcgcaattcacacaccaggctgccactttggcccctgcgtcaccttcaccaccacccaatgtgtcctgctcatcactgaggtttgtcatttttactctgagtctgtccattgtcatcatctccaccatcaccccttttgttttcattgccacccttgcctggggtgagtgaagacgctcttctctggcttccacccttccaaatgcccttaacccacagatgggaagaaaatgaggtggggggaaggggactttcttgcttcctcatagttctcccccatcctgtaaaggagcctgtgcttcccgactcccagggccctgcagcatgtcaagaacaatattggacaagcttgtcagtgagggtccaggtggttccctgccactacgatgcatgctggggtcagtaaaaggagaacacagaagaatcagcagacccagagtctaacccctcctctagttaaagacgtgaccctggccgggactgaagccagaggcccacagcctactggacctttgtttcttgcagtcaggttctgatgacagattttagtcccctcttgaatttccttggatgtgatggaagtgattctcagtggacaagaggtcacattgccttttctagcttggaaggtggcgcaaataactgcttgaggctccctctcttgggccaagcttgactctggattttcattgttgtccttttttattaaaacaggttttgtttttttgtgtgtgtgttattttgttttttgtttttttgtttttcgggggctggagtagtgtgcagagcctggcggtgattgttctcattagaaagtatagtgtaatactcaataaattacttttgttctcaccttgggaagtggactcagaggccaagtgactttgatttttcactttatcctggagtttctcaaccttggcactattgacattttaggccaggagattctttgttgggggggatttcctgtgagttacaagacattaagcaacatcactggcctctacccactagatgccagtagcatcttctatttcctcaagtctcaaaataccaaaaacatttgtagatactgccagatacccctggggaacaaaatcacccctggatgagaacccctgctttatcctcttacagttttggttctttccatgagaaagtatttttaatagcaaagtaatgaacaagaaagtattaataagacccaaataataatataaactactactttactaatggtcattatgtgccatgccctgctctaaacacttgccatgtagtcactaatttaatcctcacaagaattctgtaatgtagtgtagtttcccagggcttccttgaaaacgtgccatagactagatagcttgaaacaacagagatttattctctcacagttttggaggccagacacctgacatcgaggtgttggcagagttggttcctcccggggctctcagtgaaagcctgctccgtgcctctcctccagcctctggtggctgccattaatccttgacattcgtcggcttgtggcagcagaaccccagtctccgcctccgccttcacatggccatcttcactctctgtctttgctcccttttcctatagggactcaagtcattggatttagggctcactggaatccaggatgacctcattttaccttaacaagttgcatctgtgaagattccatttctaaataagatcacatgctagggctgggcacggtggctcatgcctgtaatcccagaattttgggaggccgaggcaggcggatcacttgaggtcaggagtttgagaccagcctggccaaaatggcaaaaccccttctctattaaaaatacaaaaattagccaggtatggtggtgcgtgcctgtagtcctagctacttgggaggctgaggcagaagaatcccttgaacctgggaggcagaggttgcagtgagccgagattgtgccactgcactccagcctgggcaatagagtgagaatccgtctcaaaaaaaaacaaacaaacaaacaaaaaaaaaacaaaacacatgctggtgcacacataaatttggaagaaatgctctttaacccagtatgagcacgtggtattcttatcctcattttacagatgaggaaattgaggcacagacagattcaataactacgtgactcacagagataaccgtgtagcagaatcaggaattcagcccagttttttcagttgcacagcctgagctcctaaccatcgcgcctggggttctcaaaggctcgtccccaagcgacaacatcagggtcatctgggaacttgttagatgtgctcaccctcaggctcgccccaccccgccagacttcctgaaccagaaactctgggagtagggctcagcaatctagttttagccctccaggggattctgtggtgcctaaagtttgagaacttctgatcaaaaatgccagataagaaaaaaaaacctttcgagacatcatttgaatcaattatcaaatgtttccaaagtgcacttgctttgcaaagcactgtactactcatctctgcctccatcggagcgagttcaggagagttgtgtttacttttctaaaggagccttttccttcccattttaccagtgcccaaaagtcttagaaaaatgacaatgttcatatatttgcccacatgaagatagaaagtgtcatgtcaaagataaagggagaacagcattttctttttttacaagtcactcttacttaaacacacagcatgactctccttacacatttatttcggaagagcaaagtccgggtccccaggctcaactatcagccgccttctcatcccaagggctgtcaccaccagaaatttaacatgctgttagtgcatgcaaaaaaaagcccagtaattgtagggctcatcagtacattgttaattgatcctcatttcctattattttacctcaaagcaaacacatcattcaccatagtgacaccagagttgtttatcttctctgtgcaagtgtgtgctctttttagcaagctttttggatcctctgtttcagagggcctttcccatctgtttactattgtggactgtgctgctttttttgtttttaattacaggttatataaaatattgtcagcaggagggaggttattattaccttaaagaataagtggtagatgcggactggccactgtgagcccatcactaaaatgcacttccgtacactaaaggtccctcttccctggcagacagtggttcattttatttgaggaggtatgttgtgggcttggggaaacagaaggaaattggagacattgatatgcttcctgagaggtggaaggggccacttaacacagctttcatttttcagttgccagtgggagaggagctggggtgggcatataatgagtaacattcaaagctccttctgtctttttttcagagaattcacaaaacaactcagggcctcctggtcctgcaaaagtgtttactgtttatttgtgttgtttctgcttgttttgcttgccaccagctccctactcacttgggggaaaataacccatcaaaggaatagaagctcaggataaacgtttcagacctttcagtaagatagtaaaatttctttcattcccagacctctctccaaaagaggcagccatcattaaaagtttgttatggattcttccagaaacgttctatgcatttagcatcagttgcagatatggatagccttttcaaaaaatgcatgcaactgagactattggctatgttttgtttattacctactttttccatttaatagtatcttggagattatttggtaccagcacatgtagctcaacctcctaatactgcatgacggataatatgccatcacatggtgtcatttaatatattcattcctatttatagacattgaagttagatccatgtcttactattacacatgacttagtaatgaatgttcctgcatgtatatttggtctgcttgagcaaggatattgggagggaggatttccagcagcagaagtggtggaacaaaggcactgtgtacacctttgaaacaattaacttcaccaaaattactaaactgtcctctagaatggttaaaccaatttcctctctaccattcacacgtgagaatgcctgtggccccccagaaattatctccagcagcagcaacagagaggactggaatgccattgacaggtcccacaagtcagcaatcagcacgccattttttaaaatttatgttgctattgtatcgtaaggttcttctgaagcgaccacttcataacactgtgtagtccaatccctaagctgggcaatttttttttcccctttcaatacatcacattgattttctgtatgactttatctgcttaatacaaagtgggattgaacagttatttgtctggatttgatcattccttattaaacatttatgatttagctttcaccgcggcatcttcttgtaaggtgtttcttatttttatcattttccgtaaaggtaggattgtgttgacagccctgtaataaatgtctcttggaagagatgtgttgctgagaggtggggagggggtgggggctctgtgcatggaatggggggaaaagcttcagggaagggcagtgcaaattgtttctggactgatgccatcttttaataatagtagttaatagactgggtacaatggctgacgcccgtaatcccagtgctttgagaggccgaggccggtgtatcgcctgagtccaggagttagagaccagcctgggcaaacagcctgaggcaaaacctcatctctacaaaaaatacaaaaaatcagctgggcgtggtgatatgcatctgtggtctgagctactcaggaggataaggtgggaggatcatttgagcccggtagatggaggttgcaatgaaccgagattgtgccactgcactccagcctggatgatagagcgagaccatgtctcaaaataatgataataattgtagtagtagtagtggtggtggtggtggtggtagtagtagtagtgaatgccctgactttggggtttgcagtaagctaggattaagtgcttcacagtgaggcacagtggggagctactctgaggatgaattgcctagtaaataagtgaggtttgtataaccgaggccagatcttagaacctcctgctatctgtacatagaagaatgttttagtcagaggcaaggcaaggtcaccaggattcactgagagtgttggtcagcatttcatctgcatatacaggactggaaaataagagagcgcaatgagacatctagtttttttctctttcgtttgttctgtttcccactgagagaattttctagctttatgtggagaaaacagtattggaaattattactcagttcaagaaaacctcactgagcacctaccatgtaggtgctcatcccgataccactatcaggccctttggaccagttgcaaggatgcaggatgaggaaggcaatgtgagaaaacagaaggagcaccaggcagtcgtgggcttgatttttattttactattttttaaaaaacataaaacaacatacattcatcattttgctttctttggatgaagaattgagcctggttcagcatctcttgcaggctgtaattgagggtggtcattgactggggctggattcgggaaggatccacttccaagctgcacagttgttggcaagatgtagtgttttggtggttcctgggctctgggactcagctttttggctgttggttgttggctgttgccacatgggcctctgcaaaaggcagcttgtaacgtggcagctgacttttgtccaagtgagaaggtgagagtgcaagaattggtgagagagaccgcagccagggtgtttttttaacttaatcttggaagtcacatcctatcgctttggttttttgactgagattattcagtactgcaatagtctccctttaaagtggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatggaatcatacaatacgtggccaactgacttctttcatttaatgttttcaaggtttgtgttatttcatgtattaatattatgttggtgcaatcacttttgaaccaatctaactaatacttcatccccttgtatggccaaataatattctattctatcaatatattatactttgtttatccattcacagttcatgtcattcccactttctggctattatgaataatactgcgatatgaacatctggttacttctggctcttatgggtaacacttctataagcgttgccacaggttgcttctgatttctattatgagtaatgctgctatgaacattcatatacaagttttagggcagacttctattttcattccaatatctctttatggcatgtcttagcagtgatgtctatgacatccaggatgtgtcttgacatgtctgacatcatttaaataaaaataaagtagggaaagaaaacagatagtgattgtgtgtgtgatcagtgatggcttttgaggaggtgacatttgaactacaccctgaatgaagagagccatgcaaagacctcagcaaagaaaatctcaagcacaggtgcagcaagtgcaaaggccctggggtggaaacacactcgatgtgttcaagggagagtaagtggtgaatgggtttggagccaacagggataatagacaacgctatcaagaggggggccaaccacacatgtgcagccactgtatgacgtctggattttccttgacttatggtgatcactattgggaggtggtaagcaaacaggtgacataatttgaatcatggttttaaaagacgccatggttgccatgaggaggacaatgcgtaggaggcaggagtgaaagctaaaggatatgctgggaggtgaccctggagttaaagagagcaactaaggtgaccaggtgacaataatggagatagagaaaacaggatggattcaggaaacatgaccacactgagcatattcaaatgtaattgtcagttttcgtgtctccctcccactggaccacaagcccctaactcttcatgtacacaccctgactcccagtgtgggctggccacccaggaggcacccagtttatgtgtgctgcgtgagtgatgtggaatgactgcccacgtaggaagtggcaggttggagaaaaagcagtcacagctcctggctgctgtggctgctttgagcttcttcctcgatcaggctggatcattaccagcctgtaccctcaaaggatgcccttagtcctgtcccctctcactagcagggattccaagcttgtaaataaagtctcccacttaaaatgtgagcagagtgaagagctggcagtgtcaaaactctgtgtccagatgttttatgattttcccttttccagatgagcccggtgtatccgtatcagtgtgtctaggaagaccaagcatgccgaacggccagcagagtagaaactctgtgtgcccatccattatgtactccctgaattaggctccttgaggctcaattattaaagtgggatttttcttaattattaacagttaaaaataggaaaatagatttcaaggggaaaaaatttgcaggcaacaagagtccaattctaaatgtgtgcatgtgcgtaaaacggaatttgccaaacatgaataggcacttacaatgtgactggaattggctctgtcatgtgtcagcctaatagcctaaaccctggttcaatacaatgaacttgggaaggtttgcttaatgaaagaactgacgttttctgtgcagcggctgcattcatcagcctgcatcctgttcattacactacaaagggctgccaatgggaattggtaggatcatctattaggtaaatgcgatggggacaaaagatagcagagcccggggctttgtggaattttctgtggtggtccgggttcctggagtagggagctgtgatgacgggcaacagatttccaagttggcacgcgggcttctggagtcacgggctgaattccggcactgccacatcttgccacgcacatcctaagggagtgtagagaagagagttttcagttatgcatgacactgccttacccattgtggattcagtagggatattcataactgtgaatttgaatataactattaaataattgaattattattattgagttactgaatataactattgagttttccctctccatctgggcacatgggaaggccgtactttcctgacatgtgatttgctgtggcgagtggaatctgggggcaagagacgtgtgtctccttgaggcagaaactttaacagattccagcctgctgcatcataatctcctttccctctaccacgctgactggcagtattccagattccgattgccctgtcagggtgggtcctagtggtaggacaaaagcaagaatcctgagctgacccaagacacacatggaaacattaattgtgcttctctgatgtggctttaagatacttgctctgtcgcccaggctgtagtgtagtgattccatctcagctcactgcaacctccacctcctgggttcgagtgattctcctacctcagactctcaagtagctgggattacaggcatgcaccaccatgcccggctaatttttgtatttttagtagagatggagtttcaccatgttggccaggctggtcttgaactcctgacttcaagtgatctgcccaccttggcctcccaaagctctgggattacagacgtgagccgctgcgcctggccaagatactgagatgtgggggccaggcacagtggctcatgcctgtaatcccaacactctgggaggctaaggctggaggattgcttgaagccaggagtttgagaatagcctggttaacatagtgagagccccatgtttctaaaaatttaaaaaaattagccgagtgtggtggtgtgccacagtagtcccagctactcaggaggctaaggcagggggattgttggagcccgggaggtcaaggctgtatagtaaactgtgatcctgccactgcactctagcctgggtgacagagcaagacactgtctctttaaaaataaataaataaattaaaaagacactgagatttgggggttacttgtaactgtgtcataacctggctccttactgccatcggcatgcctagagggatcccagttttacacatcagaacaacccaagccccagtgtgtcacgccattacatgcttacagcctatttttacaaagtttgaatattgtaatttgcctttaaaaaattgttttaaagatctgcctaggtcagcaaattttatttactctctagaaccatttgattggggtactgccttaagaaataaagcagattccttcagtcgcatgtgggcctggagtcactggaaaatgcagacaaaacaagatctgctgattggcaaggtcatcttgggaagggccatcgtgcagtaaagagcaggtccattaattcaggggggatttacatcagttccatctgcctctttcctaatgggactgtttggttgtgttctttcctggagagattagtgattgaaaggaggagatctagaaagaagagataaaagtttacatttaattttcatgccatgcagcgttctacgaaggcttcctaaggaggctccatactaaattcagacataagtcagaaggcagcttctcccaagacactgttgatgtccagggggtgacagttccatcacaaaagggggttaaaagggtttaggggaagtttagttgtcttccttttatctctaactctaaaacccaactgctggctgaattaaaagtctcttacataatggtcagaggagttttgagtatcggatctttgtgtacttgctttttaaattcagtcacgtcttaaatagtacttttcactctcctcctctccacaccactttatgtgtttgctagtagcttccatgaaactctatgggtgaacatgtctgcaactctttggcatttaaattttaggtttctgcccctcgtagcagactatctttctagaagcagagctgtaagtctcttttaacaccattttcaagcttggacaggctgacatttttattgaatgggttatctcaatatatatctacttttttgcatcctactttttttagaaaattaaaaatgatatgatgggtgtggtggctcacgcctgtattcccaacactttgggaggccgaggcgggtggatcacaaggtcaggagttcaagaccatcctggttaacacggtgaaaccctgtctctactaaaaagtacaaaaaattagccaggcgtggtggcaggcacctgtagtcccagctactcgggagactgaggcaggagaatggcatgaacctgggaggcagaggtagcagtgagccaagatcgtgccactgcatcccagcctgggcgacagagtgagactccgtctcaaaaaaaaaaaaaaaaaaaaaaagataatgatgaaaataatagaatattgatgagaacacccattactctgctcattgttcaaatgaactcatttgagagctctctcctttgtttctgtctttctctcgcatcagcttgcatctgtttgcctatgctataaggcatcagtggttaccaggcagtgttgcattttttccatcccatacctctgtgtgtgttccttatctgtttctaggatgtgccctctgccccgtcacatcacactctgtgctgctctcagccaaagctcttcttaaatacactagccatcaaaaccatacaacttggctgggtgcggtggctcacacctgtaatcttagcattttgagaggccgaggcgggtggatcacttgaggtcaggaattcaagaccagcctggccaccatggtgaagccccgtctctactaaaaatacaaaaaattagccagctgtggtggcacatgcctgtaatcccagctactcgggaggctgggacagaagaaccactggaacctgggaagcggaggttgcagtcagccgagatctatgccattgcactccagcctgtgtgacagagcaagactttgtctcaaacaaacaaacaaaaaacatacaacttaactctcatacccccacgcctgtcttttctcctgttcgacttgactcctcttgggaattccgtaagtactttgagggcaaggaccacaagataaatgtcgtaaggtaaccaggaatgacattccaagattccattctttcctttgtatatccactcatcattcattatattcttactctgggctaggccctgggaacagttgagtaagaacaagcaggaacaaacaattagaacatttagtgtggcaaggggcgtgacaaagttaccaagagaggtaggtgagagacaggagttgttatctgcggggaacaggtgaaggagtgacagcagggggtgaggataagaaggaggaagctttacccctgagaagagcaggcatcagatgggctttggaatctacatgggtgtttgtaggtagaccaccctggaagttgagtgatggggaataaaaggaagaaagtgcattctgaacagagggaatagcaggtacagcagctcagacatgggcaccttcagagcgtgtctgagtcttcctgatgagacacgtggtgttcacttgataactccctggcaggttctcttcatcgggcctccacatagggtatgcgaacctcttcatgtttttaaaagggagagatttaataaaggcaatttggtacttaaaaattgttagaagagctaaaagagtagttttgaggttgaccttcagaacggcttcctgaataatacagaagtgaccctccaggaaggcccttccactgaagctacaactggagctaagcagatggataagccaaaaccacctccgttgctgtggccccatctccaccacaaggaagctggagaagggaccccagaaccggaagacaaaaaacttccttcacacactcccttgctaagaggagaagccccaaagaagctggatatggcccttccctcacatttgctgtcccaagtgtcccatggcagtgcctaagcaattggtgggatggatttgtgtctataaacaaagttgcaagggagtctggaaagggagttttaactccaacttcttcaactagaatggtaggatccaggggcagcattgctccccaggggatgtttttacaatgtctgggatattttttagttgtcagaactggaagcaggaagaagtgctactgtcatctaatgggtcaaggccagtgatggtgctgactatcctacaatccataggacagtacctaccacaaagagttacctacccccaaaatgtcaacgtgcccaggttgagaaacgtgacctagctggaaggtgaacaggaactaaatgagtcagtttcagatatccaacacaaatacgtcacttgtttctgttccaaaagtattataatttttgtttgagctaaaaactagttacagttcattggataattgcctttcatcccttcaatatgtgttcccttgaaatttgcatccatgcatcccacatggcacccctattgattatttcagtgactcagaagacttcattattcaaaataatctctaataagatgtttagggagaaggaaaaataaagtttctctccacgttacgtttttttcttgcacatgtactgctttttcataagcacaatcttattaatagaacaagtcctctcaaaatggttgccttttctcccttcatcctcccccaccagtaatgtagagctgttatttggctcgtttttctttttcctccagaggcaggaagagggaatgaatggtggccaagaattttaaattcctgttcccggccgcccccggaagctccatctttgttgtgagggcttctctgcgtcagtagaggccagctgagctcttattcaccccttattctctggttccctttcaccagcaggtccagctctaaccacagctggagtttaggaaggccaggcagcgtgtgttgaatgccagccactcttctacccagggtcatatccttggatgtttttctgtgcatctgtcttttccgaccctcccgtgattctggaaggaaacacctttccaagctccccagtgaccctggttcatcccggaaatatgcaggaaaagcattatgagcattgcagtgccacatgctgcattggtgtgttacgttatgagaactattagggctgatctctgagaaacttaccagtggtgtgtgatcggaaatcatgtcaccctctgaatgtgggttatgggataaatggctaggtacacaggcttcagagtccagccagccccaggtttggattacagatggttgctgtactagatgaataatgtccccccaaattcgtgtctatctggaacctcagaatgtgacctcatttggaaataaggcctttttaattaaaaaaaaatttttatttaaaaaacagagatagagtcttgccatcttgcccaggctagtctcaaactgttgggctgaagcagttctcctgctttgacctcctaaagtgctgggattacagacatgagccactccacctacccagaaataaggtctttatagatgtaactgaaataaagatagagatgtgaatgtgatcgtactggtttagggtgggccctacatccaataagaatgtccttagcagagacagaacagagacaccgagagaggaaggtgatgccaagacagaagtaaagattggagtggtgccatctaccagccaaggaatgccaaggctgtggctacaccagaagctggaacagagcctgcaagcatttctcctgcagaacccccagaagggactcagcctgcagacactcagatttcaaacctctggcttcctgaactgtgaaagaataaattgctgttgggccaggtacagtggctcatgcctgtaatcccagcactttgggaggctgaggcaggtggatcacttcaacccaggagttcgagaccagcctgggcaacaaggcgagaccccgtctctacaaaaaataccaaaaaatgagccgggtgtggtggggcatgcctgtagtcccagctacttgggaggctgggatggaagcatcatttgagcctgggaggtggaggttgccgtcagctgagattgtgccactgcactccggcctgggtgatagcatgagactgtgtctcaaaaattaaaaaataaaacataaataaatttctattgttttaagacaatttgcctgtggccctaggaaaccagtatagataacttgtgatggtttagcttatttagtacaacaaccctgccccttctagtttttatgataacctcattaattgccggtactctcagagccctgattttcttacctataaagtagagattccctatctcatttggaggtgattttaaggcacaaatgagacagtgtatgtaaagcatttggcatagtgcctgattcagagtaagtgaccaataaatagctacccttactatttagaatgctattatttagaacataagtatatttaagaaagcaccatcagtattcaatttgccttgctaataaaaagggatcaagatatggattgtaaagtagaaaaatacatgtcaattaaatggatttacatcttaaaaagtggtgaggtagacacacaggcactactcacttcattccttctcatctcaacccgttaggatttggccttcaactgggtagtggaaaaaatatgatccttggcagtctactacgcaaaagcaggaacatcatctgcttttgggtagttaagagttaagtatcactttgagctacaggatcatgattaaaaagcattctgttatcttacttcacaactctccacttttgtaaaagtttaggataccggcagggcagcaaatacctttaaatgattttatttaaatgtcagatttaattaaatccatgaccagaagacaaacccaaaggaaattttcagggagctttagaattttccttttccatgttcaaggtgataaccgtagcataaaactgtcccaaccacatgcaaatgcaagcaggggcattcatcatgaaaatacagctctcaaggcggaagtgcttgttaactttgcactctatagccaagtgcgatgatcagaaaatacatacattgaagacaccagaaaatagtgtatggattggtgattttgactaagactggaatgtgggtgtgtgcactcctcatgttccggtttctgtgatcattcaggcatgcacaggtatcctgatgggtagccaggtcattaggcccagagtcggcagtgtagcatggcaagagaagtcattgcatctccaaactgtgcctaaattgcctgtaatgggttctttgcaacttgcagaaccagatcttaccatttgcaaggagaatagctgaaaagatacttaaataaaagtgatcggatgaaattttaaaaacgggaatgaccaaaaagattcccagaggaccgttactggtctgcagccccccattttagggtctggcatttgtactgattatggcctgacagctcttgagtttccaatgataacagccatctgacttgatcggagttctatggattttcactaaaatagaatcatcgccttggtgatggatagaaaaagtaaagcaatacatcctgataaatgctgtgccttcctccttcgtctctctggcggtgaccttgtgcaatccataagagggcaaggctgagagccccggccaccgccgccgtgtgtcagaacttggaaatttaagtagctttgaaacccgtcaatggggtgaagggggaatggcctgagaaagcaatggatcatgcttagagggctcagagggaaatagggtacgctgaaggtcaacgtgcagacatgtcctgaaggaacagctcaagtcctcattctcattcacgggaggctgcggccctgtgaggtgagatcagtagaagagtacaataaaacaggaattttcagagcatgtaatttcttcttggaagtgaaaggcactggagaatggtgcagaataagcactagccttagagagaggatgccctgccccagtctctttctctgagtagcagagagctggctgtgctaggaaactcttcgcctctctaacaccacgtttattctccagcccagttatcttagccaactgtgaacattttgaacactgttgatcatcggtaatgacaccagcaccataacacgaaacccctctaaaacagggcttccaggaaactcacagactagttacatccccaagccttgcatacttgattggaaagagaagcttctggatggttgaaggggaaaggagttagacgttggcaggcacccattagtgttggttacgacttgctaaaagaaaatattaagataaaaattagatcataaatttggagccaccattacgaagcctaaagtgcaaattgccaaacaagtcaagagactcattagcattttatgtaaatcagttattactgttctccacttccttaattatccatgttatttcaatacaaccctttctttgatgtcccaattctatatttaaatagtgcaagatttctatcgtatcctcccgcagaggtttgtgccatgcaaaaaacatgccaagagcagctattttagagactacagggaaatgtttaattggttcatcccatttgagttatgagggtgtattactgagcacataaaatcagaaacatggaaagtactagcttggagaagtttactaaaacctgcaagagaccgcttgaaattttgcccccaagactttttggattctcgatgggaaccgactcaaagagaaatttcgcaaacttcatggaattttgctaagtgattgatttataattgaaatatttggaaataaaatccaacagctctctttcctttggctcagagacttattgttttggttggatgaagagaacacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtcctgcctcagcctcctgagtagctggaactacaggcgtccgccaccatgcccagctaatttttgtatttttagtagagatggggtttcaccatgttagccaggctggtctcaaactcctgacgtcaggtgatccaccctcctcagcctcccaaagtgctgagattacaggcttgagccacagcacccagccagaacttcatagtttactcttattattttctcctaaccactaggttccacacttctggccacctgcctttatctcctgccccataacctaacctgttttaaaatacttattaaacaaagaaaaataaacaagaacaaatggagaatctttcactatgactgcaactgaaaagaggagtaatggaaggacatgtactcttcccatatatttttaaacaattactgtatctgatttttcatttttcattttttttttttctggaagaaagagcagatctggataaagtcagtatacaatgtggtctttggtgacagacccaagttcaagaccaaggtgtatgcatgggtttgttcaagttgtctacccttattatcccctcagtgaaacatgattaaccatgcttaccttgaagagttatcttaaatatttgtgttaatattatatatgtacattacatggtaagtgctaagtaaatggtacatgtgagtctttgctctaggcaaggcgctgtgctgaatgtttacatagatgatcggatcctcatattggatcctcaaaacgttcatcaaaatgggtaggattatttttatgtatatttaacaggtaaggaaaatggggtttctggaggtgagtgactcactcaagatcacgtggaatcaagcagagaagctggggttttaattcagaagttctttaagctacagctgtaattgagacaagaaccgtacactgtagtaagattaatgtaaagatttaaaaaactgttcatatcgttcatctacataaataaataatatttacagaaactcatctctgcagactaaagtactttaaatatttaatctaatttattggttatttatttaacaaatacttttatgggccttgccatgttccaggcacggttgtaagcacttacaactagtgactcatttaaccatttcacaaatatttattttgagagcaagcacgggggtttatgtgatggctccacagagcagtgaaaagactcccgccctactgctcgcaacctcagatgtccctgggcactagcccatctgtatgtctttaaaaaaaataaattaaatttttaaaaacatgactttctggccaggcgcagtggctcatgcctataaccctgcacttagagagggcaagacagaaggattgcttgaggccaggagtttgagaccagcctgggcaacatagcgagaccttgtctgtactaaaaaattattaaaagaaaatatatatatttttttaaatcatgacttttctgatcatacctgtggcatactcattatagaaaatttggaaaatgtaagaagtcataaagaagtgggaaaaaatttaaatccttctctgtcccaccacaaaccatttaaatcaatccaagattttagtggaaagggaaagcatatgatctagtacaaagaattttttttagcttcttctccgctgcttgtttaagaatctcagagtaatccagacgttactactccataagcaaatctgggacagtaatcagacaaccagacaaccagactgagagcccccaagggttcaaattcctgagcgccgtgtcttctctatagcttgctgtcttgttctatttggatataaagctaccatcaagcagaagaagcgggatgctctctacagagtccgaaacaaaacacagaaaattaacctgctaccatcctctaaagaagcgagggtctcagactttgtccccttttgttcctgcattgccctccattcagatcttgtcacttaggccttggtagcatgagctattaacagccctccatatttactatttttttttttttttttaactctgggagttcctgttgcagaaattggatcacttacctaaaaagctccccacccccacctttggtgactggtgggtttcatcaccaggaaagcacattgttccaactcaaagtctacagtctaaaatcatcatcatgtattttcatcaggatgaaatatcgggcactctgctcagtgcaaggttttattaatgatgtgctgtcaggggctggatgttctgcatatttgcatattaaacagctgagtgaagaaacattgcttttattgctgcagggaataaatcagtttaaagcaagttctcatcatttatactcgtttcagctaagtcttcttttattgaaataaattgttgaagtgctttgctcattctttgaatactgatgaactttaccttgataggacctcaggaaaaataatattttcttaaaggtgcagtattgttccatttttgagtattactttaatacattattgataagttaatttagaagtatcaagtgaaaggggaagaaaaacagttttgaataaaaacggtgtttcctctggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtcccctgggcaggtgcatgagggggtcccaggcaatcaggctcttctcaaacctgaattatacccggcctcagggtataggggtcaggcagctgtttgacaggattcttgcaaatgtttttggtttctctgtctactcattacgtacactctgccagaggttgaaaactcaatgttgagattacatacatcctgaaaacactgtttaaataaaattttggcctgcatcctgtttttgaaaacttgcaatggcttgccaacgttttcaagttgagaagtttcacaaaaaaaattcggatttccagcttctttcaaaaacacaggtcaaacatcctgagcctgttctgtggtcagttactcattagcagcctctgctctaggaggaatagttatgggtcctttcagacatgcaacccccaaaactccatgttgtttacagtgtgggacacctgactttcaccttttatgatacctgcctggggcatgcatgtggtgactttttccatctctggtctctatcttatctcttgtgatgaactcaggtctataaagcatttgggcactgcctggcacataggatatgtccagaaaacactagctggtattaaaacagaggaaacatgggaactgagggtggtcagtgacatcacattgtatttcctttatggtgtccttctgagtacagaaccaaacatttcttaggcgtacaatttcctgcctccaaattaatgttatttctaaaaagtagcccgttccactcctacaaatctttgcccaaatatgtccttttcagggatgacatccttagccactgtttaaaatagcaaatttctttccaaactctgccgtccctgaatctctaccctgctttatttttctccttagcagacatcatttctctgtttaatctgtctacttgctaattgtctcactgccctccccctccccactggagagtgaatgaaggcttaaggttttgtctgccttggtctctcctgggtcctgagtaccagtggccttacgtggcatttggtagattacatgcttaatgaaaagtgagtgaatgggctgggtgtggtgggtcacacctgtaatcctggctactcaggaggctgagacaggaggatcgcttgagcccaggaggtcaaggctgcagtagggtatgagcgggccactgcacttcagcctgggcaacagagcgagaccttctgtctaaaaatatttatctatattgagtgaataaatgaatgaatggattattttagtttggcctcaatctttatagaaactcaattcaacaaacatttgagcacctgtttgttcagggccacgtgctggttgcaacctggaaggaaaagctgggcaaggcggagatccagtgctcaggaagctgagtccatgccaagatgtgataattgtataaagaactacaataggcataggtacagatctgtaaaatatgaaaacaggaaaacacatggagtcttggagggtagggaagtcttgatgagtaagattgggtctgagataaacctaaaagagggtcaagattttgacggagggctggaagggaggaacgataggaaactgaccttttttcagatctcttcttgtgcgtggcctggggttaagtgctttacatgcatcccctcattgacttctcagagcagctccataaagagtccctgtgcttcccagtttactctggagacgactgaggctcacagaggttaagccacctacccaggctggcaccgcacactttgttcagagtgggcctggcatacggcatcagttcagcctggccctagacccttttcctcccacaaccatattgcccccagtggagagacaggaaagcagggaagggggcaattgccaagcctgtttctagaatctcaaggatgccatttggtgaagctgaggctggtgcagttactctgtggagacaccagcgtcttggacctagggatggattcagggaggattgtgtcccccagtgacctgctttgtgaaaggtagagaatagattacaggtgcccgagatcctagaacccgtttcttaccatgatggcgttgaggtagaggtagaaagatgggtgaggtggctgggtgcagtgggttgcgcctgtaatcccagcactttgggaggccaaggcgggtggatcacctgaggtcaggagttcgagaccagcttggccatcacagtaaaaccctgtctctgctaaaaatacaaaaattagccaggcatggtggtgtgggcctgtaatcccagctacttgtgaggctgaggcaggagagtcacttgatcccggggggcagaggttgcagtgagccaaaattgcaccactgcactccagcctgggtgacagagtgagactccatctcaaaacataagtaaataaataaaaaataaatataatacagacacaggcttttctccccacctcttttaattcttgaaaggaacagtaacaagctcctattcctgtttccttgccaggagaagtattgttttcatataaatcatttgtgacagaagctccttatttttaagtggaaaatgcacatttaataacatgagaataatgtccaaacatcttctcattgatggctgccaagagaacagcagcactcttgctgcctgcagaaagagacactcagagtcaactgttttaggggccatgctgtcattgctgccgcatttgcttaggtgggctctgagcagcagcttcccagacactccgtaaccaatggcagctgagtgcttttgtgccttgcaaatcctctagtcagagcagacctggcttaggaccccagccctaccactaactgactccatgcgctcctatcggttctttattttacctctgcaagcctcagttttctcatctgtaaagtagggataacattagcttcagccctcacaggcttagagtgaagtttaaataagaaaaggtatctaggctgggcgtggcggctcacgcctgtaatcccagcactgagggaggctgaggctggtggatagcttgagcccaggagttcgagaccagcctgagcagcataacgagacccgtctctgcagaaaatacaaaaattagccaggtgtggtggcatgcatctgcagtcctggctactcagaaggctgaggtgggaggattgcgtgagcccaggagttcaagaccagcctgaacgacgtaaaaagacctatctctacaaaaattagctgggcatggtgtcacgtgcctgtagtcctagctactcgggaggctgaggtgggaggatcgcttgagccccgggaggtagaggcatgatcatgccacttcactgcggcctgagctacagggactctgtctcaaaggaaagaaaacaaacaaacaaaaagccatgtagagctgggctatccaatacttgaaggtagccagtggacacgtggggccatttcaagctaaattaaattttaaataaaattaaagattcaatctctcactcacacattacaagtgctaaacatccggacacatctagtggctcccactgtgggtagcacatacagaaagaacgtttccgtgacagtagagtgtcccattgcacagtttgggtatggagcacttagcccagtgttgggcacagtacctgctgtgatggttaaagcttagttttattggccaggcatggtggctcatgcctgtaatcctagcactttgggaggatgaagtgggaggaaagtttgagcctaggagtttgagaccagcctgggtaacatagtgagaccctctgtctacaaaaaactaaaaaaatttaggccatacttagtggctcacgcctgtaatcccagcactttgggaggccgaggtgggcgcattgcctgaggtcgagagttcgagaccaccctggctaacatggtgaaaccccatctgtaataaaaatgcaaaagatagttgagcgtggtggcgcatgcctgtagtcccagctactttggaggctgaggcaggagaatcacttgaacccgagaggcggagattgcattgagccgagatcatgccacagcctgggcaacagagcaagactgtctcataaataaataaataaataagctggacgtggtggcatgtgcctatggtcccagctacttgggaggctgaggtgggaggatggcttgagcccagaggtagaggctgcagtgagctatgatcttgccactatacatcagtctgggtgacagagcgagactctgtctcaaaaaaccaaaacaaaggtcaattttttttccacattcatctataaaacaataaaggaaacatcctagacacttgaatcagagcccttttaattatgacttcaaaaaacagggctcgtgccacccaagatttcctccatatacaaaaaaaaaaaaaggaaaaagggaagaagcaaaggggcaatacagggctctgcccattagaatctctagggacagaccgaggtttgagagttcctgctcctgatctcaggggaatcctgaattacaggtgttaacctgattatccccagcccagctcttcgttaattacctgaagtgaatgggacagtttccaatactcagcacaaaggcgtgcgcagtgactctgtggcgtactatctatttggccttggaaagttactctctaagtcagggcttcttttcttcaactttggtgtgagactccgctggagagctggttagaaaaacacaagtctcgggccccaccccgcagagcccctcattctctagttctgggttggggcccaggagtctgcttttctagcaagcgcccagatgtcactgatgcttacagctctcagaccacagttggagcagtgatttttaaaagtcttttcatttgtaaagagttgttctccatgctccaaatgactgtgacgactgagaaaatgcatgtatgtaaagtctgcagctggtgacattgtagacactcagcaaatggcctttggtgttactgttattttatttttactaattattttttacacctacaaatcaggatctgctacaatcgcttgatatttgaaaattgggcctaacccactatgccactcttctgtcatgaaataacaatcttctatttaaactagtaaacttaatagtttaaaatacttggtagtttaatagtttaagtagagccactgaaagatggctcacacctttcagctcagtttttttgtaccagtgaggatgaatgtttctgcatgtgggtagttggcaccagtcttcaatgaattatttttcctttagccgggtctggtggtggcgtgtacctgtaatcccagctacacagaaggctgaggcaggaggataccacgagcccaggagttggaggctgcaacgacttacgatcatgccatggcactccagcctgggtgatagagcgagaccctgtctctgaagatacaagaaggccacatgtggtggttcacccctgtaatcccagcagtctgtgagactgaggcagaaggattgcttgagaagtttgagattggcctgggaaatatagcaagatcccaaccctattaaaaaattaaaaatgaaaataaaattttaaagaaaggtatttctccccttcacggtaatttggagccagtacttcttgcaccattcatttgtccacagcatgggacaaaggataatgccttaatgcctgctgcaaatagaacagtggtgcttagcagctttagataatgcattgtaggtgttttgcaaaaacatactttcgtgactaaacatcataagctccaagtgagtgatttccccgcgtaaatgaatgattctgtgaggataacacttctaagatgtgagatttcaataaatgaatctgtaggctgctgtgatggatacctttggtggggtaggaaggatcgtcatttagaacctgggttctgactccagatgacttgttttgttctatcccagaaatattcctaaaatcgatttccagtttccaaaagagcaggtaaggaaaacactgagtgttacttggtctttaaaattttttttaaattcatttttatttttaaaaaatagagacaaggaggtgggcgcggtggctcacacttgtaatcttagcactttgggaggctgaggtgggtggattgcctgagctcaggagggcgggtggattgcctgagctcaggagttggagaccagcctgggcaacaaggcgaaaccccatctctactaaaaacattaaaaaaaaatttaggcgtggtggtgtgtgcctgtaatcccagctactctggaggctgaggcactagtatcacttgaaccggggaggtggaggttgcagtgagccgaggttgtgccactgcactccagcctggctgacagagggagactctatctcaaaaaaaaataataaaaataataaaaaaaaaattacatgaaaaatagagacaaagtctcgctttgttgcctaggctggtcttgaactcctgggttcacgtgatcctcctgcctcggcttcccaaagtgctgggattacaggcacgagctgccacgcctcacctcttgttttcaataccattgataagttgtggtcttcagggacttgtgggcattttcaagttaaatatccaacagtcgtgatttagggcatgaagagctcactcatcaagatgtatgtaattcagattttctgagtgtttaattcggcgtctttggtcacaaggaacagagttttacttgtgccacctcttctaagaaaaaggtttactgtaagagataatgttggcaagctgaggaaaggaggcagttttgggtaactgtctcttgcgatcccctcctgcacaactgtggcgttctctttttctgactagctgattctgctgctgctggatttattcattcttctccctcacagttttggctcgcacatgcttcctttttagctcatggccgtgcagttcaactcaacctcatggcatctttttatcagctgtccctgctgcaacaggcttagagttggtttcccaattccctagcgcagaaatccactggcatgagtcatctttcccattggtagattgcagagcaaacttctggacagatttgcccttggctcatgtatgattggacctgcggtctgtccaggtgtactcagagtggggaaggggagcggtggcaggtaatacaaaacccacctaagtagaaggacctatgaaccatgagggttttccttagcagggagtgccagtgggtagggatgactggttttgcagtttagggccaagtgagttggaatgacagctgtggcgtgttgagtcagatcaagtccagaattcctctccaccccacccatttgcagttccctcagatttattacgggacctggatgtgatgcaagcatgcccgctggctcaggctgtgcctcacagctgcaacatccctggggtggagaagccatgtgggacctcacagaacactccaccgtccctgctaatggctgagaaaggactctgccctcatggatggggttgggggacctgttatcttcttccaggttaatcttggtttcagctgctttaaactctactttttagtgggacgcatcatactgaactatggaagcaccatagttgtcacctagttgagcttctctttgttcccatatgtttcagtgaagcagttatagcttcagaaaagagggagccaggaaatacacttgtaattcatcactccttttatagtcagagcataggaacactcatagtatgtatcagaaactagtgaacacatgttgttttacagctctgtctgcaaaattgcatcgtgggcctctttggggagtgttctcaatgtgatttttattctggggtgtcctttggccacaatcctcaggattattttttctctgtgctgttcactgtaacatcgtccaccctctgagatcttgcttttcagtctactggtatctccacttctctctgcagcgtgatgtctagtcagagtttccattctgtttttatgaccctgggaggactgggagagatctgtgaggtcatcttgtccaccctcagccagggcaggagtattccctaatggtagagtcaagtgtttggtttggtcttgtttctaatgactcaagtgatgaggcctggggacgtcccttgggaagctattctgcagcctaataactttcattctgtgatttttttttgtatgtgtctaatattcagagtctgacacaataaggccataaagagctaagtctgtctatggtagatcttcacctgggaatgttctcctaatagtcacttttgttataaatcttcacctagcatgggagttaagtgcattttaaaactagacctggggactatgtatcctaaaatgcaaaaatagcccccaaaatgaaaattaatgttgagaatctagtcaatctgccagcagtacgtacataactgttctgtgtatatttcacatggccatatatgttttgcttgtgtggtgctaaatgcaaaggcagagaagcttctgctattgaatgcttagcacagaactcctgtcctccctctttgaaattattccgacagttgcccctcatttggcttgccaaggagtaagatcttggcttgtgtgtttctcccatgtgtggtgtatctgtaatctcggtcactgttgagagcctggtgggaggctgattattgttgagggaaagatctgagagcagggccaagaaagggaaagagagagagaggaaaaaaaacaaaaaagaaaaagaaaaaagagaggtgggtagggagggaggagagacatggacccacggggaatgggaagagaaatagaaatagggaatttgaaatggaaataaaacaaaagggcaggaaaggaagaaataaagagaatgagataaaaggaaaagaaagtgcaagtagatttgggatctatagattggggaaagacattcatacagtcaggaccagatgttcactggaagttttttccttctggatccttctttggctataggaatctggttctcaaagtgtggctcccaggccagcaacaccagcatcactcagaaatctgttagaaggccaggcgcggtggctcaggcctgtaatcccaggactttgggaggccgaggcgggcggatcacgaggtcaggagatccagaccatcctggctaagtcggtgaaaccccgcctctactaaaaatacaaaaaattagccaggcgtggtggcgggcgcctgtagtcccagctagtcgggaggccgaggcaggagaatggtgtcaacccgggaggtggagtttgcagttagcagagatggtgccactgtactccagcctgggggacagagcgagactccctgtcaaaaaaaaaaaagaaatctgttagaaatgcatattttctgttttcaccccagaaatcctgaataagaaacactaaaggggagtgggcccagctatttgtgtttttggaggaactcctgttttaatttgttttttcggaagtcctccagtttgagaaccaatgataaggacatttttccgggaatccagttgttttaggaaaggcccagtaggcatttatgtttataagcaactccaccctgcactccatatgccttctgtagctatctaacagagacagagttgacttgcagaaactgttttctctggccaggagacaggcttcgttttcgaaactcacccaggaaggcagtgttcttcttttcaaaaggcatttttctgttgactgtgcatgaagccacatagtaataaacagtttccatatccaagcagctaaggcttgtgccttgcaagttaagtggaacatcacgatctatatctcagttttccttatgtttccccagttggcacatcatggccaacaagagagtagggatcattaaggagtttattttcatctttattttatcatttaaaacacatttttttttccaatgagagtactgatgacataaaaggttatacattgaataaccacccaaattagcagtgtttcatatttacactgttcaacacagttctcttgtctctgttcatgatataacagtaaatccaagttgctttaagtagatattggaaatatgaacccaatatgttcttaacatctccatgtcgtaattctaatttaaaatcaaaatctcatcaaattacattttagattaaagcattgtacctatcgaaagaagagaatcgaaaatgcgaaagtccttcattttcagtgtggcctgagattgttgaaggatttgttctattgcatgctgataaatatttatcacggttaagtgaacaatcatttggagacagacaccattttatgatgcagcttctcagggcgtcctaattgtgactctgccttgccattctatgttttatcggaatacgcagacatatactttatgaggttgggtaatgaagagagagagaccccaataaacatattttctaagagtaatggttatctatagctcaggaacccttggttagcacagcctctattacacagtactaggcaagcagttcatagctcaattagatctaacttgcttcatttttaggcattatgttattctaaattaacactgtatttcatattctccaggtctgactattaaccagattttggaacctttagggcttattatttagtaatccctgaagctctcaagtaggcgtttttaaattcatgcattagaacagattaaaaattagctagaaacgcatgttaaatggcccactccctttcttttgctaattgtgctagaaatgaaaaagaaaatgcaagtgaggtcagatctagtgtggtacaaatgaacttgctacttggtttgctgccaattgctgccgaaacaggagttatttaaattagtaaataatttttgaaatcttcttagaatgtcacaggccacaattcaaattcacagaccaggaatggttattatttctatatatcttaaagttttctgcaatagaaatgcatttcaaatataagctagaaaaaaaaaatgtgaggccttattgtgtagataaaagtgacaagatgtccaaatgttttgaaacgcagtgatttatttaagttgtagaaagcttggttttatttcttgttgcatcgtctttatccttagatcttaatcagaaataggaaaattttctgagagaaaattcacgagatcattcatgatgagtcactatatcagttactttaaaaaaaaaaaaaaagatcctgacaaatcctactttttcaggtcctgatgcactaagtctcattcacttctttctatttttcctctctctattgcatattaacccaccatattgagagaatagaaacttttgccttcattatatcacctttacaccccaggacaggtgccctcctcagcggagacaactgtccccctccatcctgcaggagttttgcagccatccttccagccactgcttctctaccggggcaaattttcccccaagggataattgataatgtctgaggcatttttaattgtcacaacttggggaaggggcaagggattgagggagagtgctcctggcatctggtgggtaggggttagtgatagggttcggctgtgtccccacccaaatctcatcttgagttgtagttctcataatccccacgtgtcatgggagggacccagtgggaggtgattgaatcatgtgtgcagttacccccatgatgttttcatggtagggagtgagttctcacaagatttgatggttttatacgatgcttttcctcctttgcttggcacctctccttcctgctgccgtttgaagaaagacatgtttgctttcccttccaccatgattgtaagtttcctgagacctccacagccatgccaaattgtgagtcagttaaatctctttgctgtataaattacccaggcttgcatatgtctttattagtggcatgagaacagactaatacagtcagggatgctgcagaacatctccaaacacacaggactcccaccctctacttccaccccaccaacaaagaatgattcagcccaaaatggcagtagtgaccttgttgagaaatgctgttcaagccatacgtcaccattggaaggttgccaaactgtgctttgcacacacatgctgtctgcacgccttgtatttttctctttgcttagtcctgctcatgctctctaaacaccccagacatcatatctctttaagaaactctggctgagtcccataatgttctggggcaacttctgtcttcccttttccctctggcaaagaatccttgaccaaactttagctcagctcctcagagcccacttctcaactagaccttgaccttgctcctctctccttgctggatcttcatagtccagtctttgtaagagtcattctaagtcagtctagagagaatcccttcacccttcatgtctgatcacccttgcctgccttcagcaaaaatcctgctaacttggttaagttggaatactcctacccttgtggttccttgtagtaatttgcatccactgaccctcccactcccctgctactctgttccttgactataaatctccagctgtctttattatatttggagttgagccctatctctctcccctattgcaacagccttgacccctgttgaaataatcctgcataaagtcttccttaccattttaacaaatgtcaaggtaactttgttttttgttttttttgtgtgtttttttggagacagggtctcactctgttgcccaggctgcagtgcagtgatgcaatcttggctcactgcaacctctgcctcgcaggctcaaatgattctcctacctcagcctcctgagtagctgggattacaggtgcccgcccccatgcccagccaatttttgtatttttagtagagatgcggtttcaccatgttgaccaggctggtctcgatctcctgacctcaggtgatccatccattttgggctcccaaagtgctgggattacaggtgtgagccaccgagcccggccaggataactttttaacaaccccccctccacactgccaactttttgaggaccatgtgttgtgtagggccggatatagtgcacatggtgaacacataaataatgtttgttggccaggcgtggtggctcatgcctgtaaccccagcactctggaaggctgagtcagaacgattgcttgagctgaattgttcaagactgccctgggcagcacagtgagaccccgtatctacaaaaaataaacaaacttagccaggtgcggaggcattcacctgtattcctagctactcaggaagctgagatgggaggattgcttgggccctggacgtcaaggctgcagtgggccatgatcgtgacactgtactgcagcctgggcgacagaatgagaccctgtctgaaaattaaaaaaagaagaagaaatgtttattgaatgaagacatgaaagcatttggtggaaatagggcacacacatgaatatattcacagttgcaaactcagaaggatactcccaacctggttctttgtcttgtccctccatctgggtgctttccagtcacagcctggatgcatgtatgaataaacttctaccattaagtccctgaattatttaagcactgccagtgattctatataaaccgttcagtaaaatgaatggcatatgcgtatgtttcaagagctccagcagcctacccaggatggcttgatgttgtctcttagcaccgtatcaatacctgggggttttcaaatattgcaggtggccgaagcctttgtgttgaggtttctgtagtgtttatccatttgtgaaaccaggcctcaatctatatgtccaacgccattcgtagaccccctttgataatctccactaagcagacatactcgatacatcttcactaatgagttctgacttcataaaatgtattaatgacttctttttgaaagtaagagtgctttgaataccagtcgttattgctttagaagttcataaaagcaaaagcacagtatttcccccagtgtttgtgcgataagagaatagatgtaggtccagcgcctagaattttagctatgcttctcttgtttgtgattccaggtttcagactgcctggtagaaggaggtcacttctgattgtcagtgactttggtgagttcttaccttgtaaaagatttacaattatttcattttcaacatagctttatcttatgacaaaggtgacagaaaggaaatctcctaagttggcctacagggtgctttagaaaacatctggctgggcatggtggttcacacctgtaatctccacactttgggaggctgaagtaggctgaagtgggaggatggttagagcctaggagttcgagaccagtctgggcaacaacgtgagatcctgtctctacaaaaaataaaaaaaattatctgggtatagtggtgtgcacctgaagtcccagctaactgggagtctgaggcaaggaaattgtttgagcctaggaggttgagagtgcagtgagccgtgttgctgccactgtactccagcctgggcaacaggacaagaccgtgtctccaaaaggaaaaaaataataaagcactgtctctctctacccttgcagtatccctgtaggagagagttactattagctcccagtttataggtgagtgatatggtttggatgtgtccccacccaaatctcaacttgaattgtatctgccagaattcccacatgttgtgggagggacccagggggaggtaattgaatcatggggcccagcctttcccatgctattctcataatagtgaataagtctcatgagatctgatgggtgtatcaggagtttccgcttttgcttcttcctcattttctcttgccactgccatgtaagaagtgccttttgcctaccaccatgtttctgaggcctccccagccatgtggaactgtaagtccagttaaacctctttttcttcccagtctcaggtatgtctttatcagcagcgtgaaaacggactaatacagtgaggaaatccatgtgttaggaagggagtgtggttgtacttcaacctggaactgtctaactcctaaggttttattaatatctagtccatttctctcaatctaatagtaaatggaagagaagcaacaacttttgttttccaattccttttgaacatttgaaaggttttctgaaaggacttaaagaaaccatagcttccttaccagttcccaaagcttcagtccttaccaaagtgtacattgcctttaaggagatttgtttccatcaatccctcccatttacaaggaattacagaagagtgatgcccccttcaaagtggctcacacctggctgacatctgttcattaagaatgcctgcctttgggttctaagacgtccaaggagctcttatgggtaacacctgtagatttatagacgttcctctctgactgtaagggccatatgcctgaatctctcacccccatgtttataaaacttaacaattgtggaagcaatgaattgaaggactagggtcaccagtggagtcccataaataggttgtttatgatccctgtgaaacaagaagaccctcttaatttcatgcttcttaaactggggtatgagtggccccaggtttccctgttgggggtactgataccagagttcatttgaagtcattggaaaccaaggcatattttcttaaagagacaactgtttttggtgaataggccatgttgtttatagtaaaaacaaacatgaatattctgtaatagaagatatcgtttgcatggtgttttaaagctaaaacttgagttattaaacacccttctctccctggggatgccttttgctatggggttgcatccacggaagagtttgaaagcccaaccatatggacatcatattattcatttttatttgccatccagagcttgccagcaaccttttagatctctttccttggaaggttcagcaagatgcttgtaaatgtatgttgctttgttgcagacaatgtatatttaaaaagcaattatttgcccatctcttgttcaactcagatattgactgcctttctgtatttctggctgggcattgtttatctccacctcatggtttttactatggttctagaggtctagcctacaaagagaatgcttcccgtccccaccactacccacaggaccctctgcatatctcagaggaatttctcagtgttccagttaattttctctctgtttcctttattacttctaagttccattgcaaaaatatgctgcctgctctgtcagccaccctatatgcctatttagtcccagttttccagcttctatttttttccacataatccctaaccatgataatacaaatataatagaaataattatgtttgtttaaaatatacacagaaccaaatagtcatagagtagtatttcaggtggggggccctcctctagggcagtggagacaatgtcacctgtcgggaacatttggcaatgtctggagacattgttggttgtggtgcggtgacataactattggcatcgagtggatggagggcaggtgtgctactaatcgccctctattgcacagggtggcccttaccacagagaactatgcagctctaaacatgcgcagccccaaggctgagaattgttgatctaggggaagatgtgatttcattcttcatgcttgtaaattattatttaagctgtgaataccctctcttttcccactgaagttgtggttgtaagattctcagagttaagcagactcggcaacattacagaaaaaaaatcaagatgtaaaaaggatttagacgtctggacgtggtggctcatacctgtaatcccagcactttaggaggccgaggcaggtggatcggttgaggtcagagttcaagaccagcctggccaacatggtgaaaccctgtttctactaaaaatataaaaattacctaggcgtggtagtgtgtgcatataatcccagctactctgtaggctgaggcaggaggcagaggttgcggtgagctgagatcgcactacttcattccagcctgggcaacagagagaaactgtgtctcaaaaaataaaataaaataaaatggatttagaaatggtacagtcagaggttaggggtcgggtcaaagcgatccccccagagacctgtggaaagtgtggttctgtctacaagctgcgaccatggtctttactgcttctgcaaatacttgacaaaaagggccacactcttagctggacttttcctccctttcctgaaacaatgcccttcccattgtcaaggcagaagcagcctccactgagaagcgtcagacaccacgtcagtcttgctttccattgctttgctccagtatccatttgaaattcagtgcaaacccataaattccactttgcctctggtagcagcctgcatggtgtgtatattgaacactagaaacacagtaaatccagcccatttattcacattaaccagcaaaggcattctgcatgcccatgtaaatactggaaattactgacatggccttctagaccatgaaaagacagaagcatatggcagaattcatatgtgaacagattgctttttctcataagaacgctttattggaatatcaactattacagctttttgaagttactcttcctgctcttgatttaagtcctgaatcaccccactactctttttttttttccgctgcattctgctatgtatctttacatctgcttcctgcactttctaaatggcctacttaaaccttgaggtaggtccttcagtttcccataaattaataacacatctatgaatatttcccagccagtcttagaagccccagtctattccaataccaggattgtaaacacagggaatagatgaagcaagctgcttctttcaaatgctcttccaatatgaagcaaaatattattgatctagactgcctgctactttcatttaccatgttactactcgtgggattacaggcacaaaggtttcataaatttcaaatgaaatatgaacatttgttgtcaaagtactgttaaggtatgaaaaccctgctagtattagttcccttttgttattattctattattattattattattgtgtttacatccacaggcaatcacatattttaggttgtggggagcaaagcagcttccccccactttttctctcactccaatttgaatcctcccatatgtccctccctcattttttaagcaggaaacaatgaatgagtttttgctcctcttgccctatttgccgtgtctcttttctgtgattcgggagcacattgatacccttcttttggagcagagaagcttgtctttcatgatagaagtaggtcatgggggcggttagctgacttcatcagagagtagcatgcagatcccacctgtgaggctatggtctgccaaggagagttcagcgggctggatcagagagagcagagccatgctggcaagtcggagtctttgtggaaagcagccaaggtcacagctggaaataaaactgtgtattccaaatcagaggggcaatgcaggaatggatcaaaggaatgaaggatcaagttgtcagccaagagaaccaagagccagacacagggaacctgtgacaaaaacgaaaaccaataaaaacatatattgagcattgaccaggtgcccaatattttaatgtcccatgggtgtgcatcaggtacgctgtggaaggacagatgtcattccttaaaggggctgcactgaattagaccaggggttctcaaagtggggtccctggaccggcagcatcaccatcacctggaaacttgttagagatgcagatcttgggccccgccccagacctcctgaatgtgaatctctggtggggagggagacgaagtgggagcctgtaggctgcagtctgtgttaagctttctgggtgattctgatacacggtcaagtttgagatgtagcaggagaagcaggaaacataggagagaagccactaggggtgggaatcagaaatacggtgtccctgcctacctaggggctacattcctccgggcaagtctttttaactctctctgcctggcaacttccttaacaaagagtgatactaatacctgccttcctgtctttgccacatcacgggattttctacagctcatattggttacagtgatagcagctgagatttaggctgcacctgagtaccaggcagggtcctaagtgacttcagactctatagacagtccctgacttataatggtttgacttagattttttcacctttgggatgctgagaaaaccatacacatccagtagaaaccgaactttacattttgagtttcgatttttttttttcacctgggctagtaatacgtggtaggatactctctcacaatgctaggccacagcagcgagctgcagctcccagtgatcacaagggcaaagaatcgatattctaccaggcacggtgttgcctgataaccttgcccagctgtaggctaatgtaagtgttcttttttatattttctttaatttttttaaatttccacctgttttggggggggtacaggtggtatttggttacatgagtaagttctttactggtgattggcgagactttggtgcacccatcactcgagcagtatacactgcatccagtttgtactcctttatgcctcacccttttaccactctttccctctcagtccccaaagtccattgtatcattcttatgcctttacatcctcatagcttagctcccacttataagtgaaaacacacagtgcttggttttccattcctgagttacttcacttagaataatggtctccagtcccatccaggttgctgaaaatgccatcagttcattccttttcatggctgagtagtattccattgtatatttataccgtagtttctttatccacttgttggtagatggccatttgggctaatttcacatttttgcaattgtgaattgttgtgctgtaaacatgcgtgtgcaagtatgtctttcatataaggacttcttttcctctgggaagatacccattagtgggattgctggatcaaatggtagttctacttttagttcttcaagaactctccacactgttttccatagtggttgtactagtttacattcccaccagcagtgtagaagtgttccctgctcaccgcattcacgccaatatctattattttttgcatttttggtaatggccattcttgcaggagtaagatggtatcgcaaatgcaacaaaaacaaataggtgggacttaattaaactaatcagcttttgcccagcaaaaggaacagtcagcagagtaaacagacaacccgcagagtgggagaaaatctatacaaatctatacgtctatacaaggactaatatccaggatctacatggaactcaaattagcaagaaaaaagctaacaatcccatcaaaaagtgggctaaggacatgaatagacagttctcaaaagaagatacacaaatgaccaccatacgtgaaaaaatgctcaacatcactaatgatcagggaaaggctaatttaagtgttctgaacacatttaaggtaggctcggctaagctatcatgttgagtaggttaggtgtgttaaatgcattttcatcttatggtattttcaactcggtatagggtttaatcccatcctaagttgaggagcatctgtatctgttttggtcctgacaataccccatgaaggaggtgcaattacccctggcttagggttgagaaaactaagaggtttagtaatgtgcttgaggccatgctacctgtaagcaagaatcactccaggtttttcttgtttcaaaactcctgttaacaactgagttgctatactgttttagtaggtcaagatatactatgtgtttcaaagggcttataaattataaatgctacttaaaatgatgtaaagtggtattattgttgtcatcatgtatatattttcaactctctcattggcatcttgaggtttctcttctatgaaattctttgccctaggatggtcccctttgtcaaagagagacacattctgaacaaggtcagacaacacagatggagtttggattcgggcactggtgacagtgaagactcagatgaggttcttgagtactttcaattaggtttaccactgaccccatcagtgtgcagacgaagggagatgagagatacagatggttaatgggatttttggggtatcttccagcctttgtgagcacagaggtttcgctacattttgaaaattaaaattcatttcattcgcattacagattttaaatcctagctcctttttaagcttttaattccaacttgcatttcttattattctgtttacaaacctgacaaattttagcagtcgttttgaggagatctagaataatgtttcatctcatttttgaatttaggtacagaccttaaaaatattatgctacatttctaatattaatatcttgctttcttatttaggaacttttcctgacaaacttcccaagaatgtaattttgttatatccatatgataaaccttaagtattcttaagccaggtgcagtggaattcccctgtagtcccatctactaaggagactgaggcaggaggattgcttgaggcctggagatcaaggctgcaatgagctatgactatacctgtgactagccactgcactccagctgggcaacatggtgagaccctgtctctaaaaacaaacaaaccttaagttttcttaatgttctgacacttttataaatgtagtatttcaacttatggtcaccattctgtaatgattatcatttgtacatttaaaatagaaactgttaggccaatgtgttattctagaataggacttgacagacttttttttaaataaaatgccagatagtgtttctagctttgcagttcagatggtgtgtgttacaactgttcagctctaactttgtatgaaagtagccataggcaatacacaaatcaatgcaccatctgtgttccagtaaaactttatttataaaaacaggtcacgggccacatttggcccatcagccatagtttcccaacctctgctttggaaggcctaactcagttaaacattacaagttcatgcagcacggtgtgatggctcacgcctgtgatcctagcacttttggaggcttatgtgggtggatcgcttgagctgaggagtttgagactgggcaacatggtgaagccgtgtttctacaaaaaatacaaaaaaaaaaaaaaattagccaggcgtggtagcttgtgactgtactcccagctacttgggaggctgaagtgggaagatatcctgagcccaggaggcagaggttgcagtgagctgagatcgtgccactgtactcccacatgggtgacagagtgagaccctgtctcaagaaaccgaaaaacgaaagaaaaacaagttcatgagataccacatacgtgaatatatgctaacacagcagcattattttttggttaatcaatgattatcaatgcttctgtgattttaaaaaggagagtcagctattccctcttctgcccgctgatatctacagcctctaccagatggtacctcacttaattgaggtttgccttttttcaggctcttctaatgatcttctggccaactctaaatcacctttaaacttcatggaatttatgcattcttgttaatttatatccatgtaatatcagggtatttctctttgtagctgcatcttctaagataatggtttttcatggagactggcattgtcccgtccctatgagggggacatttgggaatggcatttttagtactcacaaggtaactggggcactcttggtcttggggaggggaggtggctggggacgcagagggtcctgcggtgggtggatacttacaacatagaaatgtcctggctcttgatgctggctacaccctcagtaagagatactgtcctagggtcatttttttcaacccacactagttacgtggactgtcttagtcagtccaggctgctataacagaataccgttgactgggtggcttgatttttttttttttctcccagttctggaggctggaagtcagatgtcagggcaccagcatggttggtttctggtgagtgctcttttctgcatttgtggacagctgccttcttgctgtgtcctcacttagtagacagagagagagagagagagagagagagagagagagagagagagagagagaccatctctcttgtgtgtctttcattcatgagaactccacctttgtgaccttattacttctgagaggccctacctccaaacaccatcttattgggtgttctagtttaacatatgcatttggaagagagaggaacatattcagtccatagcatgaaccaaccacgtgcacagaggtgtgccccaatttactgtcagtgcagccttcacaggcaggaaacccaccaggtccaaggaaggggcactcagctgttacctcctgtcataggaccattcctcactgtgccatcatattatacttccatatcgtgtgtcttgtggcattcctgggcctgcagtgagcctgtggccacctcatagtcttgttggccacagcctctagaaccagggattggaggaacagccatcgctagcatggtgcttggcactgagcgggtgcttagtgaatatttattgaatgatttccaactaatggaagaaagctgaatagcacaacacccagaggattgaggtttattgaaaaccaacccaaagggctatggtgaaaatcatctcaaaaggcagagggcaagaaattgatatttattgagggctctcagtgggtgttgtagggggaaggaagtacaatgtcctggagctaggctgcctaggtttgaatccagggtctgccagatgtagatgtgtgatcttgggcacgtttttcaacctctctgtgcttaatcttctcctctttaaaggtgggctagtgatagttacctcacaaggtagctgtgagaatgaaataatgatacataaagcacttataacaggacctggcatgcagtgagtatcagtgggtatttgctgtggttatttagttatctactttacatgtacatgtaaagaactagggatatctgtattaagacagggtcttgttatgtttcctgggctgatctcaaactcctaagcttaagtgatcctcttgccttggcctcccatagtgctggcgtttcaggcttgagtcactgttcctggcctacttaccttctttttgatcttctgaagtcaccccctccatctgacaggaggttgaaggtccgatggccacataggtggcagtgctggaatttgaacccaggccttcctcccttacctctctctacctctatctcttctatctacctgtctctactccctctccctacttttctctttttcccagcctccccccgatatactcaacatatatctccctctccctccacccacctgcctcccccacactccttctttccctctcctctgcagggagagcttggaaaccaagagtctatgagctcgaagggagcatgcaaaggtgccaggcaggccctcaaagctgggaagctgcagtaggggttctttgggacccagttaagcagtgggcccttgctctgagatgcagtctgctgagctgccatctggggacacatcttgagtttctctccatgatggcgcagctctcagcgtaaagcagtctatggagtgagaagggaaaaggccccagtaataaaaggcaaaggaagcctggtgaagtgactcatacctgtaatcccagaacactgggaggccgagatgggaggatcatttgagcccaggagttggagactagcctgggctacataaaattatatatatatatatatatatatatatatatatatataaaataatgcagaagttttatatatatataaagttttatatttatatctataaagttatatatatatatatatatatatttatttattttcaagacatggtggcatgcaactgcagtgtcagctactccggaggccgaggcaggagagtcacttaagactgggagctcgaggcggcagtgagcagtgatgactccactatactccagcctgggtgacagagtgagactttgtctcaaaaataaaatataaaataaaataaaaaggaagaaatagccagtagtgctttcttgtagacagagaagctggtgaaatgatgtaaccaggctgggcatggtagctcacgcctgtaattcccagtactttgtgaggctgaggtgggcagatcccatgaggtcaggagtttgagaccagcctggccaacatgataaaaccccatctctactaaaaatacaaaaattagccaggcacagtggctcatgtctgtaatcccaaatgcttgctcgggaggctgaggcaggagaatcacttgaatctgggaggtggaggttgtagtgagctgagattgcaccactgtacttcagcctgggcaacagagcaagactctgtctcaaaaaaaagaacaaaaaaaaaaaaagaaatgatgtaactggtagggagaaagccaaaggttagaaagagaacatgaattgagaatggaaagatcgcagaggaagcagatttgtctgcacacctcttgcatgtgtatttggagaagctctgtgtgctgcgggtcgagggaaacacataactggaacaactgtccttttccaccattgttaaatcctgctttgctcactgcaggagagggggattatataggagcttctggaaacagatgccttgggagctctcctccttttccagaactcccacacttgctcttgtagatcatcataggataactctccgctccctttcctaagaaaattgatctaaaaagtaattatggaatcttgcagtgcttgttgggatcagagaaggctcctccgatgatgggatgttaggtagagggctgcagggaccttgcttttagtcaggaggcaaatcaagagccaagagagggaggggtggtcgtgagtttttatgatgttccttctcttctccgctccttcctgacaagagtctgtctcttttctctgtgtgtcataactacccacattcaccccggcagcccatctaccttgtttctctcataagtcagcttctctcccatctttcctgtgaaaatttctaacaaaatgggagttaaggccgggcatggtggctcctacttgtcattccagcattttgggaggctgaggtgggaggattgcatgagctcaggagttcaagaccagtgtgggtaacatagagactctgtctctacacatttttttttttaattagctggggatggtggcttgcacctgtagctccagctactcagagggaggctgaagcaggaggatcccttgagtccaggagtttgaggctgtagtgagccctggtctcaccactacacttcatcctgggcaacagagtgagatgctgttttgtttttgtttttttttgtttgtttgtttggttttttttggaaaaagaaagaatcaccataaaaaagatgggtaactcggaaatttcaaatgcttgaatttcttgggttgggaagaatatcccaaaatgtgtttccaactacctcactgattttgacttcacagggagaatattttgatttttatgctctgagttgctggtactgctgtgggcacagaactgggtatgacagaacatttttctgaactatgactctgatcttctcaatctctcagtgggaaagagttttggaacttattatttttaaaaacttggtaaaagatttataccataatatttatcattttaaccatttctcagtgcacaattcagtggcataaaagggcattcctgttgtgcaaccatcacccctatccatctccaagtgaacttgattcttaaatctcccagccatctgtttcaattcactagatgttgttccacccagcacgtcatggtggaaaggggcaggctgtgattttttttttttttaacctccagcagctgtgttccctgtggcaactatgtaacctctctgagcctcaacatctgtctataaaatggaaacagtgcaacctaccttagcatttgatgatctcaacttggatcccatagcgggtatctccaaaatttcctcatcttgactacgttctggtgaaacttaagatgtcagcacatgacctacctcccttcccttctcattcatctgcattttcacaatgcttggttttatcttttatacatataatgcacaatacatgtagtgccaacaagaattatagtttctgtaagtagtgtatgattgcccacggatcttcagtaactcattaggcactgacgggctgacatgagcaacaacgagacttagtatctgttgcagctctccatacagtttacgaaactctaatccataaaagccgtttgaaatttccattaggagatttgcacaagtggttaaaattagtcatgcattcttggtctaaactgcaggaagggtatctttactgtgaaaatgattatgacatgttaaaactgtgtaatagtaagcagacagttttccgagctgctgggtgaattctggaaatgctctattattttctccctgttgactcctttctttcaggcaagacagccagcatgttgacttggaaaacaactgaggctgagcagtttcagagcattgacattacgtggcttcttttgtgggccaccccaactcttttattttttttaattgctgcttcttcctctaaaatacaacttgttttttttttttttaaagaggaggaagccttaaaaaccagcgacagtcttggttttcttaacctgtccgccatttaacatttctagaagtgcaacattgcttctaaggtaagggcaaggaccatgacttttgcatgctgaaaatgagctgcctggtttattgagttagttattcctttttagtgccgcagtgttttcagtgttagagaaaaggctgtgattttctttgatattaaaaagccaaccacttatattttccaaagccatttgcattcagtctgacggccgctaaaaatgtatgtggatttttcatctgagaggttttctctatgcatattgtttacatttatcaaatgttgtcctgcccagtactttatattcattgttgcttccggacctagctgacaacatggtctatatgaaaaacaacacaaaacaacacataagagagtcaaagggacttctttggggagaatataaaaacaagccaaggcgaaagtggctgtaaaaatgcgttgtgttcccaagtggaggctccttctttgttctgtcatcagtttgtcagttgtcaatcaaacctcccttcgcctcacacgtttgctaatgtaagaagtgctggctctgctcttagcctgcagtggtgcagcttaaaaattctgggagggtttcatgcagtaaatacttaaagtaacagaaaaggactggggaaaagctgatgttgtagctgtatgatcacccatgtaaaactgtttatttagttatttatttatttatttgcttttttacttccttttctatgcctttggtgactttgtgtaatgctgtatgtaccatcagagcacatactgcttttgtgcacacatacattgaaaacaaaatgaaaaaacaagaataaaacaaaaaccctattcctattcctacaattctggtactttgccacaaggtggtggtagtgtatcttgagtaaggaatatgacctgctagatataagcatctgtttatttacacactaaggaatgtttgagtgtggaacgtggtttagatgctgtgcgtacagcagtgactcagataggtgtgtattctcaagaagctttcattctaatgacacatactttgtctccagtcagagttatggcaggtttttttttttttttttttttgactaaattcacccatatttgatggcaagtgtgatcacagcatgtttataaaaatcattcttaattaaggcatttccatcttatcaagccccctatttaataaggatatcaaaaaagaaaacagttttcgtgcatatgtgtagctttttagattcactttttccttatttgacccatataaactttgtctgtctgtgtctgtcagtctcacacacatccttcaacacatctcttatttctttccagagccaggctaaagcacccttgccatcttctctctctgctgttaaattagatgccttctccaggaatctctctgggggcatcctgagccttcccgattccatttcagatttctttctgtaatcaagagctccatctctgttgctttcctggggctcttcctctcctctttttgaagcttttcatttccctttatattctttcattcgtcaactacaaagaagctgcaggcaggaacaagagagctcagcacacttggtgcagtctctctggcttggtaattggtcccaagaaaatagtttttttccaattatggcaacattgaaaacttatccaggagaggaaaggctctttcagctgctctttctcgatccttgcagtttcccttttgacctgtgggtacacatggtactgacgcaattggcacctcagatggttcttcctgacagctacccttgcaactgactcaggatacaaactacctttttttttggagacagatctcactttatcacccagtctggagtgtaattgacgcaatcctggctggctgcagccttgaccttctgggcccaagcagtgttcccgcctcggcctcccaaagtattaggattacaggcatcagccgtcatgcctggcacaaactgcctttggaagtgaatcagtcagttgcctagtaggcctaaggagaccatgatccatgtaaaccatggaatattttaagcagaaaagaacgtattccccttcaaggacaaagtgctggaataattgacatccaggttatcacagagccttcctatagtgttgattctgatcactcaaataatcttagtgttaaagggtttatttttatttttctaccttcttttaccaccccttactcccatcagagcaccatcagtcttttgggaataaaataattcctcagatatattaaaaagctatagaagcagaagttaacgtacatgcaaaaatctctacatttctcaacaattgtgtaaccactaaatatagggaaagaagtgtgcaaggtataagacattggccatgcgtccttgtctgtgccacctcaccaggagcattgctcctttttatgcacaagcatcagaggttctggacatcttcttgggctagttggtatagcttccttctcagctcattctgcaaggtttgctttggaaaagtctgtgcatctgagctctctcttgccatatcaggaaccgaagtcagaaataaaggctacagatgctcaaaatctgcagtattcaatctttttaaggcccagcatggtgtctcatgcctgtaatcccagggctttgggagactaaggcgggtggatcacttgaggtcaggcattcaggactagcctggccaacatggtgaaaccccatctctactaaaaatacaaaaattagcctggtgtggtggtgcacacctgtagtcccagctagttgggaggctgaggcaggagaactgcactctagcctgtgctagagagcgagactctgtctcaaaaatataaataaataaataaataaataaataaataaataaataaataaataaagtatctgtccccaagtcacaatgctattcggttggtgcaaaagcaatcgtggtttttgccattacttttaatggaatagtaaataacacttgatctttggtcttctgacctgaaatcccatggctaggattgtcagatagaatacaggacacctggcctgttacagtggctcacacttataatcccagcaccttgggaggcagaggcaggaatatcacctgagcccaggaatttgaggctgcagtgagctatgactgcaccattgcattccagccagagtggtagagcaagaccctgtgtcttaaaacaacaaaaacaaaaacaggacacctggttaaatgtgaatttcaggtaaataacatattttttaaaaatgtatcccatgcagtatttggagcatatactctaaaaattttctttgggatatacttctaagaaatgatttgttgtttatgtgaaactcaaattttactcggcatcctgtgtttttatttgctagacgtagcacctacctgtgacatctttttgtttctgccctgctgtgtcacagggtcttggtatctttcctcctgtgattctgacactaccttgggaaatgactctgtatcaagcgtttaccatctgctgaaagctttgcatactctgttgcttatcatgacaactgccctgaaagttgggtgtacttgttacccctttccagattaaaaaacctaggggtcagagaggttaagtaacttgctcaagacctcacagtgaactgtggtggaccactgggattagaacccagtgagttcagtggctttgcctccaagtgcgtttattattgtccgcactccaaaatggctttaaaaaattaaaaagatacatgacgttgaaatcagtgacagaggcataaggctccttgagggaagaaaccaggtgttggccataaaaaaattatttttcacagcgcccagcaaagggcttgtatgcaaaggaccctcagtataagctggttgttgactgatgtgtttcaagagtaagtcagaaaaataaaaagaaggcagggaaagagttcaaaactcagtgtcacttgcacatccattttgccctagaagtgttttaaattttatcaggctcataaactatgtttcgaaacgtgaaaataaattggccccctgaccccttatgaagtgacatcattcatctgaaaggtttatcgccctgcgtgtcattttgaagttccctactctcctcctcgttctctaaatccatgaaaaaatagaaatgggaggaagaactggagagaggggttctgtgtgtgtggaatgtggctctggaaagcccccagccctcctgttaacacaatgcttttatcccgtaatctctgcctgcgggagacaaaataacagttcatctggaaaacaagattaactcatttaacttacgtagtgatcacagagagaagcttgttggagttgtctggctgaaggaaagcccgcgattctcggccattccggttcacagggcctgggtagcgggcccagcctgttgcaagtaatcgggctctgtcagatcagccttggtgagattgggatattaccagggtattctgttcatctctgacacaggccctctcaatctgatagacggtgtgcctcttctcttcattagaacatcttcctgaacacttgcctgtctgcactgccctgctaaggggttttcaggtgagcgtgctgtgggtaccttcacatttcaggccttttaacagggaatgaaaaccaactgccctgtgattccaagtctgctgatgcatgtgaaattggctttgtgttggggcctcttcttccaaagcaacagtaagcattttttttttttttgtgataatctctctctgtcacccacgctggagtgcagtggtgtgatctcagctcactgcaacctccgtcttctgggttcaagtgattctcctgcctgagcctcccgagtaactgggattacaggcacccgccacccgacgcccagctaatttttgtatttttggtagagatggggtttcaccatgttgcccaggatggtcttgaacccctgatctcaggtgttccaccctccttgtcctcccaaagtgttgggattacaggcgtcagccaccgcccccggccgatagttgcctttcttaccagcctgggccaggagcagttgtttattttctgctatttcgtgtgtttctttttgctggcagtgacatactcctacagggatgtctgcctcatgttgacctgcttgtgtttaccacctagaggcctaagaacaggctttccccgttcaaatcacccagtggcgtgcacacttggggcacctggggactggtttcctgaatggcattgagagtcattactttccacacacagttaactgcagggagatttgtctctgaaagtagtcttcaagaaatgcggcagctgcttctagccgctccatccttccttttcccagtgcgcactaaccctccagagccttccgcatctgctatgcagcattggccacaccagtgggatgcaagaatttatcccttctgttgatgcaattaaagctaatggatctcatatatatatatatatatatatatatttatataaatatattttatatttaaaaatatttatattttatatatttttatatatttatgcaagtatatatctaaatatataaaatatatataaatatatacatatatgtgtatatatagattttgttttttgagacagggtcttgctctgtcactcaggctggagtgcagtggcgtgatcatggctcactgtagcctcaacctcctgggctcaactgattctctcatcttagcctcctgagtggctgggaccgcaggttcatgctaccgtgcccagctaattgtttaattttttgtagagataggatctctccctttgtggcccaggctgatctcaaactcctgagctcaagcgatcctactcactcggcctcccaaagtgctgggattacaggtgtgagccaccatgccaaagcctaagggaccttagaattttttctcctttcttttcacattttgttttgtgcttgcttatttattgaaatctggaccacaaataacttacatgtttgtcaaggccagatttcaggacctaaccaacacccgacaggcatcttagaaagtggagggtgtaagttataaagagagattacttccaacacgtttctttaaagcctgctggctaaattaggtgggaccttctttgtgtcctctctgttcttgctagtctggcctttgtataatagggaagcagatatatctggaagcctctaagtgtgcatcatggaaattgtttgaaatgttcaaagtgatgtggatgtatatatacgttaaaaaatatcactttcccttttgaagacatttactatttctatggtttgtttagcaacagcctggctgaatagttcttcaaaaaataggaacatgatgctcatatctggccactgtatatgctttggagggaacttgaagactaggtggctgcagccactcagaatcttgttgaatatttaacatttttttgtgaatgtatcaactaagaagactatcaattttagagcatacagctgttctagaataatagtttgaaaggccagccgcaaagattgtggtgattaaagtgtgagcagatgacggaatgataaaccttaacgcttaaaaatgtgtttttatagtgccattcctatataacatcgtctgataaatgtatttgagacgaacaggccaaatgaaagaaccttccataaggggacgcagcacagtttgaatataagtgttccctccaattcccatgttagtgctttactatgagtattgaccagtgttaaagagtgagcgcacaggagccttctcaaagcctcctgcacacactctcccactgtaaatgcacgagtattgatcacaattattccgtaaacacatcttacaaattccctcagtgcacgcgccatctaaattaatccaaattcagaacaaagctctcttggaaaaggaaagagcatctctttcaggagcttccctcttggacattaaatcttccataatctgtgctagttcggcaaagaagccccaacgtcctcccaatcatagggcgcctgagctcttggtctcctatatcttatattcattatagatgtcttatatccattcctgtatcctttgtgatgtcttgagtgagaaaatgctctgaccaataagccaatgttcaattgacttcgaaatgttatgtgggataggctcattcagggtggtacggctgtagacaaaatgctatatgcattggctgggcgcggtggctcacacctgtaatcccagcactttgggaggccgaggtgggcagatcatgaggtcaagagatcgaaaccatcctggccaacctggtgaaactctgtctctactaaaaatacaaaaattagctgggcatagtgttgtgtgcctgtaggcctagttacttgggaggctgaggcgggagaatcgcttgaacccaggaggcggaggttgcagtcagccgagattataccactgcactccagcctggtgacagagtgagactccatcttaaaaaaaaaaaaaagtcttatattgattaaaagagacttaagacacatagtaccagatggattgtgtgatgctcattttgatttggatttaggggaacctgctctcaaagacatttttctgagacaaataggaaaatttgaatatggagtagctaatagatagtattaagagagtagccttcattttttaaagtataataatattttaattgagtttatgttagagatgcataccgaaaaatctacaagtgaaatgatatgataactaagacttgctttaaaataatgcggaaaaaactgttagagtaatagcgtaaataattcaagattggaaaatgttcatgttaaattattgttggccgactgtgggttcatttaattaggttctctgttttggggtatgttgaaaatttttcataagaaaatattattcagaggtctcaagaggcaggctgccaagaatagcagttagaaatagctagtatcaggcctggtgtagtggctcatgcctgtaatcccagtgctttgacaggctgagggaggagaactgcttgagcccaggagatcgagaccagccagggtaacatagggagaccctcatctctacaccgaatttaaaaacttagctgggcatggtggtgcctacctgtggtcccagctgcttgggaggttgaggcaggaggattgcctgagcctggtagaggtggaggctgcagtgagctgtgattgtgccactgcactttagcctgggtgacaaagtgagactctgtctcaaaaaaaaaaaaaaaaaaaaaaaaaaaagctagtagcacaccccaaaacttctagacagggcatggtgtgagctggagtagacaactagttcatggtaacaggaccagcagagctccgtcttgatgctgttattatttggtatctgttaggagctgaattatgtgtccccaaaattcatgtgatgaagccctaattcacagtacctcataatgttactctatttggagatacagccttttaaaggatggttaagttaaaatgaggttgcttggatggtccctaattcagtttaatttgggtccttataaaaagaggaaatttggatgcacagagacaccaggaattcatatgcatggaggaaagaccacagtggcaaaagacacattgaggaggtggctgtctgcaagccaaggcaaggggcctccggagaagccaaacctgctgacaccttgaccttgaatgtgcagccttcagaactgtgagaaaatcaatttctgttgtttaagccacctagtctgtcacattttcttatggcaacccctgtagataatacagtcccattctctggggaaacagatacctccgccagggtcctgatctgaatatgatttggggtgatggaacagaaacacccgaggactgtcgttggggaacaggaaacctgtctgtagtcctggctctgtctccaattggctacgagggcttgtgtgtactctagttctctttccgtgacactgcatttggggggaaggtaagggaactggggaaaagaaggcaaaatgatgacttaaagagactgatgaacccaaagctctcttgtgaagccccttctagaataagtccgtctcacgttacagtgcttaggaagtgttagatgtactgtcatttcttcaacatatatgtcctatattagtctattctcacactgctagtgaagacatacctgagatggggtaatttgtaaaagaaagaagtttaacggactcatagttgcacatggctggggaggccacacgatcatggcggaaggcaaaggaggagcaaaggggcgtcttacatggtggcaggcaagagagcctttgcaagggaactgccctttataaaaccatcagatctcgtgagacttattcactgtcacgagaacagcatgggaaagacctgcccccatgattcagttacctcccaccgagtccctcccatgatacgtggggatgatgggagatacaattcaagatgagattttggtggggacacagacacaccatatcatgtcttggcagccatctatattcaagacactattctaggtatgacataaaggatggcaaaaagtcagttacttaaaagtgtggaagcagagtgtcccaggcggaggaaacggtaaatgagacctctggtagtaagaagcagtgtagcatgtttgagacactgaagtccaatggaacttgggcggaataaatgaagggaagattcaaggtgaaggctgagaggtgtgcatgggtctgatcacacagagccttgtaaaccaaggtgaggacttaagattttattctagctgcagtgaggaaccagtgagtggttttaagccagagagagattgataagacatggaatgatatggtgtgatatatgaaatgacatgtttgaaatgatagatgacgtgattgtgatataatatcatgcggctgaggacaacactataactgctcggtagagaatggattgtcatggcctgggtgtggtggctcataatcccagcactttgagagctccaggtgggatgattgcttgagcccaggaatttgagaccaacctgggccacatagtgagaccccatctctattaagaaaaaagagaatggattgtgatgaattaggattggaaacacagagatcagttagaagatttatcagtgagaaaagagttcagttgcaagttaaagaaaacacaagtaaagctaactgtaacacacagagctttgtcttttcttgctgaataagaagctgagagggaggcaattgctgtcactggtccagccggctcagcaactgcacatttgtcaaagttcttcatccccagctttgtgattctctaggttattcattcttctgggatcgtagatggccaccacaggttcactgtggaaagaggggtaggaatttttaccagctgggtctgactccaccccacccccacccctacccaccgttttttgtttttgttttttaagatgaagcctcactctgttgtccaggctggagtgcagtggtgtgatcttgactcattgcaacctccgcctcttgggttcaagcgattctcctgcctcagccgagtagctgggattacaggcacatgccaccacacccagctttttgtatttttaatagagacaggatttcactatgttggccaggctggtctcgaactcctgacttcaggtggtctatccaccttggcctccccaaattctgggattacaggcatgagccaccgtgcccagccgtgtctgaccattttatcaggaaaagcaaaagcttttctagaatctatcaactcccttctgcatgtgtctatttggcatgggctgtgtcacatgacccctgagctgcaaggaatgctgggatacgatggaagcctgccagaggtagagccttgggaagggctgatagggcctctaacctaaatgtccaccaccagaggtattacagaggtttgagcaagaaattatggtggtcccagggatgatgcattctgataatcattatcatcaagaggaatgtctaaaggaaaggggaaaaaaaaaatcagacagtcacattgaaatgaggtccttaagataggccctaatccaatatgcacataaaggggaattttgggcacagagacagaggcagagatagagggaagatgatgtgaagaaaaacatagggccgtgtagaggcagaggcagagattgaaattgtgctatcatgaacgggggaatgtctgggactgccagaagctcctgaaggcaggaagcatcctcccctccagcctttggagggaatgtggccctgttgacaccttgatttcagacttctgggttccgcaactgcaaaagagtacattgctgttctaagccacccagtgtgcagtagctttctgcagcaaccctagggatgaatgctcctgccaaatgctgcctgcccttcaagatgagtgttatttggcagaggaagatgatgcactgcttattttaggggatgccctcacttttgggtccctatgtcacctgtgtgtactccatgccagtgtcttcccagcccctgccaggcaagttcgtgtggttctgtgataaccctcatctctataggttctgtgataacgctcctctcactgtgctgctccttgggtgacatcacacccaaggagaatcatgggaccacctccagagagattttcttagaggtgtggaacagaaaaaaaagcgtctctattcgaattgcaggatcttccttatagtcctggagaaacgtggcccagcattgtcttggtccatagcctgagcttaccctccctacgcaaccacagctgtgtgcagcttcagccaggtttgctttacctgatctcactggcttcatgtttattatcttattttcagtttcaaaagggcatatcctgccccctttcccaagatcagaggataaggaatgtcttgatgttctcagtcgtaaaattaggctaataacacctcccatggttgtctgtgaggacaacagaaagtaatgttttctctgaaaagtttaaaagggtaaatggcttcatcacatggtgatgacagtgattattccaagagatggctgtaagctccctgagaacagaggtgctctgtgtaaatctagtctgtctccccaggcttagtggttgacctagactataccaagagtaagtgtgttttttaaatttaatttaaatcaattcattaagcattgctaaattggaaaaccatggaatatagagatccagtagttaagagcctactgggagagacagcataataattacaataagtgcagaacttgcaataatgtaattgaaataatgtaatacaatcctgcttaatattacactgtatatattcattgacttatagactgagctccttatcttgttcattgctatggctttagcaccttttgaacagtggtgcttggcttttggtaggtggtcaacaaatgtgtattaagtatatgaactgttggaagggtctgctgtgaaggatgtgatttgctctctttgatggtggacaaagaaggtttcctggtggaagagattaatgagttgggttttgatgaatgaataggagtttccccagacacacggaggagacagaatggaatgaaagaggggttttccaagaagaggcactgaagggcaagacttcattgcttctttgatactccaatgccggcttcctttgggttggactctgatggatctaatcgaggattaggatggaggtaggtgggaacatatttagaaggatgccctgtggtttttctccttcctgctatttatatttccctctctgtctttcccacctgtttggtgatgaggaaggagctgtgtactggtttgaaacctattcacgacatagtggacccaacaccaagtgtcttattgtaaatggatccacttttactacagttactttaatggcatctaaatgataaatgttaataagcatttttgcttgggaaagcacaatggtattagcctgccagactgcaaacgttatttgctttatggaaggggatttcaaacaaggggttctggtggttgtatttttgcctcaacggttatttatagagaaagtatgggccattgcatgtttatagtatctcttttttatggctgcccaagttattattttttattggtttgggtacttaatttgcacatttgtaaacaattatgtagttacacagctgttgtaccacagagaccatatgcatttccatgttaagagaaaagtccgtgagggattctcactggataccatcataaaagaattattgtggtgccaaaaaaatttaaaaaaacgactagctcagaagttatcattgtgtttttatagtatttggagttaaataaatttaatgtttttttgctcacttgagttggagccaaactttataactgaataggagggttctctttcccatatttgagtagaacacatgatgttcaataaaaatgaatttgccagtcagaaaaatttatcttttagaaaattaatacactgagccaagcatgggtggtccatgcctctaatcctaggtactctggagggtgacggtgggaggatcccttgagcccaggattttgaggctaccctgagctatgatcacaccacagcactccagcctggccaacatagtgagacactacctagatagcttaggagagttccaatgtttctgaaggatgtttttttaaaagaagtattcatttaggtgacacatatttattgagacactaatatatgccaggaattattctattggttcctttggaggagacatgaataaaggcatggatgtgactgaggaggtaaaggtgaagaattggggaggggtggatggggctgactcatgacctaaagaacatggcatctggggctctcttgaaataatctgcactaaccactcattcacatttttttgagtctgtaagatcccaggcactcttggtagcaggggggttaggtgggtgaagggacaagtagaacttagttccaacagagctaaagggtattggtgaagactatgagcccctcatgacgcacaactggtttcaaatccaagcccatcatgtatcatctgtgtgattgtgggtgatctctttcttcccaaagcctgttttcttgcctgaacctgatcaacagaaacagtcagtgcaggtaatgtgtttagcacacagcctggcatacgaacttccacacaaaacgggtgaccatggctgaagggttattctggggagccttccctgtggaagccccattaaccatccctgctcattcctcccgtgagaccaccatttgctaaatcttctgtcaggtgatgtgggatccaagaagaaacaataatcagaagcttgccttacaggcatgcacaatttcgggtggactgtcacatgtgcactgaaaaagtcgagaaatgttatgatggccctggaaggaggagtgtctagatgaaatgcgaataaataggagacaagtgtgtcgttaattaagaaggagaagggggactttaaggttaccttaaaagaaaagagacccctcaatgctttggaagagcctttttaataagctagtcaggtaagttagattgctctgtcttacactggtttagtaattttcatatatacttatttcctctgaaatgtattagtaacatttgtaatttaccaaatggaaaatatcacttaactttaagcttcatcaagttaagaatgaatttgtaaccaggggtattatgttttctcttattataacaaacaccaatcaaaaacaaacaaatacatgacgggaaagaaagaaaacccagcatttattggcagtatttttctgcaaaatattatttgtttccctttgcagttttattcattttaagcacgttttcaccaaagtgttctattctaagctagtctcaattcaatttaaagtggaaggtttttttcagtttagataatttacatataaaagcgttactgtacattttatgaaatgactgttttcagaaaacaacgatttcaatttaatcgtattgttattctgcaagttgaaatgcctcactcttgcttcttggtcttactgacaatattccttcttgccctaattttaaatggtgagtgtttgaaaattgatgtgcttcttttagaccctaccagtaagacttaaggcccactgtgattcgtctgatagacttgaagattatgtgcgcgtgtgtgaaacaagggaatcttaatcatctgaacctgacggttatatagatctttctgaattatttttctttcttttcacaagaaagaattatttttctttcttttcacaagaaattttgcttgccaatggtcagatctgttaacacgaaaactaaaaacttatacatcattttatattttgaaattcccaatttgcaatgttatttttttttcttcttttttttttatgacacttttcttctggaaaaaatccttaggacccagttactctctttcaggattttatatcataatgtgtctgtgagagacagagccagatgttcaggatttcagaccaccatatttgtcctaggaaacctgccagcatttcacattcttgacccttgaattgaatatgaggctctgactatataacagaaaacacccgagttttatgattctgcaagcgtggtttacactataaatttccaccggtctctgcttgtctcttctagaatttagggttattctcaaactctattatacaagcagtgcccaagtgccttcctccaaaagtacattagatactttcttggggagagaagaaattagacaggagctacaaagatggattaaaattaatttggtcctaactaaaagataagttcctcccccatcctcaggatgaaaccaagagcacttctccatcatcaggggagccaagtggacgctaatcaccaccgtgcctggagagttgcctttcagctggtgaatttactattgccaactcctgcattcttattagtctataagattgaggtcgtttattggtgatcacttgtagatatatatttatataaatctcttagcccagaatctccataaactgtttttcatgatgtggataccacgtgggatatgtcccacaattggcaagtgccataaatatattataggccattatactttctacagtatctttaattgatatgccccatgtctaagaaaaaaagtagctttcatgatgaaggtgatgaactacttctttccattattctatttcccccttttcttcttcaggctttaaagatatcataataccatttacatttactgtttaatttttaggtctgtatttaaaaatctgtgtagtgacaacaattattcttattgtatgaacatattgtcggctggagagtattcagctgtcagacaaagtgttctctaaagtgttcagccatcagacagaaactctattgctggtggcggggttgtgggctgggggaaccagagtatttgctcttctttagaagtcatcaatggtaagcctagggcagcctgaaccacttgtgttagaaatattttttataaagcaggacatgtgctttgaaatttgattcctccgtcactggctgtgtgaccttaaagaaataaattgacctgcctgagcctctcggaaatattggctggccagtagcatcctcacagagtttttctgggaatcgaatgagagattacatacacagggccaggtacatagcaggtgctccgaagatacccccgacttcctttcctacgaataaagaggcccaactttttgtccatatgaagaggttggcagagcaaacgcacacgtgcgtaggagctggaattgtcgataatgtcacaatctcaggaaacccaactttgtaaatgtgactttcctttgctactttttgcctattaagcagccatgtatgtaaagtattaaattagcatccaggcactttctttttttctagaaggtggtattttgcatattaatacttgcttaaatcaagaagctaagactttgtattatattttgctttacgtgccttgattaaggtcatgatcctgacattccagtcccaaaggagaccaaggaaatgaccagcacgtggctcactccctgtctgtccagtagaggacaccaaggcacgatgaccgcagctcctgtagtagttatggtcactgactccgggttcagacggacttggggttcagtcctagctctggcgcttaccagttttctcaagtgactttgagcatctttactcaaggctcttggtctcagttttctcatctgtaaaatggagatcgcagtatctaactcatgggtgtgtttaaggattcagtgatggagaaaatagctgaaaagtgaccgtatgaaatgagcagcagttgtcaagtacttggcatagttcctgtcacataggaagcatccagtaagtagtggtatctgttgtgattatgatcatattttatttcatggagttcagtaagagtacaaagcgaggagtttttctgcccctccagtagctgtagaatttgtgtgatgactatgtgagcttatcccctggtaggtataatggaaagactaacaagagtagaagagggatgtaactggagcatgatttaaaggaactgtagtttgtctctgtttttttttttttttttttttttcctctaaataaacaaaggaatagaagatcctgtgaagagctgggtgtggtggctcatggctgtaatctcagcactttaggaggccaaggcaggaggattgcttgagcccagtagttcaagatcagtctgggcaacataatgaaaacctaatgtctacaaaaagtataaaaattagccaggcgcagtggctcacgcctgtagccccacctacttgggaggctgaggcaggaagattgcttgagcccaggagttagaggctgcagtgagccatgatcacactggagcactccagcctgggtgacagagcaagattttgtctcaaaaaagaaaatgatgtgaggaagccaggaatgatgagtacctggattaaactaccttaaggctgattgagtaaaagtgaaagatcatcccgtcaactgctggcctgccgcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggggtcagtgtctgtcaacgtggcttttgctaaagagccttcccctatgagaagtgaggcaggagaaggcggagtgaccacaagatgccctgatggtgccaagctattattataaatgaactgaagccacaacagaagtctgctaccttgttcttatctgcatgtttctctctttccagcctcatcttctactaccttcttctactcccacacttcttctaccttgattcccagccttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtgctctctgggttcactcctgacagttctttattgctttcccacctctgccaaggtcaaaaatggaacttgcttcttgttctcgtatcactcagactaagcagttgatgtaacagataacccccaaatttcagtgatttcacatttaatctgtaaaaaatgaggatttgtttatagccccaaagacagtctagtttggattatttgaggacctagacttcacctgcacagtggtttcaccatccatccccccatggcctccatggtaccctctgattcaggctcagcaggagcgggagaggatgcataggactacatgttttctgggccaggactggaagcagcatatctcagatccaacctctttaccttggcaaaaattcaggatgtgcaggacgaggaggaaaatgggagtagtgactatttagccagtctttgccacatcccggttcatatctcactccgtcatttataacctgtaattaaatctttagtgagtacctgtcacaggttgagcagtcttctagggcctctggttaccagcaatgaaaaaagccccatttggtaaaatacagtagttggattcattatctctgtgattaacttgcataaaaaagagacagttttcattgatgtgacctttagcaacaactcctaaaatattttttttccttcattcctgcttttccttgttccagaagaagttaaggtaaatggcttttagcacattgcacccccagcttttagcacattgcattatcattataataaatgtttacggttactgatattattatagttctttatcgacattattacagtccattatttacagtccttatgttatttaggaggggaatttggggacattgacccacttatgtgtagtcccctagtgaaatgacaagaatccccagagctgggaaaacatttccatgcaattccctctcagtttacatcaaaatcagctcgtcacccttgagattgaagctcgcactctgtaagctctgaataaatattaaccatctcctgaaccctgaaggagacattttctggggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttgttgcattaatgcactttattggtgatatggtttggctgtgtccccacccaaatctcatcttgaattgtagctcccataattcccatatgttgtgggagggaccgggtgggagaatattgaatcatgggggtggttcccccatactgttcttggggtagtgaatgaatctcatgagatctgatggttttataagggggaaacacctttcacttggctctcattttctcttgcctactgccatgtatgatgtgcctttcgctttgcactatgattgtgaggtctccccagccacgtgaaattgtgagtccattcaacttctttttctttataaattacccagtctcaggtatgtctttttttttccttttttcttttcttttcttttcttttttttttttttttttttgagatggagtttcactcttgttgcctaggctggagtgcagtggtgcaatctgggctccctgcaaactccacttcccggatttaagcgattctcctgcctcagcctcccaggtagctgggattataggcatctgccaccatgcacggctaattttgtatttttagtagaaatggggtttcaccatgttggtcacggtggtctcaaaatcctgacctcaggcgatctacccgcctcagcctcccaaagtcaggtgtgtctttatcagcagcattaaaacaaagtaataaaattggtttcttagggttggatggcttaaaacaacagaaatgtatcatctcacagttctgaaagtgagaagtccaaaatcaaggtgtcagcacagccacgttctttctgaaggctccagggatgatctactccatgcctttgtcttagcttttggcattgcgggcggtgcttggtgttccttggcttgtaggtgcatcactccaatctgcctttgtcgctgcatgtcattcacattgggtctctctgtctctactccttttcttctcttttttctcctttccttttctttcctcttcccttttcctttcttttcttctcctcctccttctccttctcctccttctccttcttcttctctttgttctccttctagttctcctcctttcttctttcttacttttactcctccctgcttcccttccctccctccctcttcctccctccctccctccctccctctctgcctccctctctccctctctctttttctctttctctctttctctttctgtgtctctcttttctctctctctctctttccttccttccttccttcttttcttccttccttccttttttcttcttttttttggaaacagtcttgctctgtcacccaggttacagtgcagtggcatgatcacggttcactgcagcctcaacctcctggggtcaagtgatcttccccacctcagcctcccgggtagctgggaccacaggtatgcaccaccacacgtggcgtatttttaaattatttgtggagacggggcggggaggtctccctgtgttggccaggctggtttcaagctcctggcctcaagggattctcctccctcagccttccaaagtgttaagattacaggcatgaaccactgcacccagcctatcttaattcaatacacagtagtgctttttgttcccccatgggatagtaggtaaattaatggaggaagggagtcaactaaacaatttatttgagcaattaatggaggaagggagtcaactaaacaatttattagggctttatgtaaagccctagggttagttggttggttggttttgttttgttttgttcctttttttttttgccaggggatgctgtggttgaatttccctctgtggtgagagttgcatggggcaatgaggaggtagtccagaatagttctatggaaataggaggctttcagtttcttcatctgtacaatgagagttgaggggagctgagtcgggagttgaaatggtcactgggtatcatttccgtgggtggctctaacctgttagggctgtctgcacagtgctgagcttttgtgtttttggtcatcccaatgtgcttttcctttttcctgagagcagccctctacatcttccgtggtgtaagttgccttattccagcacgtggcatcgccagtcccagtgcccttggcagaccatgcagaatgcatccatggaatatgaaaaatgaggcccagtggggcacagtggctcacacctataatgccagcactttgggaggccaaggtgggcagatcacttgaggtcaggagtttgagaccagcctggccaacatggtgaaaccctgtctctactagaaatacaaaaattagctgggtttggtgacaaacgcatgtaatcccagctgctagggaggctgaggcaggagaatcacttcaacccggaaggcggaggtttcagtgagctgagatccagcctgggtgacagagcaagactccatctcaaagcgaaacaaaacaaatgagggtcctcatcagcgtgcctttgacactgtcctctggtcctggtgatctgaatacatcaccacagaactgccagggtacgtgtttcctagcccatagcgagtcccagtgaaagcagagatgagaaagaaaggagggacacaaggtctgggtcctgagttccagtccgtgggggccctggtgctactgctgtagttcatgaaacattcccttcgattctttgaactctctcatacctttcccttaaattcttctttttcccttatgtcaagcttctttcagtaacaactgaaaggctaatagtagtgctgtgtggggaggactttggacttggggattggactccatgggagaggtcagctccttgtctccctggtggtgagacagggaatggtagagtgtgtcctacctatgtgcctgccttgctctacatcagtgcttcttggatattttggtatcaggactctaaactcttagtagttatccaggacccaaaatagcatttgtttatctgggtcatttttactgatatttatcatactagaaattaaaatagaaatagtcaaattctttattaattcgtttataagtaagaaacctattacaagtgaacatagataactcccttcctctttcctctctccctccttcctttttttttttttttttttttttttttgagaaagggtctcactgtgtcacccaagctggagtgcagtggcccagtcacaggttactgcagccttaacctcctgggttcaagtgattctcctgcctcagcctcctgagtagctgtgactacggacacatgccactacacctagttgatttttgtattttttgtagagatggggtcccactgtgttgcccaagctggtctcaaactgaactcctgagctcaagcgattctcccgccttggcctcccaaagtgctaggatgatgataggcaggagccaccacacctggccatggataacatttctataaaatataaccatattttcaaacaaagagaaaagtggcgttgtgctacatttcttctccagtgcttggttccctagaagacagccagattctcacttcttttcctgcattcagtctcttgtgatatcacatggcatgtggcctctgaaaaactccgctgtctagttgtaaaagaatacaagtaagtagtcaagtgacaccttagcattctgatgaaaagagctttgacctcacagagcttctggaagggtctcagagacatccctgagggtcccttgactgcactttgacaaccacaggtctacatgatctgtatagccttttccagttttcacatcctatgattccaagagggaaaacaatcttccttgtaaagagagttaagtgacattgtgtccttgtctacactcagctgctaatatgctatgggacctcaggtatgtcacttaaaccttgtgttggagtttcctccttgttacatggaggtcacaagaataacaaactatgcatagatcacctaatttagtcattccaacggtgtggagagatagaggattaggatggactttatttcctaagtgagaaacgttggctttagtaaaagtgtagtggtttgtagggtcatccccctaaagatatcccgccccaccaaagatatccctaaagacatcctgctggtttcagtggctcatgcctgcaatcccagcactttgggaggctgaggcaggcggatcacttgagctcaggaattcgagaccagcctggccaacatggtgaaaccttatccgtaaaaaaaataaaaaattagccagacatcgtggtgcatgcctgttgtcccagctatttgggaggctgaggtgggaggattgcttaagcctgggagattgaggctgtagtgagctatgattgcaccactgcactccagcctgggcagcagagcaagaccctgcctcaaaaaaaaaaagtaaaaataaaaataaaataaatatatatatgcatgcacatcctaattcctgtaacacgtggatatgcccttacttggaaaaagtgcctttgtagaatgcaagcatccttatggaagaaggtcagagggagatttgagaaagacagaagaggaggagtccatgcaaagataaaggcagagggtgaagttgtgcatccacaagctcagatatgcctggagccatcaggtgctggaagagatactggaagatctcttccagggcctctggaggaagcacagtcctgctaactcttaatttgggacttctggcttccggaactgcaaaagaacaagtttctgttgtgtgtaggcacccagtttgtggtaatttgttacagcagacatagcaaactaatgcaaatgggctttgcttgaagtccctcagctgctaagggtcagaaacaggatttgaacctacagttttgaggcctgaacctgctatgcagtgctttcttcctgatagtgaaaccactgtggtcccaaacccacagggctctatttagatttaaacaagactatgaatgtaaacagacacagtgcaatgccagatccagagcaatcgaaggtcatagtttcctcatccctcgaagctgccaccttgcaacatcatccttgtgttacttccagttgtttcttatgataagtaacagtgactttgatatatccattttttagttgtgtacatggtggtgatggtgttttactccttgctataaacgcttaaggattccttagctttagggaatgaaactacttgggcaagaatataaaattttgttctattttattttaaagctctggttacatatggtcaagttgcttcccaaaaagcgtctctgtcaggatgatcttatgaacgacgttagtacctcaattttactgtcccatccttttttcctccttccttgcctccttccctctctgcctccttccttttcttcccatttccttccttccagcattatcatataagccacgtgctgggatgtaccaggcacactagctctataggtaagatatttcctaggactcatcattcacatgagtccaggagaaatacatcttttgtttgtttgtttgttttttgagacagagtcttgctcaggctggagtgcgatggcaccatctgagctcactgcagcctcaaccgcctggtctcaaatgatccacccaacctagcctcctaagtagctgggaccacaggtgcatgccaccacgcccggcaatttttttttttttttttttttaagtagagacagggtcttgctgtgttgcccgggatggtcttgaactcctgggctcaagcgatactccctccttatcctcccaaagtgctgggattacaggtataaaccaccaacccagcctcaggagaaataaatcttttaggaaaaaaaagtgacacagttttctcttgtggcttatcacttggaatgtggagagtcatttccattagggaaccaccaggaatcttggcaacttagcagccacaggagatgcagaaactgagtagtgatttaaaaattcagatcactttgtttgttcccctagaataatacattattatcattaacaaagtaactcaacttacagtatcaaatcaactgcagagccattgatattgatgttaccgtactatccaacacattatgtttagtgttgatttaagaaaatgttgattttatttgatgtcatgggtgggaaattgcttgcttttgttttttgagtgaatctggtttaactgggctgtgtaagccaaggagttctaactcttcttgggcaactgagaccgtggctaatatttcattatctgtattaattaaagacagggcctggtacttgacatggcagtgtgatgtgtccaaggttagacccgaggtaagaatttagagcacagaggcacgctcacatgaagctgccaattcctctgctttttcaggtagaggctgaatgatttccgcacctttttatagattgcatgacttcaaagatgcacactaatactacggctccttgggaaatctttctgcactgatccctttgaatcttcagtgtttcaacatagacttgttacaaagagaaggaatataagcctctgttctttcttgtttccctttgttaattcctttttcctttcattccttcttatctatccctttcttaccttctttatttcctcgtttatttgggctttttcggttgtgaagatcagtaccttgaaattcagaatagatggcatgaagcacttcagctttgcattcaagtactcatgtgtatgatcaagcatcgtcatgatcattattgactggaaagcctgtaagaagaagcggataaggccagggtgcagactgggcagtagttccctgtcatgaatccactctgcagttgttttataacatgcaacaaaaactaaagtctaatagcactccccaatgccaattttttttctttctcttttttttttttttttttgagagacagggtcttgctttatagcccaagctggagtgcagtggtgccttcacagctctttgcagccttgaactctgggctcaattgatcctcctgcctcagccatctgagtagttgggacaacaggtatgcactaccatgcccagtgaatttaaaaaaacaaacaaacaaaacactttttgtagagaaagggtcttgctatgttggtgaggctagtctcaaactcatgccctcaaatgatcctcctgccgtggtctccaaaagtgctgggattacaggtgtgagcccccaaccccaaaacttgaatctgggccacctttactgacttacttattactatgtagaatatggtacaggtgacgctgcagactcttgaagttaggtcataaaagatgatcctgcttccgtctggttgtgtctctcactcatgggatgcttaccctcaaaatttggccaccatgccatgaggaaactcaatctagcgtaggtaggaagaccgtgagaggcccaaatagagaggaattgaggccgccagtcatagtcagcttcagtcatcagataggaagccaacaactgagccctcagatgattccagtttccaaacactgtgaagcagaggctgactgtcccctttgtgccatattcaaattgctgacccacagaattcatgaatagcgcatgtggtagatttacacttcaaagtctttgggtaatttgataaagatgtggtaactgggctatgctctaatcaataatcttagctaagatttatcagaaattaaaactgtatacttaactaaccacctagataggtgcaggcatatatgaattcaccgaaatttgactcaactcccttggttaatttaaataaaataaaagtaaataaggggaaattgcatactcctatctggactgttttcttatggttttggaatctctggcaggtagaagtaattatttctgtaactcttaggcagggcttaggaattatctcccttaggtttgacttctttctttcttgagaataagcgctgtgtttcgcaagagtaaagaagtggcatttattctgttgtcacagcattactgagctcgagtggatggctctttatttccttctcgtcttttcttttctagtctttgtcaggacccattcctttacccctctttgcttttacggttttcacattttaataatgtaaaaccatgttccccaaacttccgccttttttgtcccatttgctccgctgttacatcatttgtttttaattacgttcatatttacttatgtttttatgcacagctatttataaagaagattctataatactaaagtaaatagaagagcaatatcatttgccataaatacaaaggatccctgaaaataaatatactgccagcctgggcaacatagggagatcactgtttctacaaaaaataataaattagctgagtgtgatgttgtgtgtctgtagtctcagcttcccagaaggtcaaggcaggaggattgctggagcccaggaggttgaggctgcagtgagctacaatcataccactgcactccagcctaagcaacagagtgagaccttgtctcaaaaaataactggctgggcatggtggctcatgcctgtaatcccagcactctgggaggacgaggtgggcggatcacgaggtcaggagatcgagaccagcctggccaacatgatgaaaccctatctctactgaaaatacaaaaaaaaaaaaaattagccgggtatggtggtgtgtgcctgtagttccagctactcggtagcctgaggcaggagaatggtttgaacttgggaggtggaggttgcagtgagccgagatcatgccactgcactccagcctgggcgacagagtgagaatccgtctcaaaaaataagtaaataaaataactaactaggctaggcacagtgggtcatgcctgccatcccagcactttgggagtccaaggcaagaggatcacttgagcccaggatttcgagaccaacctggacaacgtacagagacctcatctctacaaaaaataaaacagctaggcatagaggcacacctgtggtcccaggtagttgggaggctgaggcgggaggatcctctgcacccaggtagccgaggctccagtgagtcatgatcatgccactgcactgtagcctgggtgataaagtaagatcctgtctggaaaaaaaaaaacacaaaaaactaaataagtcgtccatccgtccatctattcatacacacacgtaaaatgaaaactaaagcaaaagagtagtattaaattctagttagagacttaggatttccagtgactgaaattggaatgttaggtgttaaagacacacatcaaaatgagactcttggttttttttataagtgcaaggattgcaagatacctgaaaagggagtatttttcccccacatgcatctcaggagggtagcctcagatataagcttaggagtcctgaatttatcatcaatatttatatcgctgtttggcccctaacaccttccctatgatagccctaattggaatatagtaaatgtttgttgcatgaatcaacctatttaacctgtgcgtccttaaatcttacggtctgcgggttgacatttctagtgaagggagacatttctttacctacctgggacctcagaccttggacctcactgaacttgagagcagagctggtttatgtgtaactgaacctgatggttagtttcctgtttcaacttgattaggtcccagtcacagggtgcccacatgtttggtcaaacatcactctggggtgtctgtgagtgtgtttctgggtgaggtgaacatttaaatcagtcacctgattacagcagattgttctcaagtgcctgagcttcgtctcatcagctgaaggtctgaatagagcaaatagactgaccctacttcaaagagaactccttctgcctgatgactcaggtggggacttcagtccttttttttttttttttttttttttttttttttttttttttttgagatagggtctggctctgttggctaggctggagtgcagtgacgcaatctcagctcactacaacctcagcctcccaggttcaagcgattctcctgcctcagccttcccgagtagctgggattacaggcacccaccatcatgcccagctaacttttgtgttgttagtagagacagggtttcaccatgttggccaggctggtctcgaactcctgacctcagatgatccacctgccttgacgtcgcaaagtgctgggattacaggggtgagccaccacgtctggcctgacatcagtcttttcctgccttcagacttgaactgaagcatcagcatttcttgtgttttgatcttgctggagttggactgaaactacacatcagttctcctggctctccaccttgcctatagcggatcttgagactttttcttattttatctatctatcaatccattggtcatcaggttctccagagaatcagaaccaataagagatgtcatacacaccacacacaaacacacacacacacacacacacacacacacactaatatggttctgattctctggagaaccctgactaatacagaggcaagatcctgttttgacgtgcttgaactcgaggacttatgccgatgttaactctgagtgttcctgttttatactcagccatacagatgctcagagcatacctgcacaagtcaactttttgtgtctgcaggcatgggcctgccctgtacatgaggagacagcagacagttcctctccctgctgctggcctcttcatcttctcctggcgtcaccacggccaccgtgatgcctggctcaagtactagttctatgtcaatgatggtaccaatggactctaactttagaatgttgttgactgaaggcccctgccccctgccttgctttaggtggaggatctggtcaaggctttgtgaatcaggggatgctccacacctttctgctctctgcaacagggccagggatctgagtcccttcttgtctatccagaaaccgtatacccagtgttctctttctctcacctccgaataggtgggccttcccaatttacctgtgagaaaactagtgtgccacctcaagcgattctggcctctgttgactgtctgaaccctgtgttttgttgagtggtgcagactagagatgaagacagggattcggcttcgcttgctttatcaagggaatgttcttgggacaaatgtgtgacaggtgaggaaaacaacataggaaaggagacagaagtgaagagaagatgtggtctcaaatgaagtctggcttcaggtttatccttggggggctctggaataaaaatcacacctcaaacttgacccgcttgaggccagaaggccgggctgtggtaccttcgtgtcggacagtcataggctatcctcatggggacctgtatgttgccaggtgtcttgggcaaggtggacaaggatgccagcaaagtgaaattttccagagaaggtcacaaaagctaggaaatggcacagcagctgctaaaaggggatctgaccaggccaccaacagcttctgcttcttcccaaagtcacctttgctctctcctgaccaccgttggtgtctcaaagtctcacatgtgacaacacacatatcatcaaattcatgagtatccatggcacacaatgttttccttttcttctcttctctttctttcttgttttgttttgttgttttattttgttttgttttactgagataggatctgtctctttcccccaggctacagtgcagttgcgtgatattagctcactgcagcctcaaacttctaggctgaagtgatcctcccacctcaacgtcctgagtagggagggcactacaggcgcatgcctccacatctgactaattactaaatttttaaaaatttttttagacactgagtctcaccgtcttgccctggctggtctcaaactcctgggctcatacaattcccctgcctcagaatcccaaagtgctgggattataggcatgaggcaatgtgcccggcccacaatggttttcatatagctattgtgtattgcgttattgccttagtcacagaagcccataaaaaacagattccaataaagagactaggtttgcagagtgatgagtggggcccttgaaataattacatttagtgggttatatgtctatttttttggtcgttccttgctcatctgtctttatttttgtttatttatttattcatttatttgagatggagtctcactctgtcacccaggctggagtgcagtggtatgatctcggctcactacagcttccacctcccatgttcaagctattttcctgcctcagccttctgagtagctggaattacaagcgcccgccaccatacttcgctaatttttgtatgtatatgtgtatatatatgtatataatatatatattttttagtacagatgcggtttcatcatgttgatcaggctggtctcgaacttctgacctcagaatgatccgcctgcctcagcctcccaaagtgctgggattacaggtgtgagccacaatgcccagccttatatatgtatttattaagtttggggggaacaggtggtgtttggttacatgaataagttctttagtgatgatttctgagattttgatgtacccatcacccgggcagtgtatactgtagccaatatgtagtcttttattcctcaccctactcccacccttctccctgagttcccaaagtccattgtatcattcttctgcctttgcatcctcatagtttagctcccagtctacagggttatattaaaagaggaaaaggggtataagaatctaggtatcatggatgatgtcctggtcctttgctgagtcccatttttttcttcctcacctgatttcccccatctggcagaaacttttacagagtgtttgcagaagagaagcctgtaaactctggagtgtgtcctgggtggtttgtccttgggccactttattccctcaccgatcccttccaaaggccatgagttcccagtcagtcatttccctatatcagtatttattgttttaatcaattttccccatcccaagagaaaggcaccaacatgagtccatgtgttttaacatagcaggggtttccctgtcagagcccggtggacttctgtggccataagcaagtcaaggtgggctcctaagtggcagctgcccacttccagaaagctagaggttctaattatgtcttcctgaaaaacagttcaattaggtaaagtgacattttttaagcccttgtgtgtgtccgactcataaaagttcagaaggttgttactgagaggagactgcagtcattttaagatttcagtagctgctggagttgagtagataatttttcccctttctaatattatatattaggtgtgctcttgtgtctgggtgaaacagagcaatcacaatgattgttttttcagtatggtaataattaggcataaaatcaatatttatgtgtaatgtgccatttgaagattctccctgtgtatgatgctgggttttacaaaggaaaatctggattcaggtggccaatgaagtgtcacgatataaaaagagaattttgaaataatgagaattccactcctttgggagtattggcatatgttaaaatacaaatatatctgtatttttctcacttttattagaagagtgcaagtttgttcaaaacaactgctggattatctagtccctgaacagccatttatatttttgttacgcttgtggtttttaaatcatcctcatttccttgatcgcatttgcttctcctggctagaatgtgtaggagacgggtcggggagactgtgcccatttgacaggtgtgaatgcgaacagaggctgcagctggttagaccagggctgtgcaaccctagagccattgccttgaccacaaagccacagtctcctagtcctaatattaagaggtaggaggtagatagagattgtcccttaagccacattccattcttcatatttttgtacccattagagtagtgctgatcatttgccttcattgctggggtcccctaaatgcaacttctcatgctgccaatttagtcctggccctaggaagacgtaggtgataggatagaattcaacaactagaagccatggtttcctggttggatagacttcctctgccaccagaataaaggaatagagggttcctcactgtgccccatagctgcaaagtcacaggaagcttgcagcaggccagtggtaacctctgagtgacttctgagttcccagagctaggaccatgacttttcccctggattcttaagtacccggctaaaattgtgtttgccgaatgaaagtgtgatcctggaggccatgttgtttgtggttcatggaagggtgcttgttcagcttggtcaaagcaagatggtcatactgggttttggtgcccagacgttcccaacactcgcagcagagggcattaggatcatgtttagccaacaattttggaggcacccaacagtgattggatgtcatgtgctttcagaaggcacactacacatcttcggttcctccaagctctaggaaagggttgtggaattgggttgggtgacaacaggtcggtaagaagagggctgggctgagtgtaaagaaattccttggctgggcatggtggctcacgcctgtaatccagcactttgggaggctgaggcagataaatcacctgaggttaggagttcaagaccagcctggctaacacggataaacctcgtctctactgaaaacacaaaaattagcttggcttcctggtgcatgcctgtaatcccagctactgcagaggctgaggcaggagaatcgcttgaacccaggaggcggaggttgcagtgagccgagatcgtaccattgcactccagcctgggcaacagggagagattccatctcaaaaaacaaacaaacaaacaaacaaaaaccccagatattccttattatggaagaagaagcaggaaatatgtttttgaataatctgggtcagagaattgtgcatttattattgctaggatgcatatacacattgaactcagtcaacttactctctctaaattatctcaccggtggagacattgcctcaggagtcgagccctgtggtgtgcctcctgctgtcaccacatttgaccacctaactgaccccactgtggtcacctttgccacctgccctgctttggtcccttctctgcattcgccccatgccatgtagcactgctgagtttgaaaataattgcatctcctgaaaactccatttcttagagagtgagctccagcaccatcagcctgaagttgaagaaatgggactcaggaaggctggagtcttcaggcgttcttacaatgctgatgcgactcagacggctgcctgcactgtcctctgtgcttctaagtgaaattacccgtcggggggctcctgagagttaaatcaagcagcctctcttgaagcacagtaaatgctgacgtgatttgtgaagatggctctgctaatagggttggcagcgtcctttggcttggacctttggaccccggctggctgcggaagggagggaaggcagccttggaaaactgatttccgttgccctctgaccatgagaagatccctgtttaggagctagaattcagagttccacgtgtagagggggattccacagtgtgtggtgtgcagagagcactcgtctttcaggcatggggcgccgtttcatttctcctagtgctggaaggggacttggtgaaattgatttggcaaaaaggttaatgtgttgttatggctgccagttggccgattgaagcgctagtaattggggcaagggaagcattcaatttgacacaccaaatgcaggtccaccctggtggatatcttggttgcagcactctgtgtgtgtacgtgtgtgcatgagcgtgtcttagagatgcttttgctcctcttataactcctatgataaaaagagttgccattatcatcctttgtctactcaccagcccccaccagaaaccctcacagaaaaaataagagtttattttttcactatgtcacattgttggagaactgtgcaaatacaagcccttctcttacaggccatgggtctcctaagtgggatacaccacgatgatccactggggcagtggccagcaaagtccctgtccagccagccactcgtttttatcaataaatttttactgaaacacagtcatgcctgttaggttaggaactgcctagcgccacttcacactgcagtaggagagtgagtagttgtgacagagaccatttatcccacaaagcctagaatctttattataatcctgtaacagaaagcatttactgactccttagcattgccatgtttagcaaataaaattgcaggatgctggtcaggcgcggtggctcacgcctgtaatcccagcattttgggaggccaaggtgggcagattacttgaggtcaggagatcgagatcagccgggccaacctggtgagatcccatctctactaataatacaaaaaatagctggcgtggtggcgcatgtctgtaattacagttactcgggaggctgaggcaggagaatcacttgaacctgggaggcagaggttgaagtgacccaagatcaccactgcaccccagcctgggcgacagagtgagactgtgtctcaaaaacaaaatatctggctgggcacagtggctcatgcctgtaatcccagcactttgggaggctgaggtgggtggatcacttgaggtcaggagttcaagaccaggctggccaacatggcaaaaccctgtctatactaaaaatacagaaatcagtggggcatggggcgggtgctctgtagtctcagctactcaggaggctgaggcaggagaattgcttgaatccaggagacggaggttgcagtgagttgagactgtgccactacactccagcctgggcggcagagtgagacgctgtctcaaataaatacatacatacaacataaagtaagatgttaaagtaaattttaattttagataaacaatggataattttttagcaaaaggatgttccacatttaactggacattatctctgtctctctccctccttacctgcctcctatcctctcttcccaccccctacgatgtctatgtatagtttcaacctggcaaccctgtgacctcagcactaggatatggatagaaaacatagtagcccctatttacctttatcttttatctcaacccatttaaatgtcttttccttgcaatgttttgtaatattacatgtagattgtacatcgtttgtcgataaatcagtgtacaaatactaggggtgagtgtgctcaaaacttatttttactgataatagtccatgatcaaggcagtttggagaccactcaggacagggaaaacgcagactcatgtgacccatcagggcttcagggtgtcctctggtgaagggcagcagcaggacagagccccacttctagctctggctcaggttaagtgtttcagcgccctggcttctgtgtcttcatgtgcaaatggagataatagtcagcacctatgcaggttactgtgaaaacaggttggaagtatttatctacagcgtggaccagagcctctggtatgtactaggtgccctagaaatgttctttcctctgactcaaatgacaaatcagtttctagggaaaggaacgcacagcgatccccagcgcatcacgagaaatctctctccagctttgccctggctgcgctggtgactcactcggggctaaaactgtttatgtctgcggagtcagagcgttctgccctgcggtttcagttcacatggggttgggcgacacagttttgttttcactttggtttatcgtgtgagtttccatccatcaactcttttgtatctgatgttcttgggaaactttgcgggaattcacttgaaattgtccagtgaacagccattgcgagtctcatggtcagagccgggggcttcccagtgtagggtctggtcaaggaaagggccacttcctgggcctcccaaaaagaggaaggagaaggccctggcttgtggaagagtaagaggggcctcgttaatgtctcccaagcacagtaccccaactccccacatacagtcccaacccttactgcagccgggaggttaggtgtctgccgtgctcatgaacaggaagtgaacccgatcagcccccgaaggaaacatccgtctctctccttggaggagacacttgagtgtctttctctgtgtgctgcagccgttattgatatcagttcccaggcaaggttcatgctggcagaggaggccactctttctgcactggagagcaaaagccatcttatctctctgagtgcaaggtgacagtgaggagattggccctgtgtatccctcagagaccagtattccctcatttgccaatctagaaagaagactgtgtttgctgtcatttgtttcttaactcattgattctcaaacagaatcttcccagggatctgcttcatgctgtattttgtactgtgtcctgagatgatgaggattcggtgtctaccctcaagaagcatcatttagagaagaaattagaaaagtaagtgaggcaggagaacaggatctggaggcagggaatctaaggctgattcacgttgactttgtataattaaatcaaaaggaaaacaccaactttccacaactaagttataaaaggaccagaggctactccctctgcaacccctccccacttttctgagttgcagatggaaaattgaaagtacccctgattggttgctttccacgaccattcagccgtttgcataggagctgtaactttgtaacttcgcttcaccctctgattggttgcttttcacaacctatcagacatttgcataggagtgtaacttctttccacaaccaatctgactgattgtgggccattacttcatttccatgaggtgtacaccaagtggccaatgggagacctctatagggtatttaaaccccagaaaattctttaaccaggctcttgagcctctatgcttgggctgctcccaccgtttggagtgtactttccttttcagtaaatctctacttttgttgtttcattctttccttgctttgtttatgcgttttgtccaattctttattcaaaacgccaagaacctggacgccctcctccagtaacataatgaatgtctggatgtggtatgaagagtattggggtacaccacagcagcgtgtgctctgagaacacagtaaacaggcatttgatacagatcagaaggtccgtaaaggtggtatttgaactaagttttgagagctgggtaagagtttgtgaaaagacagggcttaaggaaggatatagtaagctgaaggcacaggactttagaaacacataggctataactgcaaggtgtgtctcagaaggtacatgtgacgtttcatttttatttgtttgcttttttatagtgactgcatgatcattatatgcagaagacgcttgaaggggccagattaggaagggcccatggtccacactgctttttttttttttttttttttttttttgaaacggagtatctgtctctcacccaggctggagtgcagtggcacagtcttggctcattgcaacatctgcctcctgggttcaagcaattttcttgcctcagcctcccgagtagctgggattacaggcacctgccaccacacctggctaatttttgtatttttagtagagatgaggtttcaccatgttggccaggctagtcttgaattcttgaccttaagtgatccacctgcctcggcctcccaaagtgctgggattacaggcgtgagccactgtgtatttctattaccagcctgcactgcatttctattacccgaaaacagtgtggaaaatattaattacaagggagattaaaaagtaaaactggttggttggcctgaagacccacatggtgacttcactaaagtcattgggtaagcaaagaagagcaacactctagttttcctccaagcttcaacgttttctgtttcctcctatgtcaggtcttaatttccctacctgattcaggctgcgctaagctgacttcatcatgactcctggcttccccagtccctgcttcccagcacataccatttattcagtgttggccagtgacgcctgccactgcattttattgatgaagaaatggagatctcaagaggtaaaaaaaactgactataggagccaagactagtttagagtggagtttgaatatgaacatgcctctgtctgtgaaagccagtgtcccttcagccaggatctttcctggaagaactcagtattaaggcacttgattagttcttcctgttggtggactgattgattacatttgaatctttcagcaagcttttggctgagctgggcatcttccccgccttcctccacctctgccttcaaaagcctgaatttccaaggctttctgccatgagtacttagctttgaaaaacatgagcatatttttcattcttcttgccggcctctccctgtgtcatgcctgttattcttttctccctcaacattgacctaggtcagaaggaccctattttaatgtttagcgtttgggggtcactccatagagaggggtttgtggaaatcctttttttttttttttttttttttgcttctttctgtggatctgtttggaaatgtaacattttaaagcccttcttggctggaggattttttatggtaaacataaaacgttcattgaaacattaaacattttacagctgtttttcagcacataaattttcatagacatccaccccctcactgccacaccccctcatagatttcttcttttcctcctccttctcctcctccctcttcctcctctttttccccccccttcaaatagttccaagaccagagttgagggtgggtgggtagagggctagtttacagataaaatggttggtgtagatcatctagtttggaaaaagcacattgtattttaatactaggaacgtgtgcatgccagaaacctgccaaggaaaacactcccgctgctccttccagccctgactccagctgctatgaactggaaccctgcaccacgtctcagaaggctactgggaagggccataatctgtatccatccacaaggagaggtggaggggggctactctaagaagccaaaatgctcaggaaagccagagctaagatggtgcaaaccagcatgtgatttgtccaaggacatcgttttgatatgatgaaccatgggtggtttgggcatttgtcaaagcagggtcagcagaaagctgacgtagttgggtctaaagtacaacaggactgagcatggtggctcacacctgtaattctagtgcattgggaggccaaggcaggaggattgcttgaggccaggtgttcaagaccagccttggcaatatagcaagacattgcctgtacaaaaaatttaaaaattagctgggaatgatggtgcatgcctgtagtctcagctacttgggaggctgaggcaggaggatcaactgagcccaggagtttaaggctgcagtgagccatgatcatgccactacactccagtacactccaggactttaggcctgctaaagtgcattgtagtaatactagatatcagcacccttgccatggcctcatgagcagtgaaatgaactttcttgctcctggatttttggctcttggccttgtaatttttttttttcatgggatattagtcaacatgatgtgagcagagtcttgagatgtgcttgcatgattggctttgtactcctgcatttttcccatagccaatgccttttcttcagcttgggctgcagaatgagatagatgaaacagacctgaatctgacttataccctggagccattttcagcaaacccagtcaatatcaggccaacctcaaccaattcttagactagtgagtgaggaaaataaatatttgatcttgtgaacccttgaaattttgaggttgtttgttatgcggcagtattttggcagtagctgatgaatacaccactccccatccctagtggcttcctataccatttagaataaaaatacacgctcttttccagggtctacatgtcctgaagacctgaactcctgcctgcctctcagtttatttcctacctcaagtagctgtgcccaatgtcctcccaatatcctgcaaccactctagtcttctttcttttcctgggacccacagagcctatatctgcttcaaggcttttgtacatgttgtttcttttgcctgggaagagtggtggggggcactttcttgcccattttttttttttttttttgagatggagtctcgctcttgtcatgcaggctggagtgcagtagcacgatctcggctcattgcaacctctgcctcccgggttcaagcaattctctagcctcagcctcccaaattgctgagagtacaggcatctgcgaccacacctgtctaatttcttatctttctaacacagtttaaatatcactttctcagaggcctaccctgaccatcctacttaagtaacaataataaaataaaaatacccatcatttatgaagtgctcattatgtgccagcgttcttagcatctcccaacaaccctaggagacaggcattacaatgagccttcgtaatgttcagatgaggaaactgaggctaagagagccttggcaagctgagttacttagctagcaaatggtggagtcgaattcaaaccctgcctctcctcacccactctgtttcttttcttttgagcacttaccactttctgaatatgtatacaattgtttcctcgattactgtctgcctcttcttccctagagcgtcagcccatgagcttatccagcctacagaggagatgctgcagcttggcagagcatggattgctcaacataccagagtttagtcctacctctgtctccaagctgctccatgatcaaggataaactataatctttctctctgcctcagtttttccacctgtcagtggaggggcatgctcttggatgcctgagtttttcttagactcagcatcctgcagccgaaataaccatgcttcttagtggtcctcttgcgtagcagcctaagaaactccaagtccatctgcgccgaagagtattgaacttggccagagcacttgggatctgcagaagtgtcccctgtctgttagttttttcacagactctgctctttctctcccagaccggaccctccactcctctatctcgcatttatccattgcaccccgtgtcattgccgaattcctgagctacaaaggtgaacaggcaccaaagctagggcagtgtccactcaatacatatctgatgaatgaatgaatgaaccttgtctaccacagatagctcaccacaaataaacattttaatctactataaaatagctcaaaagactctatgcaaataattactgttacccagtggtggaagtgcttcactttttatggaaagtctttcactcatttctatctgcagtatttactgggcatttttccacgccaagccctggggatacagagttaaataaaatagaagcttaatccaggcatgctggctgtaaagttcacctttcggctcctttctgccattcttattagggtcttgccccatcttggcagcaagcctgctttaccattggagacctcagctctgattacaatacgtccgtgatcaacatgccctaactggttagcagatggcagctgcatgaagtcactgggcccagataggaatcaacaagggagattaggtaaagtgcttatttgaggtgctgtcagggcccgtggcaaagggttccctcattccctctgcagttatttttcatgcacactcggattacactgctcggtgatattacatctgcatgcgtcttgccctctgacacggcaaacacagatgctgcccaaatccttgtaaagccatatatcttaagtaggaaggagcatctttgcaggggaggtgaattgatttgcaaagcagcctgacacatggtctcttatttctccttgcaatcaaataattcatctttatgcccgtagggccgtggtgaaatttgaacctgaccaaatcaacgactgcaaggtttatttgtagcagtgggatcagagaaattagccaagtgtattctaaaattatcaattgctgatcacatggtctggatgtgttttagtgcttaggggttggtggaccgaggctatggtggcatagtcctccatgaccaagggctgtctgcatgggtacgcagataaaacatgcactgccatggggtgacctgtgtgccatgcatcacacacagactactgtttaaccacctacatcataggtagatcctgcattttacaaatgaggaaacagagctcgagagaagttcaatcctcttccctacagagaggaaaggggaaaaaaatggactttcaagacagctgaaattcaaaacaaaacaatgttttaaaattgaatacagccttttgcattaaaattaccattttaataatagtttaaaagagagaaagagagagacccaaaatagtcaaactgaggttttgggttctggtgatagaatattaaatcataatgaagcatttaatgttttgttgttgttacaattgttgttttaccctagggctatgcaaagtagtttaaggatgtatttatttcagtggggaaaaaaagtggaggatatacatttggaggataaggaagcatgaattagggtggaggaagtgttttctggtctagctaaggaggaaaaattatagacctcaaaataggtgtcatttaatatatatctgtgaaaatgggccaaatagattgcctccgttaaagccgtattggatgttcaaatctcgagttacctgaaatgcaactgtacttcctatatttaaccaggctttttataaactgttcctcttaacacctcaagctgacaaccacatcctgggtggttatttaataccaagtttgactttcttcactttgagggtcctcaaaatagaaggtcagagagtagacttttaaaagtcttgcactgtttacaagtcagatgctttttggcagagtgactctcagctccccccaacaatcccttcttgtcgttcagtagtagatagactctatcagggaaaaataggagaaataaaataagacagcatatggaaggcattgctgaaagtctttttcacaccttaaaaacaaggaagaagagaaatgaaaataaaatagtgagcaacacctcggtgaaagtagaggtgtttgtacagttcagctgctgccttattcaaaaacaggaagaaaaacccactgcccaggtcagctggtgggtgatctccactgaactcctattcagaggctcagtttctctgcaggacagaaatgagaggcacaaaatttcatagctgtcttgcccctcctgtggtctgtaagaatgggaccaggactcctagttgtgaacccgaaaggatttccattaggatcaggaagtgtgagttggcttagaaaaagtaaagaaagaacagtgctgtttcatttatttatcatgtgtaagtaaactgggatttattttattttattttttattttttgtttcagtttcggggggtacatgtgtaggtctgttacatggatatcttgcaagatactgagatttgggcttcaattgaacccatcacccaaattagtaaacatagtactcaataggtagtttttcaatccttttctccttccctccctagtccccccttttgaagtccccagagtctattgttcctgtcttcatgcccatgtgtacgcagtgttgagcttcgacttgtaagtaagaacatgcggtatttggttttctgtttctgcatttattcgctcaggataatggcttcaagctgtatccacgttgctgcaaagaacatgattttcttcttttttatggctgtgtagtatttcgtggtgtatacgtaccacattttctttaactaatccaccattgatgggcacttaggatgattccatgtctttgctgttgtgggtagtgctgccaagaacgtgagtgcaggtgtctttttagtagagtgatttattttcctttgaatgtatacccactaataagattgctaggtcaaatggtaattctatttttagacctttgagaaatctccaatttatttttcatagggacaaggttgcagagaaaagagaagagtgctgtttcaaacagttgaaaccattcctacttccaaaaagaatttgactcaaaagggaatagtacactacatataaaagacagatgtatttaatttgtgtttcgaactacatatcagaaattagttagaagaagatatgagataaatatacctggaaactttatgaattatttctgacatctagcattaaatttagctgggtttcctgggagtcaaaagcaaagagttttcaaccaaaaaaaagaaacagaggtgtatagtaacacacctctgtcctgcaacataactgtaagaatttatcagattatatatatatatatttatcagattatatatatatttatcagattttatatatatatatatatatatatatatgcatatgtttgtatataaatatacatgtaaagacccaaaactcatataaaaagacaaggtgatacagcattttaaaacagtttactaaaaataacaaaacattcttccatcagtcatgcatgccttatatttatgtagatacaaaaatagagtttgatattaaacaatactccaagaaagccatttctgcagagttaaaaaatacgtaggttcagttccttaccaacacgtagacatgttgtgatgaaagaaggaaaggaaggaaggaaggaggaagggaagaaggagggagggagggaaagagagagagagaaaaggaagagaaaggattttctagaaaaagaaaggaaggagggagggaaggtaagaaagaaattaattcccattttagagtaagactggaggcagagtggtcacccagatgaaaatgaataacccaactgtgtctttcttctggtgcctccacgtggaagtgggctgccacaatacttctaaagagaattggcatttttctttaaataaggaggaggatgaggagagagacgacacaaaattcactcacagaagtgaacataaattctaacattggtaaaactttgtctttgttttaaataatcagtcagttgtctcaatccataaaagagtatctcttgtacaatgtctgcttttgagtgattcacttcgatgcgtactgaaaatatacctttaagtagttgagtgacttgaaatattggtaaatgttctttaatattttgtctgtcagtgttagagactatcaggttaaaacaaagatattctttctttcctttttgtttttgacggagtctcacactctgttgcccaggctagagtacagtgatgcgatctcagcttactgcaacctctgcctcctgggttcaagcgattcttctgcctcagccttctgagtagctgggattacaggcacacaccaccacacctggctaatttttgtatttttagtagacacgggatttcgccctgttggccaggctagtttctaactcctgacctcaggcttcccaaagtgctgagattacaggtgtgagccaccatgcctggccaagaatattctttctaatatgatttagctaacaggttcagcagatttttaaactcactttcaaatcatgataaaattctttaagataaacatttgtcttctgttttcccctgagagtggtttagcatttatggagccctgctttgtgctaatgagtttatatgccctgtcttctttaatcttcaccacaactttatgtaataagtagtctccaataaatttaatcacataattacttaaatggcctggcgagccgccttacctagctggccaggaattccaggagtcaggcttcctgatctaaatctgtcctggtcccatcttggctgggtgccaccagcagcaacggcacactccagcttaaatatcagtggggataattctaggccgtttgtctgcctggttcttccaggatagaggcagtgatttcagtaatctcttagggctgggcacggtagctcacgcctataatcccagcactttgggaggccgaggcgggtggatcacctgaggtcaggagatggagaccatcctggctaacatggtgaaaccccgtctctactaataatacaaaaacaaaattagccgggcgtgggggcaggcgcctgtaatcccagctactctggaggctgagacaggataatggtgtgaatccgggaggcggagcttgcagtgagccgagattacaccactaccctccagcctgggcgacagactccagcctgagcgacagagtgagactccgtctcaaaaaaaaagaaaaaagaaagaaagaacctcttaggcaactctcatttcattatccaggtacaaagacaatgagtaagaagagtattggggttgggaggaccagtcacccctgtgtcttaagatacttctcagttttctttgttgcagcaaatattactgcagagttttagtgcattatagccttcttaaataaaacttgcccaggtgcagtggctcatgcctgtaatcccatcacattgggaggccaaggcaggtagtttgcttgagcccaggagtttgcgaccagcctggctaacatcatgaaatcccatctctacaaaacataaacagaaattagctgggcattgtggtatgtacctgtagtcccaggtactcaggaggctgaggtgggaggattgcttgagcctgggaagtcaaggctgtagtgagcaaagatcacaccactgcagtcaagcctgggtgacagggcaagaccctatatcaaaaaaaaaaaaaaaaaaaaaaaaatatatatatatatatatatatatatatatgtatatgtatatgtatatataaatttaaggaagcatagaattgaagaggctattccaaggtcacatgacttttaagtggcagaaacaggggaattctgtctaacacaatccaatttatccatctcaagaaaagagatatgccaaagagaatgattattaaattatcattaatgtgaactcttgtaattactctcataattttctttaggcttatcccattgggcattgctaagtattattagattgtgattataaatggattccgccaggcatttctcttttgctctgtggcagctctttctctagagaacttggtccctggggatgccatcttctctgtcttcactcggtgaggatggactttaggatgcctcacttctcttcctgagattcttgcttccttcttccttaagggccactgatgagcaatcagtgagtttcaggaagaaggcattcaggctgatttcagacagcctaaggtcagtgtgcaagttagtatgtacctgtgtcttattattgaactggtgaatgaatgaatgactaggtcattatgaatttgtagatcagggttttgaagagtttggcaccggatttgaaagccaatgttctcttagtacctaccgctttcttttcctcaccttcctggatttcctgctcttaaggttttttgtttttgtttttctctccaaataaatggtatttattaaataaaaattcattttctcatttatcaaccagttgcagtctttggatgttttaattatataaaaaaagcatggaaactgggcattttaattagcaagtacagccttgacacaaataaaggcatggctttggttatgcagtgcatttatttggttttcttgaaataagaaaaaaagatttcttctccatcaccagagttgctgagtttgacagtgtgaatgagatgacctctaaggcctctacttatagatctgcacggttgggcctgggagctgtactacctcagctggtgggtgataacttactcacagtctgtgctgtgtcctgcactgtccattatctgcaggggtggtactgctgtccccagggaagagaatgctgtccacaaagagccagccatttatactattaaaagaatacacaggagttgaacaatgagaacacgtggacaacgggaggggggaacatcacacaccggggcctgtctgggggtagggggaaaggggagggagagcattaggacacatatctaatgcatgcggggcttaaaacctagatgacgggttgataggtgcagcaaaccaccatggcacatgtacacctatgtaacaaggctgcatgttctgcacatgtatcccagaacttaaagtgaaaggaaaaaaaaaagtttcatcaaaaaaaaaaaaagaaaaagaaaacaccggaaaaaagagactctcttccttgaaggatttaattccaggaattggagaatgtcttgtacatttcgagaaggcaatatagaaaatgcagtgggtagcccaggactcctggtccaggtaaagcaggccttgttgctattcccctggaccatgatattacatgttgggatgatggggtcttgtgatactgattaatttaaggctgcatgatgatgagggaggaacaaagatgttcttgagtcagtacctgccagagtggctgtatcctggtgttgtaatatcaaataattctacattatttagtaaatagccctgcccgaagcctctcagtgccacacacccactgggattcctgtgtgatttgtcacctggaggaacatcacctgccttggttggggagaggaagcctcaggaccctgcaccagggccatgtgacaaatacccattttgatagttcagtacccgctattaaatatgccgaatattattcctgaaaaggggcatggggataattacaaaaacatacctggttccactctcactttcgccatttaatagctttgggtctacaagtaaccaccccagatttttctcctcctctatgcaccagtcatatcaagaattactgtaacttcataggatttttgtcaggacgctatgatgagaagaacatatgccaaggagacagttttctggcaaatcagaggcctgtaagaaatgatggctttttgcttgtatgaccaagtctcttggagacaaggcctcatgtatgaactctgaggcatgagaaggctcagaattcaccccatcttcagtcttttatttgaaaaagggaagaatgatggaaaggggaggagagagtatataaaacacgaacggggatcctagagacttgaatttctagtatgtactgcctctggctaatagggatctttgacacatacgctttttctccctttccagctggccctgttgcttaaagtggcagaagtagatgtcatgttggcagacagttttgttcactgtcaaaactgggtttatctaatgtgtatttgaaacaaacaaaaaaaaatcaataaaatgagcagctttgggagccagggtgaaggcggttgagataggacagaactccagaggactcttaaacattattcaggaagctctgaagctccctcagtctgggattccagaaaaagattgattaggcaatagtttaccttagaccatgaggagatggactttagccagaacacactgaaaaacacgagaaaagttggaagaaggaattatttttagtgttctgagaatgctttattgatattcctatgagagtttcattggttactgacgctgtgtactgattgggtaaattctagcatttttacactcctttgtttcaccctgtttgttcattcattcttccgttaaactaccattaagcaactaccatatctaattttaaggtggtggacaaagaatcaaacctaagttggggaatgtggcctctggtgattctcagttcttggtagccatgtctcagcatagtcttctcggacacctaatactactgacctgtataatcgatagggtattgcagacatcagagcatgtgacttacgaggctagaccataaaaatattgaggcttctgccttactgatgtggatcattcactctaggaaaagccagctgccatgttgggaggatactcaagcatacccgtgtagaagaactgagcctcctgccaacagccatgtgagtgaaccacgttcgaagttgattctgcagccctagttaagccttgaggtgattgcagcctttgctgcaatcttgactggaactttatttgagcccctatctagaaccaccgagctaagctgctcacaagtttctgcaccacagaaattcttgtgcgagataataaaagttaattattgtttcagcccacttagttttgggataatttgttatacaacagtggataactgcccattcaaagagtctaaaccattaactgttcagcattaggtaagaaaaccagttaattgttactttcttaccacctaccccagcaccccagcaccccagcaccccagcatgaccaccatttagagggagctgcgcttttgcaaaggtacataggacactgtctgttgcttctgtacctcttgcctcatcagttagtggtgtgatgtgtttgcctgacaaataccatctaggaccctggctgcatgagcttgttgagacagctaaattttacaggtagttggggtttcaccatttaacccagttaactcttctataagtgccgtattaaagcaggtggtgtattttgaaagacgtatgtaaaaacatttgtatttatttatatgaatgaatacattttatttatttatataaatacattatatttattcacataaacacattttatttatataaataaatccatttttatttatttatataagtaaataaattttcctataaataatctttctgattgacagatagcgaccttcctgctatgtccttacatgacagaggaagagatcatctttcttcagcctcttctgacaagtccaccagtctcattcatgagggttccactctcatgactgaagtacctcctaaaggctccccctcctaataatatcaccttggagattagggtttccaaatatgagtttggggggacacattgattccacaacactgaccttctatcagatcagccaggatgctctttttcaaacttctgtcaatctttccccaccttcacaatgtgcccctattattattaatatttaaaatattgaagatctaattaatgttgaaatttttctttaaatcaattcatagattcattaactttgttttaaaaggaaatgttctatttccatcgtaaagggaagatcaatatgatttgccacatatagatgaagataaacctatatacaaagaaaatagaactatagtaattccatgtagctattattaccagagaatactctaagcccaatgcttgtgttctctttgggcaaatggaagatgagccacttgtagagaggtattaaaaaccaaagcaagatcttttgcaagtagattaattgggcaagacaaagggaataataactatgtcaccaaaattatttaatgcagggtccaggagccaccttaatcatccataaattggttaggcatgtttattaccacagattggaagcaggcttcccccaagtgtgtttccctttgtaatgccagtgtcgtaacgccactatctatacttttcaacacaattccaagtgctacctctgcatggcagaaactatcaaccgtggatggtttctttttagcttgtccttcccgttctacagcatggaggttaagagctctggctttggttccaatcgtgtcccctttcctccctgtgtgttattgattgacctctctgagcccattgataaatggagttaaaaatttatactcactggggtggtgagaaggttaagggcaatgatgtatacaagacattagcatttgctataaggaggatgtatctcagttgccatatttgtatcactaaccatttgaagattttgtgttcaagatttggaagagaatcttcttcccaagccagcattttatattttgcattaaaaaaaaccacaaaagacaaaaaaaaaaaaaacaaaaaaccttcacagacaaaacccagggcatattttaggtgtgtttaattcgaagctcctgatgtctagcaggaacctggaacttccctttctatttttgtgggtcaatatattcccacttttgatttaaggtagtacaagttgtatatgggtgccagttagggattcctggctgatctgtgcaattttttcagtgaagttatatgtggtgcttagtggtgactatgggaagattacacggagaagtgttagaacagggtaatcaactgggaacccatttcaggtgaatgccaagatgttttgaaggtgggcatggcagggaaataacaggatgccatgcttggtgagaaatgaattcgtaagtgtgcactgtctgccataaagagccaggcaaggcacagaaaatattcttctgtttctttttctattctaccctctctctgctttttcttctctcactgctgctgaagcagtgagagcctgttgagttaaaataagccagtgaggattttggtggtgtttgcccttgaagcctcttgacatacagtgtcatcaaggagcagtgggtgagcctgcccatatctcgggcacaaacctaggtactcattgaatcctttaaactaaccctctaaagaattctcaatctgtggatgagaaatggcaacacagggatgttaaactgcatgcctacaatcatccatttggaagaagcagggctggaatttgaacatgagactgtatgctccctgttgtagtttcctatggctgctgtaaaaagttagcacaaatgcagaggcttaagacagcacaaatgtcttatcttacagttctgaaggtttcgctccagagtgagttttatggagtgaaaatcaaaatgttggcaggccttaggggagagtccattcctttcatcttccagtctctagaggctgctggcatttttcagctcacggccacagcactctaatctctgctttcactatcccttcttttttctgtgactctgaccttcttgcttccctcttacaatgacccttttaattgcattaggcccaccaggctcatccaggatgtatttgtctgtgttcacactagtgataaagacatacccaaaactgggtaatttatcaacaaaaagagatttgatggactcacagttccatgtggctagggtgggtgcacagtcatggcggaaggcaaaaggcacatctcacacggcagcagacgagagagagtgacagccaggtgaaggagtttcccgttataaaaacattagatctcatgagacttattcactaccatgagaacaatatgggagaaatcgatcctgtgattcaattatctcccaccagggtccctcccacaacatgtgggaattatgggagctacaattcaatatgagatttggatggggacacagccaaaccatatcacaggatagttccccatatcaaggtccttaacttaatcacacttgcatttgattttatcatgcaaggtagcatactcacaggtgggattaggacttagacaccttcagcaagaaacattactcagcccaacacactcctcaaacctaagcttattcccaatcacacagtcaggagaggatgcccacaatgcacttggggttttgtgtctgtgtctcccctccaagaacaggtacttgcccttgtctttggagctcacagccaagtcctacagtcagcatcagacggcttgtctcaagctgctgatttccgggagcaaagctgctgtgggacatgagactctttgaggcagaatacctctcatgcctggagagcattacaggctgcattagtctgttttcactctgctgataaagacatacccaagactgtgcaatttacaaaagaaagaggtttaatgaactcacatttccccatgtctggggaggcctcacaatcataatggaaggggaaaggcgcatctcacgtggtggcagagaacagaagagagcttgtgcagggaaactccgctttataataccatcagatctcatgagacttattcactatcatgagcatagcacaggaaagaccctcccccatgattcagttatctcctaccaggcccctcctacaacacgtaagaattatgggagctacaattcaagatgcgatttgggtggggacagagccaaaccatattacaggctaatgactgagcgggggctgtttcttgttgtgttcttataagaactattgcattttctttttcttccaaatatagttaatggcctcatcttttctggactaggtttgtagtagaccataagcaaaagagttcagaaagcacggcctccaagaagtcggatctgcttgtctttatcaatctgtttggattttcctggcccatttactcacaaatttaaaagacatgatgagttttcagggagaactctttagcatttacattttaatttagttttgtttacctgtttagtgccctctcggttcccagaccatcaaactcaccattgtcaccggggagaaatttgtgttggctgaaatctgtagtggttggtctgctgcttttctttctctgctcatctaccctgatagtttccctgtggtttgtggtgggctcacagctcttgacctcaggactctcgctggtctagaggagattggtttgtgggggcgtctgacatgtttgggttctttgtgacatctgggccacccggttgagtctgacaagaaacacttaatacctccttggctttgaagctctcctttgtggcactacaaggtcctctttgaaatcccacattcttttttggatttaggtattaaccccttggtgtgaggagaaagataattgtcaacacacttaggagagaaatcatgcagtaaagctgacccgacatagactaacttaaaactaactagttcattagtgctaacttagttcattagtgctttatctccttgtgtgtgtgagtgtgtgaggggatcaattatatacataagacaaagaccacctaggaaatgtttgagaaactgtgcagtgaggatgaatcaacaagtaaatatcatgagaatttcttagattgaagaaatattactcctatttggtgtcaactctgtgctggccttttcactgaagttctctgatgtaactgcccacagtaatcctgtaaggtatggctaatcatttccattttatagattaggaaaccaaggtcaaaagtggtgaattgatttgaccaaaatcacagacccaggaatttcctcagccaagagcatacagcagctgtgtcttaagactgtgccctttcatccaccctcttggtactcaaagcttggtccatgaaccagcagcttcagcatctgctgagagcttgctggaggtacagaatctcaggcctgactgaccccaggcctgctgagtctgaattttaaccagagtctcttggtgactcgtgtgtactttagaaggggaactgctcaccgcccccacttcccactgagtcgaatagacattaagtgagccttccttatgtgctcagcctgtggtgaggctgcaaagacaatacgacccagcccctgtaatgcaaaattcagagcatagggcagcacactgctgccatgagtcgaggtgacacagtactaacagtgggcacagggggctcggggcacagaggaggggtgcttcccagggagactgcccgttggagcttactcctaagctaattgggaggcaggaatccactgtggctgagaacagcagctctgaatttgcactgtctggtttcaagtccaaattctactacatcccagctgtgtattgtggggcaagttacttaacctctctggcctcagtatctgtatctgtaatatggggaatcataaaagcacctacttgttaaggcatattaaatgcaacgctactttgaaggactcatggtagttaacacccagtttggtaagtgttattattgaaggctgagaacagaacgacaaacaacaatcacaacaaaaggctggggaagattttcctggtggggggaccagatgagcaatagatctccatatgcagaggggtaactgagtacgactctgggacttacactagaacattcatattgcaataaagcagatttttcctgagcacctactctgtgccaaagcactattgtaggctgtggagatagggagctgaagtactgaaagcgttacagtcaagggccagaaaaccattgttcaagcagttggcgtatggcttgatctgtgtttattacaaagcgatacttttccttctaagtactgctttacctgcatcctgcaaattttggtatgttgtattttcattctcattaattcaaaatatgttccaatttcccatgtgatttcttcttcgaccctcacatgtttattacagcatttacttgtttctgttcatccagaactcattgaatacctgctatctaccaggcagtggcctggtcacatcttctgacctcaagtagtttatagtccaaaaagacattggctctttgggatagaggcactttttgggggagagaaacatgaatgcaattttttacatagagtatgaaactctgttccaaatctctcaaactcaggttctttgattcttaaggtatttttcactgccgagttgctgtcattgaaacaaaatctgtcctggtcaccactgtatgcccagcacctagtacagtgccctgaacatattaggtactcattaaatacttgttccacgaagttgttatttggtattcacgagttttgtctcaattccttttgattcttcttttcacccatctcatgttgacttaatttctccagcattcagttaagacctagccgaagcataattgtcagcatagtagagctggctctcctctttctaattgccctgcagagtttttggggagtctgtatgcaattgtgtacaccccaatgccccaaaaccctcttctatttcctttagcactcttgagctgaagaagccccactctccctctgccccacatctattgtgggctgggatacatgttgggcctctgcccagatcatgcttggagtggcaccagctgcgtaggatatgtgaaatatttgctcagagagatccagaagggttgatgtgagtaggatcagctggtgctccaggataaaaatcgtgtcaccacttttgccgaaaagtcactgtgtttctcctgtactcagcaggttacagggtgccatattgttctcagtcttccggctctaccctgttttgaagtgcggccgggtgttgttaaacggctccgccttcctgccagaatttctccgtggggaggagctgccacccagtccagtgagtatggccttttggtcagcattgcagaacctggcaagtcctaattccctgtgagcttgacacaggaggccgcctcctcctccaggcccacttggaggcattctgtcctcttgttggaagggaaattggtatggtagggaggtgcttcttctgggagtgggtttgtaaaattaagactgttttcatccaaaccagttacctgtttgtctagaacctgtgttctctgctttctgcctcttgtgttgacatttctcctttggccttcatctgttactcgctcacatgtgccgtgccccgggtgggtttggaagccatgctgctatggtttgattcctggctttccaacattacctttgataaccaagacaagtggcagtctaagcctcagtttcctcatctgcaaaatgggtgcaattctagtacctccttcctaaggctgtgaggattcaatgaggtactgcttgcaaagtttctagcacagtgtcttgaacacggtaaacaacttacctaggtctgatctcatttgatattgttgctcatagcaaaggtttgttgagtttactatggatataacacttgttcttttttaaaataacttttaaaaacgcaagtgttgaattatctgcattgtgcctttagggcatacacatctgcttacaatattttttgagctttcagaaaacttaagatatggttgagggatgcaggaaggaacaggacaagaacccagatccctgcccaacaggacagtggaagggaagtctcagcatctcgaaatgagtgcctggagaggatgggtggcggctgtgcggggatgtggtagggtgatggtccttgaaggatgctgcagatcacagtggccccacagtgtggggattggggtgggatatgtgacaacaaaggcatccctggcagaggatccagcacgagcaaaggcagaaagtccaggaagtgtcaggaatgagaagagcccagtagaggatgggcttagggacagtgatgagaccttctggtagaggcgttgaacactagggtgagggctttgctctgacttcaggaagcaggtgagaggccctgaaatttccacgtaagattcggggccgggcacggtggctcatacttataatcccagcactttgggaggctgaggcgggtggaccacctgaggtcaggagttcgagaccagcctggccaacatggtgaaaccccatctctactaaaagtacaaaaattagccaggtgtgatagcgggcgcctgtaatcctggctactcgggaggctgaggtgggagaattgcttgaacccgggaggcagacgttgcagtgagccgagattgtgccactgcactgcagcttgggaaacagagtgagactctgtctaaaaaaaaagaagagttggatcacagcaaaggtgagctttaatgagttcactctggcagttgtgccgaggagggactggcatggagagaaaacagaggcaaaaatcacaacctctgtcagagaactcatcgcactatttctgtcctgccctgggatggtggagcctaagggaacagagaggacagagtgggtggcacaggcattgcggaggcagaaatttacgtggcttccatgcccattggtgtgaggagtgaggggtgatcagggatcccagtggcttgaaagtataacaaaagtatgactagatccaggaaatacagctggagagacccaagtctgcacagaaaaggtttacagagcccaggcacacagatgacatgagcagttccaaaggagtgggacggggtgaatgatttgtggtcagaggtgtggtcacacataccgtcccctgatagtcggtgggaactgggtcaggttccatttgccaggggcaggacatactgcgtgccttggccttttctgggctactcaaaaaaggattccaccaggtaaacttgaatcacctagcgctggtagaaagccttgctcttcgtcatctctcctgtgtgtcgctagccttattaaaatgtgcagaggagaccgggcatggtagcacacttgtaatctcagcacttggagaggctgaggtgggagaattgcttgaggctatggcttcaaaaccagcctgggcaacacagcaagaccccacgtcttaaaaaaatttagccggctgtcgtgtctcctccgtgtagtcccagctattcaggcagctgaggcaggagggctgcttgagctcaggaggtggaggctgaagtgagctgtgattgtgctgttgcactccagcctgggcgacagagggagagcttgtctccttgtctctaaaaaagaaaaacatgctcagaggccttgtgagttagctctctccaaagtttttaagacaaggaattcagttaatcaagtttgttagacttgtttgaaaaaagggcctgaacaggctcagagcaagggcagatcaagctcttccacagattttaatgttcaggttttgtgacctttactttttttattttggcaaaatgtacacaacttagtatttatcattttaatttataagtgtaaaattcatagtcattaaatatattcacaatgttgtgtaaccatcagcattacctatacctaaaatattttcatcacatcttttaaaaaataactgccccttcctcacttccccaagcttgtggtctctggtaacccctactttactttctgcatctatgaaattgttttcaaggtcaatccatattgtagcatatatcaaaatttctttctttcttcctctccttccctccctccctccctccctccttctctctctcctttcctcccttccttccttccttctttccttccttccttccatttttgacagggtctcactctgttgcccaggctggggtgcagtggcacaatcaaagctcactgcagccttgacttcctgggcttcagtgatcctcccacctcagcctcccaaggagctagaggtgcatgccaccatgcctggctttttaaatttatttttattattatttttttatttttagtagagacagattttgccgtgttgccctggctgatcttgaactcctgtgctccggtcatccacccgcctgggcttcccaaagcgctgagatgactgcgccaccacacctgccacaaaatttctttgttatggctgaataatgtttctgtgtgagtgtgtgtgtgtctgtgtgtgtgtgtgtgtgtgtgtgtgtttgaataatactcctatgaacattgtaccaatatctattcagatctctgctttcgattcttctgcatgtatacctaggagtgaaattgctgcgtcgtttcgtatctgtgtgcttaaccttttgagaaactgccaaactgtcttcaacagcagccgcatcattttacattcccaccagcagtgcatcaggattctagttgctccacatctacccaatacttattttacttaaaaaaatagaatagccatctgagtgaagtgttacctccctgcagtgttgattcccatttccctaatgatgttaagcgtactttcacgtgcctactggccgtttgtgtatcttctttggagaaagtaacatccatttttgatactcacatggctttttggttctatttttgctttcttttggctaatgataaccttccagcaccacgagtttggactgtgctaatgtcttctagtactgtttagaagttgaggtaaaaagaaaacggtaattgaaagagacagttgttgtttacattggggaggttggtattccaccccctgtgctttttcattagctgtattgtattcttattatgtgttttaccgggtaattgtaattcttggctttggattttgtcccttttttaggctgcggggcgggggggtcggttattttataagcaaagaagtacagccagtatgattctgaagcaactaggtcacagtagaaaaaagttggagagtgaaatctcaagcaagccaaaaagtgatagatgagttaaaaaaaaaaaaaaaaaaaaagttgcctggcttggtgcagtggctcatgcatgtactcccagcactttgggaggctgaggtgggcggatcatctgaggtgaggagtttgagaccacactggccaacatgttgaaacccgctctctactaaaaatacaacaattagccaggtgtggtggcgcacgcctgtaatcccagctactcaccaggctgagagtggaaaatcacttgaacttgggaggcaaaggttgcagtgagcggagactgcgccgctgcactccagcctgggtgacacagtgagacttcatctcgaggaaaaaaaaaaaaaaaggctttggagcttcctaatttctaaatagatttcctttataattttcagaggttgtgaaattaactctgtagattggggagtgtagtttgtcactctaattgcccagcgttttaattatcggcgtgttttatgcttttgtgaaatgctcatttcacagcttgctggtgggtctttttgtggaacgagaaagtgaatattcacaccagaaatgaggtactgaccctgaagggctttccagtcaaagagaaaggagagcatgacccgccaatgccgttgtttgtaagcaggaagctgacgctgcgccatggtgtaggggaggaggacggtttccattctgttttgagcatcagaataaaaccaagcaccagaaggtgtggttcaaagatgctttcctttttcagtctctggtcaatttgttgttatttttcttcaagagagttgttggggttgggtaggcgcaggggccacaaggccatctttataaggctctggcatttgatagtgaggtattttggtattccaaataattggtggaaggatggaaaggttaaatggaaattatgtaagggctgcaaagagattcatatatgactatttcatgagtgcttactatataccaggcgctgttacagcccgtgtaatgccacctgggagttggggggagtcaccatcgtccatccgtctgtccatccatccatccatcctgcctccctccatcctttctctttttcacaatgtctcttgctccgccccctctcttcccctccttccttcctatccagtgcttgtaacctgtcaagcacatgttgtagccattggggacatcgtggtaaacaaagcaaagtccttgcttgcattctgtgacagatggagataaaatgggtaattaacaaatgtaatccctcccacccaccccccacattatttatttatttatttatttatttatttatttatttatttatttatttatttttaccatgtctgttactccatcagtcaggatccagttaggagacagaaactatatcataattttaacagggaagatttaatattaagaattattagctacaacagggttttggctactaaagggtaaagagaatcaggccgagcacagtgactcatgcctgtctgtaatcccagcactttggaaggccaaggtggaaggatcgcctgagtccaggagttcgagatcagtgtggacaacatagggaggtcctgtctctacaaaaaataaaaaataaaataaaaaaataaaaataaaaataaataaaaagtagttgggcgtgtgtggtggagcatgtgggggtcccagctacttggcaggctgaagcaggaggatcgcttgagctcaagaggttgaggctgctgtgagctatgatctcacctctgtactacagcctgggtgacagagtgagaccgtgtctttaagtaaaataaaataaaaaagagtaggtcgggcatggtgggtcatgcatgtaatcccagcactttgggaatacgaggtgggccaatcactgaggtcaggagttcgagaccagcctggccaacatggtgaaaccccgtctctactaaaaatacaaaagtgagtcggggttggtggtgtgctcctgtagttccagctacttgggaggctgaggcaggagaatcacttgaatccgggagccagcggttgcagtgagcttagattgcaccactgtactccagcctgggccatagagtgagactctgtctcaaacaaaaaaaaaatttaactctaaagaatccaagaatacagatttgggagcagccagtaccaatgggggatggggcagtacacccaggaaagagcaaatctggggtccccacgggccaggactgggatctggactgggccatggcccattggatggcagaaaggttctcactgaagcccccataaaggtgggactcactgggaaaccgctctctgtggtgccagggaaggacgtctgtgggaggtgcctaccaaggaagtctctggaaatcagcctgcaggggtggagtgccgggaaactcccgccccctccccccctccccgaagtgaaccgcccacagggagatgcccctatgggagcttcgcaccagaacccgtctgcgccagtgtccctgcagcgccctctactggcgaagctggacatggcgtccgctggcaaaggggaaactcttctttcctcccaagccgagcaatgctaaatgtgcctggtactgagacgtcatctgtggacggttggcaccgatgctaatcagtgctatgggaaaataggcagagcgaggagcgtaagaattattatgtgtgctgtttgatagagactgtacaaggaagacctctctaaaaaggtgacatttggagcagagacatgaaggaagggattgctggaggcagaacattctaggcagaaggaaccgcacgtgcaaaggccctcaggtcagccggcatggcatgcaagtaagccagctgcaacacagcaggtgtggatgaagggaagagaattagcatttggccagagcacgcattttaagggatggagatccatttggatagtcttgaacacagaactgaccggaactgacttactctttgaaaagatcgctctggctgctgtgttgagtggattggtaagggataggtggtgaagactgaaacagggtatccagttaggaagctatcacagtgatccaacccccagcttctgttgaggttgaagaacatgcatgcccaacctaaatatatgttcaaaggtggttattactgtttgaggtgatgaaagagttttggagatagaagtgatggttgttcaacatcatgagtgtaattaatgccacggaattgtatccttaaaaatgcttaaaatgcgctgggtgcggtggctcacgcctgtaatcccagcactttgggaggctgagatgggcggatcacttgaggtcaggagttcgagaccagcctggccagcatggtgaaaccccgtttctactagaaatacaaaaattgggcgggcattgtggtgggtgtctgtaatcccagctatttggaaggctgaagcaggagaattgcttgagcctaggaggtggaggttgcagtgagccaagattgtgccactgcacttcagcttgggcaacagagtaagactctgtctcacaataaataaataaataaataaataaataaataaataaataagagttggatcacagcaaaggtgagctttaacgagttcagtctagctctctcacaaaaaaaaagttaaaatgacaaattttgtgttacatacattgtactacaataaaaaccatttttttgaaaagaatagtacaaaaatgatacttccctctcagtgtattttaccaagggattattagtgtatatgtgtgttcttactggaaatgttaattggacctgtaattctttttttaacttttattttgggttcaggggtacatgtgcaggtttgttatataggtaacttcatgtcacaaaggtttgttgaacagattatttcatcacccaggtaataagccttgtatccaatagttatttttctgatcctctccttcctctctccctctaccctcaggcaggccccagtgtctgttgttctttctttgtgtccttgagttttcatcatttagcttccacttgtaagtgaggccatgcagtatttgattttctcttcctgcattagtttgctgaggataatggcttctagccccgtccgtgttctcgcagaagacatgatcgcattcttttatatggctgcatagtattccatggtgtatattcactactttttttttaatccaatctgtcatttgtggacatttaggttgattccagtagacgtgtaattcttcttggaaatgttaatcttgatcatttggttaatgtgatgacttctgggttctgcagtgtgaagttattatcttcccttttgtaggtaacaaatactttggaagagattaaacaaacaaataaaaaagtggtgattgttattaccagcatggctactactagctaattccaggcttcaagccactggggcataggcatatgtttagctcattccacaggaggggaacagaggctcaaagaacctaggtaagttggctaggcgcggtggctcacacctgtaatctcagcgctttgtggggcttaggcaggaggattgcttgagctcagaagtttgagaccagcctggacaacatagcgtgaacttgtatctacttaaagtaaaaatcaaaaaaataatggggtgcagtggtacatggctgtagtcccaattactcaggaggtggaggtgggaggattgcttgggcccaggaggctgaggctgcagaaagctgtcatcatgccgctgtgctccagcctgggcatcaaggtctgttttgcagaccttgtctccaaagcaaaacaaacaaacaaaagaaacaaacaaacaaacaaaaagaaattaggtaacttgctcagtggctagtgagtggctagattgtaagcttcatgagggcaggggactttgacgattttgtcggtatcctaagccgctagaacagtgcctaaacatttgttgggcagttaatatatatttgttctattaataagtagagcccgagtttgtgttctccgattccacaccccatgttccttctactacaacttctggctctggcttctggactgtcagtcattagcactccctatccctaaggtttcaggaatgttcagctgtttcctagcttggaatggaccatcctctggtcccacccatgggtaagtcattggctgcagagcgcagacatttggctcccctcgggacattcctccctcatttaaaacaatgaggcgggcagcagggtactttgtcccttgtgttagctgaagttggaggatgctgtgttgatgggaaaacgctgttactattcttagactagtggggctctcacttattcatagctccgcactcgtgggtggaatgagaagttataatagagtgcaggtgcctctcattgttttccgctactcactggatagtgtttattaaaaacgaaatcacagtggtgtgtctggagttgaagtctgaacaaataacccaaaatgaggagtccctggaaggtgggcaggaggcgacaaacaaagagaagcaaaaacaagtttgagctaattgggatcaggcagtactttgcatgtgagttctgaacagggagcttggctgcaaaacgattattgtatttaacttctgttggcatcattcgcatacttgtatgggagatccagaattggaatttaacacagttttcccaggcccttcatggaatttgaaaacatgactctgaaagcatgtggctgaaatgagactctttcacactgtttaaagatgcatgtgcatatgttggtgtccacacatcaacttaattttttcatgttccttgaaggaagcccgtctaggtccttctgaaagaagggctggagatttttattaaacattacttctaggctgggtgcagtgactcatccctgcaatcccagtactttgggaggccaaggcaggcagatcatgaggtcaggagatggagaccatcctggccaacatggtgaaaccctgtctctactcaaaatacaaaaattagctgggcgtggtagcaggcgcctgtaatcccagctactcaggaggctgaaaaaggagaatcgcttgaatcagggagtcggagttttcagtgagccgagatcgcgccactgcactccagtctggtgacagagcgagacaatgtctcaaaaaaaaagaaagagttctgaatgatgataggtgttggaatccacgttggtgtgtctcatgtcattttttcgggcagtttcttgacagacccattttgtgtgtgtgtgtgtgtgtgtgtgtgtgtgtgtgtgcgcgtgcgcacacgcatgagcctgtacgtgtccccctccccccccacacatatgcacataagatagcataaggtagttcctggcacatggcgttgttcttaaccatgaggtgctcccaggctccgggcagttccttgaaagactcattgtctgtgtggggggaggggaggctgtacatgtccccacccaacacacacacatacacacacatgggcacatatgatagcataaggcaattcctggcacatggcattgttctgaactgtgaggtgctcccaggagatcttgtgcttcctatcacatgcccattctgcaagtccatccccttattgagcagatgtttaccgcagagcactaagacagatggaacgtcaccgttgcccatagcactcatggacagcatggggtcccctgtagcagatatttgtggtgtatgctcgaagaggggctgcaggtagaactagaaaggtaggtaagttgggcagatggcgagagacatcacagccctcactcctgagggtggggagccatctcaggctcaggagaagaagagtgacagagtcaccaactcactccatcaaatgtggctgtatttttagaagtgtctggttcctgaaatacctcaattccttttgcctgcctggctcctctcctctcttctgcctgttcattgaactgaaagattatcaggactgtattcagcccggccaataatatcacaaaacaaaaatatcttgtgggtttgaaatttatgagtgttttgactgttcacagcaatgcctttgagaatcacagtgtgtcatcccctccccacccccacgaacatgtagtttttgggcaacttttcgatgagtaaaacagggcctgacttttaccccaaagtgatgttcttttgtggcttgtctactccaagaactgagatacccagactcatttctcatctcttgttgaaacagagaagtcactgtagcgccctccggggggtggggtatcaagggagagtatgggctttgaaactgctcatcccgtctacaaccttggagggcatggtgtttcactcccccacctctccccacaacttcaccctgctccaatgaggatgaaaatgtctttcttatagatgggacaggagccttagtaatatggtgcgagcaatggttcacataggggacaggtgttcattcaatggtgggtattattataataatcattagcatcattgctagtgactttatttttcctttagccaatggagcagtggcttttggcccactactttcgactgaatctatgagtgaatgtgatcctccgttttaaccctgtcttattggatgttggtaaacagtatatcatgagcccctgtaagagcttgaatccttcaaagacaaggtcagtcagtggccatcactactctaaacgtaagaccctgtgatgactgacacttactaggtttctcatttatttatttttctctgcaggacacagctatgtgttccaaagatggtcttaaacctataggagtataacaccatggctagttcagaaaaccttattccaacttccaaacttagaagatactgggaagtaaaagggagagaagggaatgcatggcttgggctaaaaaaatgattctgcattcatctcagaaggatgttttccagtctttctctagaaacaacttttgtgtctaaggattgtgggtgaacaacagcagcacaggctacattggcttggctcggtggttgggatggtttggctcttactgggcagtaagcacagtggctgggataggaccttggcatctcgtgcgaagcccctctgcctggagtcctgcctctgtgacacttgcttactgtgtgacctgggtcaactcatacctactgttcgtcagttttctcatctgtaaaatggggattccagtggttattatgagaattaaatatgacgatacataaatagcacctggaaaagtgtttaggaaaccttgacatgatgacctgtttagcagcagcagtgtgtgccatacttacctttatggaatgaacagatttggagtgaggatggatgtttagctcactttattagtctggtctcacactgctataaaaaactgcccgagattgggaaatttataaagaaaagaggtttaattgactcacaattctgcatggtcggggaagcctcagaaaacttacgatcatggtggaaaggaagctagtgcaccttacatggcggcaggcaagaggggcagggagggagagagaaagagggagggaggaaaccaccacatataaaaccatcagatcgcgtaagaactcgctatgtcaagaatagaatgggggaaccacccccatcatccagtcacctcctaccaggtctctcccctaacatgtggggattacagcttgtattacaattcgagatgagatttgggtggggacacagccaaaccataccactcatggcatctcgtttttacagagtatatgtgttttcagattttgcatgacattttaggataaatgtgatgaaaatgaggaaaattgggaatgaagtttaggtcagaaaagtttcagtgattattttttcagaatcattgtttcttggtttctagggtccaacatgccattgttcaatggctgtatttcaatggctgtatttcagaggctgtattttttttcccatctcttccttcctacttagaagacagtgacatttcctctgtgcctctcaggtgtcaatgccatccaacaggaatttgtacaaagaaagggaggactttctgatgatgttgtccaggacagtggccccatgtagctactgagcacttgaaacgtgactagtatgaccaggggctggacttttagtttaattttttgtaatttaaataatttaagtagctgatgtgtctagtggctgtcgtattggaaagcacagagtagacattgcaaatacagacgtagaaagacaccgtgcctgctgctaagaggcccctggtcctactgagtggtcagctgtttacactgacagtcccagcgtggtataataagcattaacacagagacatgtacagggtgctgagaaagctaatttttgcaatagtcaaaaaagacctcagggcagactccccagcacagagttccaagcctttacctaaaaaggtaatcattttataagtacctattatgtgccagatactaggataggcactttgcatagaaactcacatttcgactgggcctggtggctcacgcctgtaatcccagcactttgggaggccggggcaggcagatcatgaggtcaagagatcaagagcatcccggccagcatggtgaaaccctgtctgtacaaaaaatataaaaatgagctgggtgtggtggcacatacctgtagttccaactgctcagaatgctaaggtaggagaatcgcttgaacccaggaggtggaagttgtagtgagccaagatcgcatcactgcactccagcctgggtgacagagtgagactccatctgaaaaaaaaaaaaaaaaaaaagacatttacattttatctttactgtagctatggctgcctatcccaaggatgggaagtctgaagttcaaactggtgatgatccccaccccaagtcacacagttagctttatagttaaatcagggtgtgcctgatttcctagccataccaggcagcctatttcttgaataacctcccatcccctgtgtctcctttgtggagctcttggcaatactctggtgattggtaaccactgatacgccgccagcagtccacgcttgggtggaaggcaggtttcacgtaactgatttaccacttggtaaaggaacgaggtgacagcaagaccacaaactaataaatatgccggtattgacataatgtcggacctcagtatgattgatgcatgtgttgttgactgggatgtcacatgttcaggctgtaatcctggtctcagtatgactgtgaggacggggccaagtcatttcacaatttgggtgagtgttccaagcttctcagaagagcgacgcaatagaaattcaaggtatgaaattcaaggtgtggtctcagagtcattttatcttacagcttctctgctgtgttttctcagtatgtgaaatgggaacatcacttaccatctactcacctcctgtttgagttcaagggaaggtttgcagattggcctgaaggaagacttctcttgaaaaactcaaaccaaagagcacaccgccgtccccaaccctgagccatttctgtccttttcatggaaagggaactgtgttcgccagctcgtaaagccccggcgtctcctcctagaagaaacacccacattgacccagcagtgttcattttcccataaggtggtgctggatagggataggatgtcgccccttgttcaccccttggcaataatctgtttgattcactccaaatgctgcttctgatctccatctatttcaggggatgaccagtctgaataaaaccaatgagcttaatctacttgtggaatgttatagccggaagggattcatagagatcactctatcgcctaaaattctctcttctacatatctcagtgttggaaaacataaatgtgactccaacttgtcttttttgttgtttgtttttgagacagggtctttgtttcccaggctggagtgcagtggcatgatcttggctcagtacaacatctgcctccctggctcaagggatcctcccatctcagcctcctgagtagctgggactacaggtgcatgccaccacacctggctaacttttatttatttttagtagagaggcagttttgctgtgttgcccagactggtcttgaactcttgagctcaagaaatccttccacctcagcttgacattacaggtaagagccaccgtgtccggcccccctttcttcttttttaaagtggggtattaaggctcagaaaagagtgtttctgccactgcagaggattgctgacattattagttgctcactctgtccaaggcattgtgctcagctctttgtacagattgtttaaccctcacaagtctatgaatagagtatattacccacttcattttaagtaggaaattgaagctcagggaatcgtagcagagggccccagttcacactgctgatcagtgatgcgactgggatcaccacagcccatctggttcagaagcttgttctcctaaccaggatgtgagagacattcttgtcctaggcagcacgttggtggcagaggtgggatctagactgaggctctcattctgtaccctctctggccccaaggaaggaaaggggaaggagaagggcctttgggactgggtggatgtaacactttctgccacctctactcttcctgctatagattaaaacagaagctctgaattgcagccacaaatcaataatgaaaagctaccagaccaagccctttcttgtttagtgttgtgtcttctgtgtcaacatctctggaacatagtcaatggcagtacccagtagaagccatatggatactttttctcaagtgttgaaataaattaatggtgtggccatggttctcgtacttcaggtccctgtgagcccctggggtcctacacaacttggggtaatgctatggtcacctgcatcccctcctctccagccctcacctggttttctcttctccttccaagaaaaaacacccataccattcttaacatctctggaagctgggggtcaggagagggagatccataaagttcttgtcttccccgactcaagaagcttaagggtacattcactcactcatgaattgactggtttattcattcactggttgattaattcattcattcactggttaattaattaattcatgtcatcctttggatgtcttgcagagctgagtgctgaaataaaatgataaacaagtcaaaaacaaaaaggcctctgacttaacaggacttccgtgatgcgggggaagaagacaataggcaagtaagcaagtaaatatacaagataaatagaaactgtgatgagggagttaaagaaattaaactggtccttgtggaagcaacttcgggggaggaggaaagacagggaagaccattttaaggaggtgatgtttgaacttaagaatcaaaaacagtgcaagcgctgcatgggggagaacagtctaggcaaggtgaacggaagtgcagggtccctgaggcagaaaggagctcagcctctttgttagctagaacaagaaaggggcccgtatggctagcataggatgggataggggatcgtggtggataccagctaggatttcactgtaaaagaagaaaggaagccactgaagggcattaagcagggcagtgatgttttttaaagatctgtctggctgccttggggagcatgggttcagagagcagcagcagaagtgtgcaggatgacttggactgtcaccttggggccagcctgcagactggtgtggccgaaggagtgccgtgactcctctgccacctctccacatttggaagattgttttgcagctgcaacctcaaaacagaagcctcctaattaccaggtagctttctagagccaaacaaatgctgttgtttctgacaggtaaatcaagacagggaaatgatgacacattcaccacaactgaagtgttgatggggtgtgttgtgacccctggcttgttccaaagcctatgtgggtgggaattctttaatgtctgcctggaactgggcactcagctataaatagagctattttggaaattctgcacctcaatttctaaaaagttggaaggacaggaaaggggagctgtgtttgagatctcagaaatctgcaccccaccttgctatccaccactggtattccgtcagtcttactaccccctcccacctctagcccaccctctaccatcctcaccaggaaggaggctgcattcatttcaagaactgcttttcttttatcagctggcattactaggtatagacattatgaccctttaatgggcgatgggttaatacctgttgcttttgtgtgcttcctatttaaaacatgtttatctatcccccacccccactttatccaaaagttattcagtgttttacaaagacatgaatattgggccgggcttggtggctcatgcctctaatcctacctgaagcaagagaatcgcctgaacttgggaggtagaggatgcagtgagctgagatggcacccctgcactccagtctgggcaacagagcgaggctccatctcaaataaaattagtcagtcaaagacatgaatattttcttctaagtagaagtaatgatgacgatgatggtagcagttatgagcaggtaacatgcattgaacacttatttgctccatgcaatgttcacaggtctttacatgtaaaaacaaccctgtaaaataaataacattattctcttcattctccaagtaagctgaggcagaggattccagcacaagcaatttggttccaaaacctgcccttttaacctctaccagattttggtgaactctctgtctttggaagggtaggtggcggctgcggggagaaatagatgaagctgttacatttggcagcaaatgtaaatcaccaccttcactggctttaatttccccctccagccttctcgccttgccatcaccttcaccctgtccttcctcttcaggccacctatcccttccgattgaccccactggacttctctgctcctggcttctgtcttccctctagtgaccgctgtctttaccttcagctgcacgagctttttcaagaaccttcttgctccctctccatcctctctgttttcctacttttctttggccactgtttttgccacagcttctaggatttctctttcccacaatctaggagaaaggtagagctctcttatgctggggcaacgctaccaacattggtattccacagcattccaacgattctaaatactctcccagagtagggaggaaaaatcatccaaactacttggtaattgaattcaagagtgatggaccaaaaattattaatgcattcccttccgtccaccagccaaagaggattccatctttattctcctcccaaatgcaggctccattaaccttttacctttctttctttccggtctttcttttctatatctttttttttttttttttgcatttttccaattgtgatcatactatatatgcaatttgaggtatttcagacaacattattacatcattacagaagtctcatatgctgtattttataaatatgtgatgcaatcaatcattgataagatgtactgttattttatgtttcactaagagtgcgaagaacattgttaattatacaatgatccaaaaatgtcttctctctcagaatgtattgttttatatctattacaaaggctcttttgacttaggcatagatttctcatacatcaggccatttctatgcctgcctgtgaacacagggattttgaattacaatactgaatcctagtgtgatctttctgaagtcattttaattatcacttaaactcaatatggaaagcatcagcaatgcacctatatgcacaaaaatgagcagctatgatcaagttatcaggaaaaaccaaaacaaaacaaaagcacatctccatcatttataatggcccatcatttataatggctgcctgataattggagatacatgcaccagacttgacttaactgttctcttagtcatcagacatttagatttcaacaggctcctgttaagctctccttacagtgtgtgtggcactgtgcagttgaatgaaacatgccatggccagtggagacaggcttgggctgatggagagggcctacagggccaggccttgaaggggagggaaattgttagctacacgaccaagagacagaagagaggaaggagtttgtacccacaactcagctttattttatgtaagctctttctgcaaagggaaagtagctctttgtaccaaagcaagggcctctgaatgagagctgggagaggccagaatgggcctgtaagaggttgatgtgtatgagacctgaagccctatgcctttgggaaggagaggaaggagtaatatttgtgtggtacaaaggatgtgcctggcataccccatatcttttacaaagacataaatgtcttctgaataaaagtatgatgatgatgatcatggtgatgaagatgagggtgatgatgttgatgttgatgatgatggtgatggtgatgatggtagtatgataatgctgatggtggtgatggtgataggagggtgatggtgatgatgatggtgataagatgctgatggtggtgatgatgatggtgatatgacgctgatgatggtgatgacgatgataatggtgatgatggtgatgacgatggtgatgatgatgtcgataatgatggtgatgctggtgctgttggtgatggtgatgctggtgatgatgataatgatagtggtgataatgttggtgatggtgggatgatgttgatgttgatgataatgatgatgatagtgatgatgatatcaacagataccatgtactgagcacttactttgtaccatgcaatgcttatggttttttaaatgcatttacaccaaattcttataacaaccctataagtcagtgccattgcttttcccatgtaacgtgcacatcattcaatcactcaacccttgtcataggtagatactattatcctccttttatagatgaggaaaccttggcttagaagggataagctcaagttcacaggcagaaaagagacagccagtcaagccctgactccttttgtgaccctgatgagattacaggtcctcagtctcctcattgtatctgaagactaaagaatcagaaatctgtgactccacttagtttttctccacccaggagcccttaggccgctggtgagtgaagttcttacccattagggattattaatatactagataagagtacagtctctggagctaggcttgtgactttgaacaaattattttatctctctgagctcagtctcctcatctacaaagggggaattgataataggaattgtcgcaaagagctgttttaaagattaaatgagataatagatataaagcacttagaagagagtttggcatttgctaggctcacagtcagtgtcagtggttcccaatgttactgttttagctgcccccagtcaggtggttgatgagttggggagcctggtgggcagtctggaagagagcacagtgactgcaaggtcagctcctgaccttcataataaggactcacatgtgtcggtcccaaggatccccaagggatactcatggttgaaggtgtctatgtgttctccttggtgtccagcgaatgcctcttgacaatctgtggtcatactcacaacctatgaccacatacgaggaagcgaggtgtcccttttgcagttgttcagaaggtcccgtgggcaggagcagccagaggaacatgaaaccagctcgtaggtggtacttgtggcaacagcagttatagccaaggagaagttaaattctaaagacttgggcagtctccagggaatatactaactgagaaataacatccataaaaataattcaatactagtatgtaaaactaaaaacaataaccaagtgtgactggctgtctaagaattaagcaaagtaagatgaagtgtcttttgctagcaggcgctctcagcaaaggagataaggctgcagtaattctcttcccaccttcgatgggcaggtgcaacctttggctgcagaaattctcacttcccagcagcagctttgagcaccctgctctgaatgtttcttgggcagcagcagctagggaagaaactcagttaaggctgtttgaggacccaaggtggtctcactctgcaacacacatcggcagccagtggtgtgctggtaaatgattaacaactggctctctgaaaaacaaacaaacacattgtgcacctatacatgtacacacacagcttattatttattatttctctgaaatatgggtagcatataatttacaaataagaagaagaatagtatacacagtactgtttcttataaattcgagatagtcagtttttaccaaatgcttctgatttttgctgcgctattatatccattacaaaaccattgttgcagtataaaattgcagtatgtagctgtgacatgaatattggttgatattttcatttttattaagaagtaaggcaaaaacaaaataagacatatgtcagaacttcacttatccttctttgctgaattggataatggttttaaaataccaaaaaatatttcttcaatttttttctgctactcataatgtagcatctgtagagcgacacacttttgaatttgagttaatatttcttttttattttattttattttttgagatggagtctcattctgtcgcccaggctggagtgcagtggcgcgatctctgctcaccgcaacctccgcctcctgggttcaagcgattctcatggcttagcctcctgagtagctgggaatacaggcacccaccaccacgcctggctaattgtttttgaatttttagtagaggcgagattttcccgtgttggccaggctggttttgaactcctgccctccggtgatctgcctgtctccgcctcccaaagtgctgggattacaggcgtgagccaccgcgcctggcctgaattaatattttctaccccactttcttaagtcgagacaatcaataaagcaataaatgacacctggatttgtagcgaatgtctatttccatggtgtaaatagtggtaccctgagcaattttaagttataaatatgagatcactgaaagtggagttggggaacacgttattatatagtattttcaccacacacaggatacagtcaatgacttcaagagcataggtaacagtaaaatgtagtaaaacaatttagaagtcatgagttttgagtacttagtactttttagtatgatttatttaatagtaaccttatataatgtttttcttttaattgttttattgagatgtatttcatacactttccaataagcccatttgaagtgtaacattcaactttttttagtatattcgcatggttatgtaattttcatcaaaatctaattttagagtatctttttgtccccgtaaaagtaactctgtgcccatagttggcagtttgtcatatcactcaatcactgtttcctttaaagagcttatcattaaagacagcaggcagttacacaacatcttctacatgccaagaatgtttctaatacatgctttatggatttttaaattgtggtaagatttacataatgtaaaatttaccactttggggctgggcgtggtgactcacgcctgtaatcccaacactttgggaggctgaggtgggtggatcacttggggtgaagagttagagatgagcctgggcaacatgatgaaaccctgtctctactaaaaatacacaaattagccaggtgtggtgctgggtgcctgtaatcccaggtattcaggaggctgaggcaggagaatcgcttgaacctgggaggcggaggttgcagtgagccaagattgcaccactggactccagcctgggcgacagagtgagactgtgtctcaaaaacaaaaataaaacaaacaaaacaaaaaaagttcaccactttgaccattttaaagtgtaaaattcagtgacttttaatacgttcacaatatcgtgccacaatcagcagccatttcagaacatttttaccatcccccgctaaagaaacaccatatccattaagtggtcattccccatttcctccttcccccagcccctcataaccacatctactttgtgtctctatagatttgactattctggatatctcatataaatggaatcacacaatatgtggccttttgtgtctggcttcttgcttttagcatgctttcaaggttcatccatgttgtagaatgtatcagtacttcattctttttatggttgagtgatattctgttacatggatataccactttttgtttatccatttgccagtgggtggtcattgtgtttctacttgttggctgttacgaattatgctgctatgatcatacatgtactgtttttatgttttctgcaaactcctgttttccattcttgggcatattttggggagtggcattgctgggtaatatggcaattttatatttaactttcagaggagccaccaaattgttttccacggaggctgcaccattttatatttccacttgcagtatatgaaggttccaatttctccacatccttgccaacactttattttctgttttctttgaaggtatgaaattgtatcgtggttttgatttgcatttccctcatgattaatgatgttgagtatttttatgtggttattggttatttgtatcttttttaaaatagaaatgttgattcaagtcctttgcccagtttttaactgggtcatctggcttttgttgttgagttgtaaaagttgtttatatattttggatactagacccttatcgtataaatcctttgcaaacattttctctcaatctatgggtaggcttttttactctttttatagtgtcttttgatgaacaaagattttaaatcttgatgaagtcccctttatctattttggatgttgttgcttctgtttttggtgttgtatctaagaatccattgccaaatccaaggacataaacatttactcctgtggtgttatgatatatatagggttcctggctcataactctcatagcccttgttgcagtctattgttacaatattgcctgtgttaggcatcaggaaacagaatctctttgtctcctgtccttctttcacctgccccaaggcaggactctaatcttccccacctttttgattgtgagtcttcagaccctccccagagagtcagtcctgccttatgccctggggaaaggaatgctgacctcatgaagctcccataaaaacccaagagggctgggtttgggagcttccagatagctgaagacaaggaggttcctggagcgtggctgcctaggaagggctggaaagctccatgcccctaccccatacctcgccctatgtgtcttttcatctctgtccttagtactgtcctttataataaagcagtaaggggtagcaagtgttttcctgagttctgtcatctgctccagcaaattaatcaaacccaaagagggggttatgggaacttccacctgaagcccctcagccagacattctgaagtctctgacttgctattggtgtctgggggtatggggggcagtcttggggactgagcctccaacctccaactaactccacgtagacagtgtcaggattgaattggaggactcccagctgctgtcccctgcttagtatgtggggaaagttgagttgtaaaagttgtttatatattttggaaactagacccttatcatataaatgatttgcaaacattttctctcattctgtgggtagtctttttattcttttgatatcatctcgtgatgcacaaaagttttaacaacaaaagtttgggtgttgtatctaagaatccattgtcaaatccaaggtcatgaacgtttacctctgtggtgtcacccctcctctcgcatttggtgagaggagtcttctgtgttgattgtcatggtggtgtgagagcagaagggaaacatggtttcagaaaagagtttttccctgaaaccacccctctattttcttctcagacttttatagttttagcacttatgttaagacttttgatccattttacgtcaatttttctatatagtttaaggtaggcattcaactttgttcttttgaatgtgaatatccatttgtcccagaagcattgattaaaaaagataattctttctctattaaatggtctttgcacccttatcagagatcaattggccataaatgtaagtatttctttctggactctgaattatatcccattgatctgtatgcctgtccttatgccattgccacattgttttggttactgtactctgtgtaagttttgaaatttggaattgtgaattctccaactttgttcttcattttcaagattgttttgggtattctgggtcccttgtatttccatttgaattttaagatcaatataatttaaattttaatcatggcagtgttcaataactggcttgcatattttttgaacagtcatcagctcttgtgagccacggttggccagctcccaaacaccatgacatacaacttgcaggaaaagctcattttccagtttttccccctccagctgtaggggatatattttcgttaattcctgtgaccatatggcagcatggttaggatcttgggcttccaaatcagacagttgtaaacttaaactccaattctgccacttattgtgtcactttggacaagttacttcacctctccaagcctcagtttccctgactataaaatgctaacaatagttgttctttccttattggacactcaagaggattaaatattattcatgtaaggctcttagtataacaccttgcacataggaagcatttaatacctaaaatcgagtactgttattgtttcaggattattattttttttaaatttattttatttttttgggacagggtcttgctctgttgcccgggctggagtgcagtggtgcgatctcagctcactgcaacctgcttcctgggttcaggtgattgtcctgcctcagcctccctagtagctgggattacaggcgcacgccagcacgcctgactgatttctgtattttcagtagagatggggtttcatcatgttggccaggctgctctcaaactcctgacatcaagtgatttgcccgccccagcctcccaaagtgctgggattacaggtgtgagccaccgtgcccagctcagcattattatttttagtctacacacagtgaacttaaatctcctctagaaaagtcagaaggtctacctacaactttaagagttcagccaaaagagaccagtatctactaccgtggacaaccctatttaacatggaggagataagcagaaactgaaaagaggagcctgttttctctctggcagattaattttctttctttcttcacccatgccttggacatgaaacacaagtacaaaggttcagagaaaatcaaaacaagactgtggtttacaaataagtagtactagtaacatctcactgttggctgggcacagtgactcatgcctgtaaccctagcactttgggaggcagaagtgggaggatcacttaagcctagggttgaagaccagcctgggcaacatggtgaaacctcatttctacaaaaaatacaaaaattagccgggcgttttggtgcttgcttgtggtcccagctactcaggaggctgaggtgggaggatcacctgagcccaggagatggaggttgcagtgagccaagattacaccattgcactccaccctgggtgacagatccagaccctgtctcaaaaaaaaaaaaaaaaaaaaaaagtgaaaaaaaggaaaatcttcgttgttcttcatcagaagcctccacacagggcccctgaaggaagggcagggaagaagggggttggaggtcagtgggaggaataactctgtgactcagtgctttcctgactaccatctggatgtgggctgtatctgcgtaaggtgccgggacagggcggcctcatgaactcatgggaagcaaacacacaccctccctccgatccaccaggcactcgggtttcctgtgtgtctggtgatgtgctgggtgttgtggatctggactcaacggcagtctcaggtttatgtattaggaagcattcagcaggcaggagcagccgatctgagactggcatgggcagtggagacatcattcatctcctgaaacgtaatttggaggagactgttccagggctggctgagtgactccttgatgtcagcactttgccctgtcgtggtcttggcctttctcttgtgttccccagatgggtttcactgctctaaggatcataccttcgcaggccatctgaagttagtgaatctgaggcaaacagaagggctgggtgcggtggctcatacctgtaatcccagcactttgggataatgagatgggtggatcacctgaggtcagaagttcgagaccagcctggccaacatgatgaaaccccgtctctactaaaaatgcaaaaaattagctgggatttggtggcgcctgcctataattgcagctacttggaaggctgaggcgggagaatcacttgaaccggagaggcagaggttgcagtgagccgagatcgcgccactgcactgcagcctgggcgacagtgaaacttttgtctcaaaaacaacaacaacaacaacaacaaacaaacaagaaacaaaaaatacatagaagaggccttctcttcacaagtttttcttattgttttttgtttttttaagggaggaaatttctttcagaagtcagtactggacattcccttatttcaccttgagctacacatcccatagtcagcttagccctgtccctggtgcgggggagcaggacggttgcctgtatcccttagtcattgccgcaggcttgctgcatcacaaaccaccattagacctcagtggcccgcagcaataaacattcgattctcgccatctctgggtttgaggtgaccttggctaagctcccctgcattgctctgctcatctttctcacgagtctggcaatggggctgggaatgggctgatctaggctggacttggctggagtaacccagccccaccttggatctctctcctctacttcccacatgtatccttttcatggttaaaggtagaaacagaaaaaaacaggcagaaacataaaaagctcggagatggcttcctattgcttcttcattctgggccagagcaaatcatatggtcgtactccagggtgaggaagtatgtcccacttacagactgaaaaggtgctgcaagtctgcacggcagagggcatggataaggggttcgtaaaaacttagggccatttaatacaaatttgtcacatcacactggcttggattgattttgattcattgctctgtcgcccaaacagaattataattattttagtaaggaaagaggaaggatacctttggggcagacaatggatagagcttactatacaagtctatagaggcatctcacctgtagaaatcttaagatgagggttagccaaagcaaagagtggttcagggtgggaaagccaaggaaggccaggatcctcaccaagattgccagcagggagctctgattgtccacagctctgctctctgctcaccccggggatttagcagtaacagaatccacactagaaggacagagtgctgtacagacagaaggaaagacgcagacccaaaccttgataaccatggcaatgcaataggaaatctctttatttcgttggtgctcaagtgataccattaagtcccttaagatgcggaatttccttgcccccgctgccccctttctttctttcatcttatctatatatctgtatctatatctaatctattttttgagaaaggctctcactctgttgctcaggctggagtgaagtgatgcaatctcaggtcactgcaactgctgtctcatgggatcaagtgatcttcacacctcagcctcccaagtaactgggaccacaatgcccagctaatttttatatttttttgtagagacggtgttttgccatgttgcactggctggtctggaactcctgggctcaggagatctgcctgcctcagcctcccagagtgctgggattccaggcgtgagtcaccatgccaggcccctgcctctgtttaaatgctcaaacttggtatggaactgcacagactatacggctgctctccactcaagaatacaaattgaacattgactttcctcattttttatccagttttgctttccagagacccagatatggcttcattttttaaatgaaattttgcaggtcattagctcataatgattaaatgattctggttattagcataaaacacagctgtagtacataagaggtaacctttattgtttaaatattattcaatgtgcctacatagcacacagcaaaaaaaactttttttcagactattcagccattatggaaataacttataattacattcagaaatgttgcaaatgcaactcatccttgcagtgggataaacattgcctagaagggtttgaagaggaatccaggttagaaacaatgaaaatttttggctgggcaaggtggctcacgtctgtaatcccagcacgttgggaggccgaggcaggagaatcatttgagggcaggagttcaagacctcctcatctctacaaaaaataaaatatttgaaaaaaaaaagtgaaatttttgatatagaagaggatgtagggcaggtagggctcagaaagacccatgccatatagcaaagttcttagtaacacaggctttgggttacagcaggctagattcaaatcctgctgtggtcagaatgtctgtgtcaccccagcattcatttgttaggagatggggtcttttgggagatgatttggacatgaagacagagcctgcataattgcatgagtgcccttataaaagtgaccccagaagctgccttgcttcttccaccatgtgagaaaacagcaagaagaatatccatgaatctatgaggaggcgggactctggccagacattgaatttgctgcttccttgatcttggacttcccagcttccagaaccatgagaaataaatttctttttttcaaagctccccaggagtctctctcggtctgttctggctcaggaagctgccttatttgtaacaaacaaataaacaaaaaacaaaataaataaaagctacccagcttagattattttgtcataaaagccccaaaagactatgacaaatccttccatctatgtgtccttaggcaaaatacccaaactctctgaataccaattttctcatccaaaaaaatgggtgaataatatctaagaggtaataaccctaatacctcttagtgttgctgtgagaattaactaaagtaccatcttcatgtggtcagcacaatggctgacacatagcaagaccttggtaagttatagctgttgctgtcattcctgcagctgttatctttgtcattacgcttactgttattattagctctgctatcagagtgatgctgtggctggagaagatggagacccatgtgttcaggctgtgagcataggcagatcctttctaatgcagaaggtgcagacacagggcacagaactgccaactgtggctgctgacacctgtctgactttgactgggttagtgacaaagaaatgacttgccttttgtatgttagccctgtgcctggcatactgcaaatatctatggttgataaattaatgttatcatcatcacgtaagcatcttgggaagtctgtaagtaatgggagttggaggcttaacactgatctttgagctggcgatttttccagccaactcattttggacgttggtgcttaagcatatcctgttttcgagggtggtgttggtggtggaggaggtgatggtgatgatattgataatgacagcaagaatgtcttacatttatagagtgttcaaaaggtgccagatattgtgctaagtgctttgcgggcattatgttattcacacttcacagatattctctttctacatgtaaggaaaaaaaggcataaatactttatataatttactcaggattttaagtagagggtagattttaagtccaggcagtccaaccccctgaaagctgactctttaacaccatatgcttctgtcttcctggctgttttgtgaatgagtaggatggaaaggagatccttgaattgggaaggctacccatggactacaactagtacttgtcttcaacctccatctagatggagtgctcacaagatcctctacatcaaacctggcttcttagtccactgctgagtcttcccaattctgaaaaaaaggattcagggtataatttctcacacagatttctgggacagtgctttcttggagcaccacgcctcactaatggaacactcatgtataattctggcttttgaatttttatttttttattaacatacacagtcagcattgggtgtggctctggggattcattctagtgggcaagtctcatatttctcaacctcaggtttttcatctgtaaatggggacaatactgacatctagctaatgtccttgaggatggaatgagatattgagtataaagtatctagtagagtggctagcgtatagtgagtacccaataaatgcaatagatgttggcttttattactgtcaagtggaaacaaaagtataaggtttaagtaagcgaacgaaatggaagataattgaggaagaaaatcagatgatgtctaagataaggcaaagaacattttgtgaatgtttaaatatcctaagacccactaaggaagtttgtggcaatatttgctcaaagacagtatatataataaatactttagactggctaagagaatggctctgaatgtctacctagctatcacatttagaaacgccccttgccttccttccaggactttcttccttaatcaggattgacttaactgttaactcctagaactgtcgttgattgcttgctgaagtaacaattagtatagacattcagcaactggcctcccatactgtgattcactgacccagactttgacatcttgggctcagccataccctggagcctccaaatcctctgctggatcctttaagtccagacatctgacaggggaagaaaaagtacaagtttccaaggagttattataggtcaagcctggaagcagtgaggtcacttccacctgcttcccattggccagaattcagtcacatgatcacaaccaactgcaagggattctgggaaatgtagtctggtgatgcctcgaggaggcaagagaaatgttttcagtgaacacattgccttctcaggcttgctttctattgtagattgcttacaatattgcttttaaattgcatggtcttgtacaaatgatacgagttttattttgccttttggaaggagttattgtccatatttgttagagatatatctgtttatcagcatcattgcaaagtattagaaagggccctgcctgggctaggagccagaagcattcttcagttcccaacggccatccagccactcattgctgtgtgagctctggctggtcagtaagaacctttgatcccatgtttctttatcttcttctttttttttttttttttagccatagtctcactctgtcacctaggctggagtgcagtggtgcgatctcggctcactgcaaattctgcctgctaagatcaactgattctcctgcctcagccttccaagtagctgggattataggcatgagccaccatgcctggctaatttttgtatttttagtagtgccggggtttcaccatgttggccagtctggtctggaacacctgatctcaagtgatccacccacctcagcctcctaaagtgttggggttgcaggcgtgagccactgtgctgggccccaactttctttatcaatagaagtggggaaatcgtacctgccctgtctgcctcattggatgtggaagaaatgacataatccatgagagtggcttctgaatgaagagaacctgctaaagggaagacatgatctcaagtcagccacctctgacccaaataagaacacataattacaagactgtattgtataatcatgcaggacacaaggtatgcaattttaagggtcaaagtggtaaaaaaaaaaaaaaaaaaaaaaggaaaatcaaatataaaaaggcagccccgacaggtacgagcttgtagtcatttccccaaatgcctaaagtagacccattcccattgctctaatttgtagagatgttctcgaggcagcctggagtcaagacaagagtgccagccaggattgaggcactgttccaactccagtctggctgctttttcaacctggggctttagtcatgtcaatattcctgagcttccatgtgcttatttgaaaaataggaagattcgtccagtctcaaggaactatgataagtagcaaacaatatcccagaaaaatctccaggcaaaaatccactggaggccaggtgcgttaggtcatgcctgtaatcccagcactttgggaggtcgaggcaggaggatctcttgaggctaggagctcgagaacagtctgggcaacatagcaagtctctgtctctacaaaaaatacaaaaattagctgcgcgtggtggcgcgtgcctgtagtcctagctactcaagaggctgacatgggaggattgattgagcccaagaggtcaagacggtagtgagtcatggtcacaccactgccctcaaccctgggtgacagggtgagaccctgtctctaaaaacaaaagcaaagtctactaaaaattcactggagctatgagaaatcttagcccatggaatccagtcttctccttttgtttctggggaagctgaggttcagagagatggggtagcttgctcatgttatatagggagcaaaggacagagcttggaccagagcgcagaggtcatgataccaaagccacggcacctttgccacaacgtgagcaagaaaggatagccttgttatttttaatccaaactgaagttatgctttgggcttccagaatctgggtcaaaaagagtagaagtcaggctcagattgacgcttttcaagagagagaaaaaaaaagaaaaaaatcttgcctttccctagctagaggtcagatgtcaaaaaagctaataacacaacccaaggatgtcatcgacaaatgaaaaaactggtgcgatgcgggaacaaaagctattttatcattaatatgccgcttttttgttatgtactcatgccccagaaattattgtacagcctgtacttgagtccttagacagaaagcatcttatcattcacaagcttagctatgcaatatattcctccctccccccaaggtagttgttgttgggttttttttttttttttaagagatttacagtgatctttccatataggtttttctcgaaacatatatatttttaatttctcaccatctcaggggtaaataaatatattaaaataagctatgggatgtacagcagagtataacaatgataaatgatgttgtgtgtaatttttctactattaacataaagtaatataaactgaaggacactggtctattgagagacttagaagctaatgttccatatcagatgcggccaatgtcaggactgaatacagattaggcagtgtccttttctccccaggggaattaaagtttgagacaccacttgctgccagtggttttatggcattttgttggggccggtggtgcctttcttggtctattaattcaggagccgtaaacaacaatgtgagcaaaatgcttttccggtgggatgcatttcatttatatgtgcttgtatcgtctataccttgtcaatccattttgtcacaataagtgtttttaaattgtgtagattacctccacttcattatggttcctggcatttgtgtcttatgcaaggctattatgtgaagttaggaaatatttaaaactctgcctttctaaagaaacagggacacggtgcagaaaagttcatctggagttaggcttgtgtcttgccgtctctttaacggagagttcatgggcagggtacagtctgtgagaaggaatgaaaaccccagggtagatgctaacaaaaatcacttttaaaaaatgtatggtgtccatctgggttagcaaacacatgctcacacgtctgtgcttgctggatttttaagaacttaccagcatttaaggttttcttatgaaactgattttactcaccagggatagagtctcaaagttggaggtattttatgttgttttaaataatatcgtcatcacatgtcattttagaccccaaaagtccactccgaatctctgcgtatggaattgaggaggggtgaggctgtcagaagccgagggacttggccaaggtcacatggctttggacggccccctgaaccttggagctcatgttctgtggcactttgcatactgacctttctgctcttttatgctgcctgctctctaatattgtccaaaaaccttctctaaagaaagtacacaaatggagagagggggaattgggcatgccattgggagaacaaatttatttagatatctttggctgtgttgacagaagctgcccaattatacccaatatacaaattttaaatgcatattagtcaaagttccagttatgtagctttagaaaaatttctatgtgaatgactacttttccctgaaatacgtcctccatctcaggcactagttaggaacttcccccgcgtctggcattgcaggtctgaggttccgatgaactcttttttctctccttccccattaaaatgggcagaagggaaggaacacttgggtttcatcaagcacattgttatccttcgggttggctctgagatgatacgtttgtcacggttcataaattttatctttgcactaaaaacagggttagaatatcttcaatgcaattataaaaatgtattaaaactgagaaggagaaaaaatatggcggtagatgcgattttaatgattgtgtaaatgttcattgttccatggcaaaaaaaaaaagtcgagcttttcagccacagtatttcagacaaatgccagggcctgtttttctgtaaatgtgtaccgtgtgcttttaacacaaagacaaatatgttgctttaaaattccgcttggaatagagtgaccagctgtcgttatataatatctgcaggctatgattgtgtaggtgcctgtagtcactggctatgaaaatggccccaaataaagtggtatccacacttcttctttctcctacgaatttggaggtctaggaacgggggtaagcctatatggtcataattagcctgcaaacgtgaattaatatgcagaatctgtccccactgtgatagaatttgccattcgcttcctttgctaaatggcttgcagtggcagctgacggccaaaggggaagctgagaacagcaaagattcaactgaaaacattttagggggttcctgacttcaggcctcttttcagaatgagggaattgtctaaaatcccaaatgcattcttagctaaggtcagtgtgtctgggtctgtgtcaggcatgtagcagccacagcaaacttctcttgagatagcatctcctccccagcactcacttgacagattgtggtcagtcaacactcagtctgatagtttagaaagcttttgcaaggcattccccaatataaccattaagcatcaaactctcaaatggaagtttcgaaaaacagaaaaaaaaagtgagcataaatgcaaactatcaccccatgtaatagtttatttatttcatgctccacttttctgggcagttttgttgtcattctctctctacctctttttttttttttaaagacagagtctcactctgttgcccaggctggagtgcagtggtgcaatcttggctcactgcagcctccacctctgcctcccaggttcaagtgatactcatctcaagtggtttctacctcattaaaacaaacaaacaaacaccactcaccatttttgtggtgggcatggtggctcatgcctgtaatcccagctctttgggaggccaacgcaggtagatcccctgaggttgggagtttgagaccaccctggccaacatggtgaaatcccatctctactaaaaatacaaaaattagctgggtgtggtggcatgtgctataatcccagctactcaggaggctgaggcaggaaggtcacttgaacccaggaggtagaggttgcagtaagctgatatcatgtcaccgcactccaacctgggtgacaaggctagaccctatctcaaaaataaagaaacccttgctattttagcttccgatgaggatatttatccttctagcatttgaatgcagccaaagtccttactgggcaaatttttgagctctcaccccacattaacaatttctctccttaactttgtttctgaatgaagttatccacagagttttaaagtgagtggtgagttgtggatacctcttccgagcaggtgcacccccatcctgccattgtccctctccttagtgtatatggattgatgacatttcagtttcagacaaagggacatttcattttttttaggagattaaagctgtgtaagatatacaatttaaactgaatgttgatattttatagattgttgagtccgattgtcctgatctaaaattaactggttttgtgatttggtgtaaatcgcttaacctctttcaatgttttttcagcaaaatggggtaagaacagaatctgccttgcagagaattaaccgagatgatgtgtggaaagggcctatcccagaggctggtgtaccatggtggcttctcctggctctgctggttattattattagcattattgtcattgtgaaagtgacaaggaatgtgcctgtgcgtgaatctcactcttagatcagacgtgcttttgaaatatccagatatatacaacacaaagagcgaagtttgttttatattttgtttgtttaggttttttttttttttttttttttggctggtgtttactgaatgcgtgcaaggctttctgtcacaggctctgtgttaagatatttaacgggtgtttcattttcccagcaatgctataggacacagaaaggaacataaattgttacagagagaaagagggtaggtctgtgaatggaattgaacaggtaggttgaacaagataaatgccgaggaagcaagtgtatttaaataaacagttgtttatggaaggctttggaaatccactatattaatctggaattttatgaaattttaccagaacttaaattattaatagttgaggacaaagaccaaccattttccccaaaacttagtcactagttttgtccttaacaactaattaataaatatttgtgaatatagtgagtgactaaagtaatgcattaatggttgaatggctggccaccgtgcctcatgcctgtaatcccagcactttgagaggccaaggcaggcagattacttgaggtcaggagttcaagatcagcctgggcaatatggtgaagccccgtctctactaaaaatagagaagttagccaggtgtggtggtgggcgcctgtaatcccagctacatgggaggctgaagcaggagaattgcttgaacccaggagggacaggttgcagtgagacaagatgatgccattgcactccagcctgggtcacagagcaagacttcatctgaaaaaaaaaaaaaaaaaaaaaaaaaaacaacaaacagaaaaatgaacgagtgagtggcaagaaagatgaaatgattttcatcaccaggcctgccatggaattcatggtgccttgtactgtggccagtaggtgcaagagtatctagtaggtgctttatttttaaaaaatgtcttggaatcagtcatagtttaatatcaattatatataaattagtctttcaggatccaacagttctgatttattccactcacacaacaagtcagttcttaacacaaaccacataggttcttccttaaataaaaagctgtggctatgaagaagtgagagtttttttttttttcctctccaaaccaccacgtgctcttgtgtgttattgtagtggcttcgcagagtatttatttggccagaaagtctatagtcaaattgctcttcattctcaagtgtagtatttatttctccagctcatgcagaattctgttttatatggaggttttaaatttgtgcagaaaagtattacgtgggtttcaaaggtactcttttttcttttttgagacagggtctcgctgtgttgcccatgctggagtgcagtggtgcgatcacagctttctgcagcattgaccttgtgggctcaagcagtcgtcctgcctcagcctcccaagtagcttagaaccacaggcatataccaccatacctggacatgtttttaactttaatttttatttttgtagagatgtggtctccctatgttgcccaggttgctctcaaactcctaggctcaagcagtcttcccaccctggcctcccaaagtgcaggcattttaggcatgacccatcgtgtccagcctaaatggcattcttggaagtaaaaccacaggggatctgttggaagtggcatgatggaggaattttaaaagaattgaacaaataaaatagtcagagctcaaaaattgagtactgcttcgtttctcccaaataaccatcaccagacaaacaggtgtgtgtgtgggtgggggaggtggcctggtggtacttcatgatcttggaagaaggaaggcgcccctccttcttagctgattgatgatgagatagaaagatagaaacagccccatcactatgagatggaaacacttctttccttcatctgacttccctctccttcattcccaaccaagtttgaccccgccgcagtggagattgtggcagatgggtcagatagcatgtgtcctgtcgctgtcacaactttttaataagggctgggggtcctcttgaagagcccaggaactgcagtccctcctctatgccttcccctgaacacagtgcgccctcactaataaattctgagggctgacactgcctgagccggctggtctttgccctcaatttcattgagatgggccattgaaaactcattacaagctgtttagactctgactttgacttttgctcggcagcgaacaaaattaacagctcttggaggtaggaaaaaaggcgctcagccaaattaaaaaaaaaaaaaagaaagaaagaattgaaatgatgagaaaagacttttaatattaactccattagtcatgcaaacaagcgcacatgcgaagcgcatatgttctgcgtgtggctctcatttggagcctgatgagaactgtggtttctcccactggagggaaattcatacccaggtcttacacgtagctcaaaatgttttacatgtcaagcaatgagcctttgagtgtagcagaattgcttcataaatttaactatcactttcaaatttctgttttttttctaatttagtgcttgatagttttttatgtgataattttaaaatgctgtttgtagcaaaagttaccttgatagttcaggtgtgcagagaaaattcacagccatcaatagaaaagaaaaaaaaatcctgtttataccttaggcattctgtgatccttaggatgtagccatgacagtattacgggttttaaaagccacccaagtaatctaaatttcctccaaactaacaattcctgaaagattgaaatattgctaccaatgtctatggatggtttccattgatatttgggaagtttccatttgtatttgggaagctttgcatgagcaaaatgcccctttctcctgatatttgcaacccatcttaaaaataaaagtacttttctgcatgtggtcttgtacatgaaattaagaatatcactaccaaaatatcaaaatttaaggactagattgtgaaatgtttaaggaggcaaagaatatttaaccaagaaaggaaaagtgtatttgagagagacctgatgagttcaccactgcctctggagaatcaaatccaaaacagcatatatatgtatattttttagagacggagtctcaccctgtcgcccaggctcgagtgcagtggcgccatctcaggatctcggctcactgcaagctccgcctcccgggttcatgccattctcctgtctcagcctccggagtagctgggactacaggcacccgccacctcgcctggctaatttttttttttgtattgtttgtatttttcatatttttcgtagagtcagggtttcacagtgttatgcaggatggtctcgatttcctgacatcgtgatccgcccgcctcagcctcccaaagtgctgggattacaggcgtgagctgacgctcccggcctacagcatagatttgaggcatcttgaaggtagatgcagaagagtgggatctactttggatttttagattaatcactgttaagacttaaacagcttcttatttgggtgaaacatgggagtgtcaaaaataagtcactgtcactctttgccaacttcctttaactctttatacggctatatctccatagatatccagtttttgttttgtttttgtttctgttttcagttcctctccaaactgtcaaggacagtgccaagatctgcgaatatagaaagattaagagtttttttctgccttgttgggtcttctttctagcatgccaggaacatttttctcatcttttgaacattagggaataacacccaatgccaccctataatctcgagacagaagtggaggatcctcttaagacaagaaatctttcaaagccaaataatgaattaatccaaagccacttgaggctctagatagatcttagcagtcaaagcaataaatatataatcccataaatctaaactttgtggtatattcattaggctgtctgttttcttttctttcaaatgtttcacttaattccctgatataataaggcttccaaattcttggtgtttttctacaaccaagaccttgaactttttcctctcaggatttctttcatgagaacccattttctggccatttggatatcattgatgagggaattgaagcatttccctattctttagagtttcattaaagtttgactatattccagtaacaattgttgcataacaaaccacccccaaatttagtggcttaaaacaacaacatttattttgttcaggaatctgtagtttcagcagggctctgaggaacagcttgtctctgctccagcatcagctgaagcagcttgaaagccagggtctgagatcatctgaaggttgttcactcatgagtctgaggattgatgctgactggtgggtgggacccttgctggagggtctattggctggaacacctacacattgtctccatgtaccctgagcttcctcacaatatggcggctgggttccaagggtgagcgtcccaagagaaagaaccaagcagatgctgcattgccttttatggccttccatagaagttacatagccctaggttttcctgcattctattttttaggctgtcagacccaccccaaccaggtttgcagtgagaggaaatagaccccacctcttctggaagagaatgtgggactggacatactgccatggccacttttgaaagatgcagtctgccacataagcaaacagttcgtgtcctgcagtgggatattgggaaaagaatggtatttggcaaggggtcaggaaacctgcttttgaatcctacctctgcctcttactagccacatgactgggtcttagcatgctcatctatgaaatgggggacactaatgctgaccccacatttgtgctgaggattatgcaaataaaatctgtaatttgtgcaagcatccaccaagtgcctggtgcagactggatgctcaataagtctttggtgggtccatgtattgaattggaatctgcacattatggccattatttaggtttcttgtgtcctaatctatgtcactgagtacatccttgctgtttttcatgaattttccactgagtcgcaacatgccactggccagtgaaggtcaggcaggaaacagattaacaacatctcataccacaatgtcaaaatacttaaaagtgtttacagatgccagtgacacccagtgaatctaaaacaagaggaccagagcagaagtaaaactattcttgttcttctaagcttgaacacaggccttgatgttttatgattgttttaaggtccattaatcgctgaatcatgaggccatgtaaaaaaatgacagctataacatcaagggcccgggtttattttaaatgtttttgcttctacatggattctaattaacgacagtggctaaaacctgattcaaatgtggcaaatgtggagtgccatgggatgaagccagtcaatttcatctaggagcattttatggcttatggaaagaaatattctcttagattgaagggcgccagcctgtaatgggcatcagctgattctcagaaagaagaaacaacgtactgttacataattggggcttctccaaagtggcctgaccaaactgtagagctgcttgtttgtctgatacggtagccattagccacatgtggctatttaaactgaaatgaattaaagttgtataacatttgtaaaaatcacttcttcggtttcattaactagcctcatttcaagtgctcagtagctacatgtacctaacacattggacagcacggttacagaacgttttcatttcatcggacagtttaactgctttggagactggttctcctttttctttttccatgttcactccagaattaaagtcaaccagttcaaatgtcccatctttccccacagacatttgtgctcaaaggcatccccttccccatttggagactctcctagggcctaggcccaagcaaccaggactccctgtagtcaaccccactcctcaatttttggcacccatgttattccacctcaagatcatgtcctcttttaacccctctgaatatgctcctcctgtgatacccatagggaccctgaacctctagtcctcaagagcagtcattcacccctttggactatggatccgtttgcaacccaggaacaactactgtatggccacttcaaacctgtatatgctgcaagtattttattctaggtagggtaaataataggtcttagatataggtgcaaataattttcaaatatgggtaaatgctattgggatgtgtaaagtagaaatccattttaaagtgttattgaatccatactaacctgatcattacatatttactaattgatgattactaaaaatgtggacctttgtgaatttccgatgtcatagaagggtgttcttaactggaaaagtcagtagccaacattctgggaagtagaggcctcttcctcactgcttcattggtttaaaataaactccaacagaaaaacatgccatcatctttaatttcctgcatcagctaagcatttatttcatgtagtcctcacactagattgagtggttccatattaatatcctacgtcaaagatgagtaaattgagatgcgtaggttctaatttgcccagtgtcgtggtgtgtgatcttgaccactagcctaaactgctattttatgtccacccatcaacctctacggctgcccctcatttgaacacacaaaatatagttgtgtggcttggtggagccatctaaattccgttaggccatttgccaatgctgctattaggggcgaaatgtcatgcgcttgatctaaatgtacttaggagaattctcaggacctgatgaattattattcggaattttatggcctcacaggttgcaggcttcataccaactgcagctaatgagctatgggccccgagaaacactgaggacacacggcgttctgcacacagagtgggctgtttctgtctgttctccccctgcacccttctcagatgcaatctcaagtcataggagaacttgtgcaaatgtttctcctggatggtttcctttagagcatgtgtcctataacttgaaatggttgtctgagcagaatgtttttagaagttagatttttttaggggggaaacaggaaccaaagcaaagccaatagagatcttgaaaaaaaaaaaaaaaaagaaaaaaccaccgtggtattctaggaagaaaaaagcatttttcgaatgaaaactttttattatatttgatatattctgcttcccttccctagtatgtattaatgagatgaaatcacttcttaattttcaggttaatattaaagttgaagcccatccctctaccctgaggactctgccagcctctggcagtattcctttccaacttccacttgccccaaataggtagaagttagcctttatttttggtgtcatgtcttctttccctcctcctatcagtttttcagaaactccagaaatttaacctagtacacaggggccccccacccctgtttccagatgccttctagaaagaggactgggagtgtgaatgaggccatgtgggctttgtttgaccctgtggttgtcatgacaatttctcaaagcttagctgggacaggaagaaggaaggggaggatagcggtgtgttcagtgtgtgagctcctaaaagctcttgggtcactgttcccaggggatgatgaccctctatggcagatcagttgcatgtgcatatgagctttccctcctcccgtgggttagcatgttccacactcaccttctcaaagcaaagtctcccttaggggacccttggtatcctgttcatctggcaaatctcagcaccaatagaaacaccaagaacatggattcatcaaaggaaaaatgttgaagtttccatttttatgcttcctggtaatccttcagcccttgatggaaatttccagacctaaaccagtgaattaagagtatggggaagaggagccctcatacagttctgttaaatggtcctttaatattcttcttcagagtgacgggtaccccttgcctatacattttcaaaactacactgaaaatttcaaaacatttctatcagaacacagtcttattctcagctgatctgcaatttccacctggatctgttaaatggcagcttagctatgaaatatcatgttctgcccaatcacctaccctgcctcatatgatcagccggtatatttatgtggacacatgcagccacacttgtttttaacatttgagaatgacagcgtattggcagttcatataagctatcaaatattacatgtcaactcagaaaacatccctaggaagtattatgggaaccccctgtatcacttgagattcttggatccatatttgctgttaacaaaataaattaatagtcaacaactgattaaagcatttccctgctaccatgattgccttgacaaattctgcagtgctggagtattttacctcccattatttcttccgctgaacaggacgtttggttctaattgttaagcctgcctaatgctgattgaagcgggccatagtatcaagggtggaagaaggtgggaatataaactagatttgctcccttctgtaggaataactctatgaagactttctttttggagacaaatcatcttatgcaggggggaaaaaaaactccctaaaaaagacaaatgacagcgcaagatccaaaaagacaagtgctcagtcattttgtcataatgccagaagagacagtaatgctgtgtggactatgcattcagacatttagaaaatactgcaggcagagctggggattccgtggccagaagcatatttggtgaaccgaggacgcatcaaagagcttctctggtgtttagtaacttgcactgtatttcagaggtttataaagggaagggacaggaaagcagtgtgccagtaagacaactcctcttctcgtctggattttagaggaatgcagtgaacaaatgatgaaaaagtctgaagggactttggtaattcagtatccgaaaaacaatcagtgttttgtgacattcttagttgtgatctaccttatgttgtatacacatggtcactcacatacataggtgtattattctgcaattgctgagtaattgatgatccttcattctctctgtgattcataggctctctgggttggataaatcacttcggggaattatatctactagtatatttatgtcactagaattcctttgagaagctatcactgtgtacatttactgtatctattaactttcttcatctccctcttcctccctttcttcctttcctttccctttcctttctcctctcctgtcctttctctctccctccctctttcttttctttctttttcctttttctctctctctttccccctttttgtatttctaggagaaacggggtttcaccatgttggccaggctggtctcaagctcctgacctcaggtgatccacctgcctcagtctcccaaagtgctgggattacaggcatgagccatcatgcccagcccccttgtcctcttcttataaggctactaatcccctcatgaggggacccatcctcaagacttcatctaaacctaacaacctctccagggtcccacacccagataccatcccactgatggtcagggctttgacatatgaatgaggggtagagggacacaaacattcagtccctaacacttggtcaagttacttaagcttggtaagcctctctcttcttactgagtcatgagcataataagatatacctgttagggttcttttgaggaataaatggaatttttaaagaattgtgccagacatgtaataattacttgataaactatagctattataacaccatcaaagctgtggttcttaccctcatcattgtttaccctctcacacagtaagatctttctgaaaaggatcaagtctcattctcttttgaaccccaaagtccccagccaccacagagaccaaatacagtaggtaccaatgcatggcaatgcataggaactaggtgtcctaacttggcactgtatctgccaattttttaaaagacaagatgacatcccaaagattggggcatatttaggataatgccccattctgtgagggtggacattatagaggacatcagcagccagccacaggccatctcttggtgccattgggttttgagaccctcagggtgacaccgatttaacatgacaggtcttatgttcttgggtaatgtcaaacaacttcttgaaaatatttgttaaaaaaaacccaaaaacagaaacatatctgactgggcatggtggctcctgcctgtaatcctgacactttgggaggccgaggtggacggatcacctgaggtcaggagttcgagaccagcctggccaacatggcgaaactccttctctactaaaaataaaaaaaaaaaattgccaggcctaggcgcaggcacctgtaatcccagctgctcgggaggctgacgcgcgagaatcacttgaacccaggaggcgaaggttgcagtgagccaagatagtgccactgcactgcagcctgggtgacagaatgagactccatcctcccaccccctaaaaaaaaaatctatccaaaggccttgactaatgcagaatcagcactaatttacaagccccataaactaaagaccccatgtttgtgttataagttttcaaactttttaaatattttcccctgtcttattttctatcatttcacatcttcttaaacacatatatttttaaaagaggttttgactcactggtgaatttgtcttaaaatggaaaaataaaatcaaatataagaattttgttatgaatctttggggaaacacaattagggaatctaccttaataggtaaacccatgtaatttcttatttccgtctagttataggaaaatactgagatacttgtgagatgttttctttttttttttttccaacttgtatacacgttgttctataagtggttgattgttttttaggaaaaaaaaattcagcatctcaaatgtacctttaatattgcttctgatttttgttgttttgctatcatagcgttacctacctcacagagatgttttaggtcataagtatttttcatttaattttttttccccttaatttcctttttttccctcctaagctataaatatacagccttaaaaaaaacactcagaaatttaagtccaagaagcctgcttttcttgatacctttcaagtgctagattaataacatttttgtcaggtggttaccagaatggaggatacttgagctgagttttgctagagtccaagatcatctattctaatttctggggacacatattttgtcctggttagagagatatataatgatgcctatctgattctgtggtggtctggctttgatgtatgtatatgtgggcaggaatgtgtgtgcgtgtgtgtgtgcatgtgtgagctcctgtgtgtgtgttcatcacgtatccattgtgtctccaaggtcttatcaacagcaacaaaaggcctcctttgagatcaatcacattcattcgatgtttgttttctactacctgatacttactgctttctctttgtcgccgttaattttgtttgtcatatgtcagaccaggatgagtggggcacatacagattcagctcattttattttttttctcccttccttcgtcaccacctttgctaatttcaggcggtcagcacatttagcaagcatgtagctgcttgcctgagcaagccattaatctatattagaaaatgtagaggccccagtgttaaccttcctgaagcttgtctccccacccccaattctataggttctattatatctccgctggtttaaggcaactgctgtttcttttaggagttttcttttctttccttgctgaatatctgcacttaccaatactgcccaggcacatgggctgtggctcaagttttcagtgcaggacagtgtgtcattgcaggagaagacagaacccggccagatcctcccgctgccggcaagcggagtcagttactgggaagccataataattctgtcttctagagaattttggcaaaaatgtgcctccatcttacatcaacaatttttcatctttctggaatttttatttccccttcccctcttgttcctttttatcctcctggtgaagtatctccttttccctaaaaaactggaaaaaatgcacttttctatattaattcaaatcatattcaaaaaatactatatgttaaaaaatacgatgtttctgtaatccttacatcccctaataaaaccactgtgtgatgaaactaccaagaagcctctcttgaaaaaaaaaaaattaagtgaacctctactttagaatgttggcttttcatatatgtacaaaacaaaagaggttgcagtgatggcgtggataaaggcacctgtgtacttttccaacctatccaatttcaagatgtatcctttgtggattacattggttcttttctatggaatcatgcaccttagacctgggagaaaccagcgtgacatccagggtcaaggttttccaatcaggtattttgggggaaaaagttctgccttcatgtaacaactaatgtgacatggcagtgtataagacattacagccaaggccttctggttgaagttggggaactgtgggcgttgtccccactagtcctgtcatctgcccttgcaaaaccacccttgggctctctcgcgtgcggtctgtgcaccagctacctttgtgctccccacattcttccacctggcctggaagctgaccatagttggctctcttgccctttcttcttctggttggatttagcaatttaattttcaggcttgctccctgcagggtgtcacttcaccaccttcctctgtagaaggtttcgtccaggccgggcacagtggctcacgcctgtaatcccaacacttcgggaggccgaggtgggcagattgtctgaggtcaggagtttgaaaccagcctggccaacatagtgaaaacccatctctactaaaaatacaaaaattaaccaggcatggtggcacacacctgtaatcccagctacttgggaggttgagacaggagatttccttaagcctcggagatggaggttgcagtgagccaagattgtgccactgcactccagcctggctgagagaatgaaactctgtctcgagaaaaaaaaaaaaaaagaaggtttcatacattttagctgacaagggcaggagctgttcctgctgttactaactggagtacattgcatgaaaccttgctgtttccttaaaccctgcaccgacctttacaaacagtgcctttactaaacacttcttacgttacccgttttgagtgtaccatctgcctcttgccaggaccctgaccaagaatttgaaatctcagaccatgatgacctccttgcccaatgcgtaagctgtcctccaaaacacacatttatgggggcagagggagtctctctggaaggaaacttcgtctgagccatggctccttttgcttcccctgggttttaatccttccttcccttcctgttcttttaaggaaatctgaaaaggagcaaaagagctttagaactgcaatgcatctgtctgaggccaaggacagttgtacgcagacctctctgccagtgtttcagtgaccctcctcttgctgcttggctgcctatgagtccatgctgacatctggctctgtctgcccaaatataaacttgagagtgacttccaagatatatacagggctcagaggttctctccccaacccattcactggccctgctctctctcgatgttcccaagtctcctgggtgaccttgtgtgtccttcctgggatattgctcaatcaccctagaactgtaaggccaagtggtcatagccagaacatggcagaaacattcctgcttctattctgcttttctagcatggaatcccctctgccttaatgtgaataaatactccccaaaatgaaggcagaatccagtatctgttgtttaaactaaatccctaactggaccccctctgataaaccctctgataaagaattgatgtaaaatttgggacgctggataggaccaggaagccagagaaagagggcacccttttcttttctagcatttgagttcccaaagaagtaaaactctgtgaatgttcacttcattttttcctgatatatcgaggactccagatgtaacctcattgatagtcttggtgtgttcttcagtatttgtgcttttaatagatattgcaagtgtgtttaatgtgaaaatagaaatggagggcttttaaaagagcttactcaaaatcctgccaattactgaaatctaccagacaagaaggagccactcttttttttttttttttttttttttttttttgatacaatgaggggaaatgtttcttccacaaaagcctggccgtttgtctttaaaaattttcatcttttgggtactgagttgtaatagtaaatacagatgtagctgtgtcacattaaaagcacaaccaaattgtagtacaatgttcaggacacttttatgtcactttaaaatgtagagtatcatctaaaaatgagcaattgctgtgaagaaactggggttggctctgattttgtggctcagttttttttggtttcttgagaagatcatctttaagtcaaaagttatgcaatgccaagtactcatctgtgtaatctatttcagtttccaaaatttttcatcacctggttacaaacatctgaaggcaagaaatagccaagattccattgcaagtcccagagtaagttattattagacagaaacaaacaagtaaataccttgggcctgagctattgcccaaaccagtcctgacttggcttgggttctgaccaactgtttttgatcccacagtctgaagtacgtttgtggaaatacaaaggtcaaaccttcccctaaccctctgtaatccctggtggagctaaggaatgaaaagttgcttaaacattttcctgttgccagtttttcttaaacattagtgctattctttttttttttttttttttttttttttccttcttcaaccctgactctgattcacaaagaatagggaagcttagccaactgcagtttcaaagtattgcttcttaagcctgggccaagtgtgtagacttgatagaattctgattaatgcatcttattacattaattttagaagaaaccagaaggcatttctcctattcctagtgcaggccagcctgccagaagcatttgcctccttaaagagctaatatcttcagctaccaacaatcataaaactgaaagatctatcggaagagttggcttctctggatgtgcataaggcacactgcaaaatagatgtacagcttggctgaactttgcttcaaatttgccaatcaaaattcacgaacccatgccaagttggctacaaaacctctcgcttggagccagcactaattatgtcaacaagtagttcaagtttagcccctgttaagtcctgtactcctgggtattggggatgagtctttgtgtggtggcaaacgggccctgtcttcgcttggcttcctcctaaaattcccaggacctcttcgggtcccagccctttctcttcccctgagattgcgcctcctcaccctctgtcttggatggaaagagttccaaggcagtccagtcaccccagtgaaaagttttctgatgaggtcaagccttcttattgtcataggtcattttctttagaaatgagaaaccatctcattgggctttccaggaaggagactctgagtgcaagtttgttgtgaagaacacgtgccttggaattaacacctatggaagggaagaaaacgaagatggagtgggcagagggagaagctgactgagatggagtccagcaagggtctcagtcaaccttatgaagctaaaagggcccatcagagctaatccctattgggctaatgtggccaggcttttataaacctgccttgactcgtgattgggtgggctgccccaggaaggatgtgcccttgcagaaggtagtctctgtgttcaggtactccctggaaaggctaatggctgaaggctacaggttaccctggaagggagacctgggctgcacatcagagcccatctactttccagtgtggacaagttccagctcctgccccagccctgccacaccatcaccctctccagcacacacagcccttctctgttgattagggttggttgagctgttctaccaccttcattgactcaggccttgaagtgcagtagaaagccctaggacaaggcaggcccagttttgaggctgggtgcagaggctcatgcctgtaatcccagcacttcgggaggccacggcaagaggatcacttgaagccaggagtttgagatcagtctggccaacacagcgagacccaatctctccaaaaagtttaaaaatcggctgggcatggtggtacatgcctgtagtcctagctactcaggagactgaggcaggaggatcacttgagcctcgtaggtcgaggctgcagtgaactaagatgccacaggactatagcctgggcagttttgagtgctgcctctaccatgtaactagcttgccagtcaagtcattaactattcggggccttagtttcgtcttttctgaattggagccagtatacgtaattccaaaggttgcttttaagcgtaagtgagaatattggcagaaattcgttagcactgagagagggaatgtaaagtggaggttaagtgtacggcttaagagcagagtcaggaaacctagacttgcaccctgatttctgagttgaatgttccagggtaagccacttaatctctctaatcctcattgtgcttagctctagaatggaggcttgttgagaaaattaaatggaaacgataacggcgaagcacttagcacatgagcaggcccatagtactcaggtgttcattccacagaaaagcgttcactcttctgcactctttctcagtcagttggccactgctgttcagttcacttcttttggatcttctcagccccatcaggttcccaggtgaaatgagccccggctcagcaggccagttgtcttcagtgacccccagtgaggcagcaggtgggacttgattctggaggcaagactcaactccatagacagggcttacacaccggaccaaattgaggactagctaaaacagggatagggtgggtgcacctttccatgagctgtgtccgccagtgtgtcatgtcagtttacaatttccatggcaacacctagaagttactgcccctttccatgacaatgacccaacaacctggaagttaccaccctttttctagaaatttctgcataatccaccacttaatttgcatataattaaaaatgggtgtaaatgtgatggcagaactgcctcggaattgccactgtgggtactctgcatgtggggtagccctgttttgcaaggagcagcacctctgctcctgttgtacactgtcccttcaataaaagttgctaacaccaccaccttgcccttgaattctttcctgggcaaagccaagaaccctgttggcctaagccgcaattctggggttcgcctgccctgcatcaccagcacagtggaaggccacaagctcacagcattttcatccgtaaacaaagcttggcaatatctctgatggttaagagcttacgtgtttgcgccagtgagacttgcactcagtcttctttgagtgagacttgaactcgattctgagtctcctccttcctagatggactcattatttacttatttatgtattcactcatctattcattaatttatactcttagtttgatatcaacatctgtaaaatggggatggtaatgtggtgatatggaggaaaataaaataactctggcattgttcttactatttacctctgtactgtcatcgttatcattcctttgataaccgtgagcacctgtcatgggcctggcactctagtaggctctcaggatgcacaatgaccctgtccctgcttgctggagacataggagaagcccccagccactgacatctgggtgttgtaagaaagcaagaacagtcatggacactgctaagttttgatgccaaagagccaaatttgcagtaccagaatgtcctttccatgtgtgacccaaagttttggctactgaagacgttgcatgccctccaacagtggaagtggtgccctgaatacgccagaaataatcgtggagtcaacgaagatctgggagtattgtttggagacatctcagtattcctaattcattttcccatccttaaataaaaatctttcttactgatgatctgagaacttcttgtaagccccatttccatgagtagagttggccattgcccactaagaaaatttaggtggtttttattgggattagtggatgaacttaggattagtgtggcccttccttgaaatataatgacaaccttggtgaaagcaagaccacagggcctgtcttcagggaagtgccttgcattttaataccaaccatgccacgtgtatgtgtttcctgggcctgccataacaaattatcgcaaactgggtagattgagaatcattcattgtttcatggttttggtggccggaagtccaaaatcaaggcgtttgtggggttcgttccttctggaagctatgagggagaaaccatgccatgcctgtctcctggtttctggtgactgctggcaattcttgatgtcccttggcttggaaacaccacattctaatctctacttcctcccttacatcaccttctcctctggctttgtgtcctttctgtctcttacaaggacaccagtcattggacttaggacccacctaattgagtatgatctcatctcattccttatcttaattacatttgcaaagaccctgtttccaaataaagtcacattcgttggttctgagtgaacatgtttctagggggacactattgaacccactgcactgcatcaaacgtatgggtgtgctttctcttggcctttctcctatttgccttctctgtgttgggaattgtggcttcacacccatctacttatccctgcatgttgagcatcgtctgttacctgaagagcagaaggatgataaaagtgaggaaactgaggcacaggcttgccccaggttacacagctagttatgatggagggtgggtcggaagccaagcgccccccagcccccaccccacaacaggtgtatgtggcctctggtttatccttctttccccctgctcaccacatggcttctcattttgaaaacccggtggctaataaagtagatgagtttcaggattgcaaaatattgtgatcctggcctttgtccattgtgtaatcttcacagtgaccagagtgtttgcagttcctaggaagttcacccattcccaacagtgtcccagggtcaagctcagatgacctgtggtatttttatacccatatatgtgtcaatgtttataacttttaaagttgttttcaggaagcactgaggcatgtggtcgttcacaggtgacaaagacagaggctcagggaactcagttggttgctgagctttaaacccaagtctatttctgaggctggactgagtctttgagaaaatgcaaagtaacctagcatagtgtcagacacaaaatagtcagcaaataccatcgtagattcaggcttctgagtccaaagctaacaattctcatctccaattcccatcttcaaatattaaaataaactttttttttaagagacagaatctcactgtgttgctcaggctagagtgctgtggcatcttagctcacagcagcctcgacctaccaggctcaagcgatccttctgcctcagtctcctgagtaggtaggactataggcatgcaccaccatgcccagctatttttaaaatttcctgtagagatggggtctcagtgcattggccagactgacctaaactcctggctacaagtgatcctcttgccttggcctcccaaagtgctgggattacaggtgtgagccaccatgcccagccttaaataaactctttagtgtcaaaaaatctacgtgaggccaggtgtggtggcttacccctgtaatcacagcactttaggaggccaaggtgggtgggtcatctgaggtcaggagttcaagcccagcctggctgacatgacgaaacgccatctctactaaaaacacaaaaattagccaggtgtggtggcatgtgcctgtaatcttagctactcaagaggctgaggcaggagaatggcttgaacccaggaggcaggggttgcagtcagctgagactgcgccagtgtactccagcctgagagacagagccgagactctgtctcaaagaaaaacaaaaacaaaaacaaacaaaaatctacttgaaccaataaaaattcccatccccacctagaattctaaatattttataaataaagtcttcagagcctagatattcactagaacccagtggtcacgtgttcctaatgggtggaatattattttgaatctttccatgatgagagttacattgctgggtgaaagctttttatgcaacatcatcattgttgaataaacagacgcttagcatatttaggttggaatgcaagggaactaaaggtaggggagattcttaaggaagtctactttctcttcaagaatgctatcaaattgaaaggtaattcctaaagaagagtcatttgtaaattagggaggaagagctaaaaaagattcctagcaagaaacatcataaaggggcttgataaagccaaaaaactaaaagaaaaaaaaaaaggaattagaaacagagaaaagaggcttcgtgttgtttgtaaatttgtgaataaatctgttaaagaaatattggattcatattcaacttggaaaacagggaaaggccttttattgcatgctttgaagtttgaatacactttcagtagctcttcgttatctcaaattaaatcttaaattgagcttgtggttctgtgaattaatactccggcctttcagccctgctgctgaggtcattcaaatctaatggtggaaacggtcacagggtcaggccttggatggtgctgtatagaaatgccttaatgatgctggcagatgtttgcattctgcagctggggcggctggcgggttgggggctgcaggaagagaggagttgatgatcacattattgtgtcagccgcctgtgtgaataaggaaggacagactcccaccccatcccatcattccaggttcaataagaggcaggtgcttcctaaagcagaaaaatgtaagggaagtcatcatcgcttatcatcacctgaatgttcaccatggtgacccacatctcaggatgctgcaaaacgagagaggtcacctgtctgtgtaatcgcatatagcattctaaagatgttccattcattcagcaaatgtttaataaaggcttcatctgaagtttaatggacattgtttgataaaacagacccagtcactggtgtcagggagtttatataaaagtatacacgtatctgtgcaaatgtgtgcatttaaggcccgccgagcctgagctgatatgcatgtcttaactttgctgtttctctaaggggatggaaggattggctaccctgagctttctagacttgttatttttttttttttaagacagaatcttgttctgtctccgagctagagtacaatggtatgatcatagctcactacaacctccaatgcctgggtttaagtgatcctgccacctcagcctcccaagtagctaggactacaggcgagagccaccatactgggctaatttttgttttttattgagatggggtcttcctatgttgcccagcctggtctcaaacttctggcctcaaagcaatcctcctgccttgatagacgtgttcattgtaggtttctagcctctgaatccaaattttatttttctagtactttattttattttactttttattgattgaaaccttgaaataaagtttttaaaaatctatttgattttaaacgatctttagaaatatatgaaggttaaaaataactctcattttgctttttataaacagtccactcctacatgtagacacatttagatgcttcattttgcctgtagaaagtttttctaacaataaactgaccaatgatgatgaaatttttattgactcaaatgtgtgattggttgatttactgtattcagtccaagctcctcccaaaggttagctcattgactctacaactctgttttcctcattcattcattcctctaatcaatatgtattgctcacttggtacatgtcagatactttcctaggtgctggggagaaacaagcaaagtacttcagggcctgtattagtttgtttttcacgctgctgataaagacacacccgagactgggaagaaaaagaggtttaattggacttacagttccgcacggctggggaggcctcagaatcatggcaggaggtgaaaggcacttcttacacggcagcggcaagagaaaatgaggaagaagcgcacgtgagaacccctggtaaacccatcagatcttgtgacacttattcactatcacgaggatagcgcaggaaagaccggcccacatgattgagttacctcgccctgggtccctcccacaacatgtgggaattctgggagatacaattcaagttgagatttgggtggagacacacccaaagcatatcagggtcctaggcaactttgtgtgagaacagaacagagaggaagcgacacacctttcctttgggagcaatttttgggttgcttttgtttttatttgttgttttcattcctggtagtaatagtaacagtagaaaatggcagcgttatagccataaacaaagtgctctgtggtttctctctcaccatcccctaaaccctacaaggctaggggaaaatggtaatactcatgaacaactccacttcataaatgaggatgccggcactcggggaggtcaagtgagtttcataaggtcatagagcaaccaagtggcagggctgactcccacccaggtgtgttccatgggcagcgtcttcttactgcactgtcctgacttgctctagtgagatctaagagaggcacaatctgctttccttttgatggtgtgcagcagcatgatggccgcgcgaatttccaagaagaggatgttggtcgctgatggcatcttcaaagctgaacggaatcagtttcttactccggagctggctaaagacgcttctctgaagctcaggttcaagttacacccatcacgacagtaacaaatatcttagccaacagaacaaaaaatgttcctggtgagaacagccagggattctggaattgactgctgtagttcagaagagatttggcttcccacagggcattgtagagctttatgctgaaaaggtggccccagaggtctgtgtgccattgcccaggtcgagtctgcagtacaaactcctaggagggcttactgtgcggagggcctgcgatggtgggctgtggttcatcatgaataggggggccataggctgccaagctgtggtttctgggagactctgaggacagagggtcaaatccatgagtttgtggatggcctgatgatccccagcggagaccatgttaactagtacattgatgctgttgtgtgccatgtgctgctcagatagggttttctgggcatcaaggtgaaggtcatgctgccctgggaccccgctggtaagactggccctaagaagcctctgcctgaccacgtgagcatcatggaacccaaagatgaggtagtgcccaccactcccatctcagaacagaagggtgggaagccagagccgcctgctatgccccagccagtccccatagcataacgggctgtccttggcagttgtattcggagtctggatgttgctttgtaaagacatttaataaaatattgtacaaagacaaccgggaatgcctgtaatcccagcactgtgggagtcaagacaggccgatcacttgaggtcaagagttcaagaccagtctggccaacatggtgaaaccctgtctctactaaaaatacaaagattagcctggcgtgccctgtaatcacagctacttgggaggctgaggcaggagaatcgcttgaacccgggaggtggaggttgcagtgagccaagatcgtgccattgcactccagcctgggcaaaaagagtaaaactcagtctcaaaacaacagcaacagaaatgtattctctcacagttctggaggccagacattcagaatcaaggcagggctatacttactttggaggctctagctaagaatctgttccttgcatctttcgtttctggtggctgctcgtgattgtgggctgtgaccatatcactccaatccctgcctctgcagccacatggccttctcctcttctcctgtgttcctttcctgtctgcctcaaatctccctctacctttctgctatgaagacacttgtttttggatttagggtcttcctggctgatctcatgtcaagatccgtaacttaattacatctgcaaagacctgattcccaataagcttgccttcacaagttgcagggatttggatatggaactgcctttttggaggccaccattcaacccacaataagagcacagtggtgaggtttgaggggtggtatgaggtcacagtcacagccacccctctcaccagctgtgtgacaattctggatttacttagctgtcctctgcctccatctccctttccctgtaagtggaagtggtattcattgatcacacactacatgccggacaccaagctattacattttttgaatatgtttcttccttgcctcttgaggactaaccagccgggtttagattatttcctccccgtgtcgctttcctgcccccacatgttatagatggtgcaagggaaccagagagctttgatccctggtttctctggtcacaaacctgctctcctctccagaactccaggatgcctttctgtgggggctaaatcaaatttagctgttcccccaactgcaaagtacataggcatcaagtgaaagggtaaatgcatgaaaacctgaatggctgatcctctaagacagtgagagcagatgttaattgctcactgtccaagtgctgggctctgtgataagagcttcacgcagatgacatcaaagcaccatgtgtgggggaagcacgatgatcttgaccattttacagatgaggaaggtaaggctcggtgtcatcaactcacagaggaagtggagctggagtctctgtggctccagggtcaggtgtgtagtctcgaaggctgttttctgttctgcaagtttctccttaacacatttccagccccattttctggcagggagaccccaggactgaaaggagctggaagagtgaggtctaagagaaaaaggggctgggtgtggtagctcatgcctgtaatcccagcactttgggaggccaaggtgggtgggtcacctgaggtcaggacttcgagaccagcctggccaacatggtgaaaccccatctctactaaaaataaaaaaaaaaaaaaattagccaggcatggtggtgcatgtctgttatcccagctacttgggaggctaaggcaggagaatcacttgaatctgggaggcagcggttgcagtgagccgagatggcgccactgcactctagcctgggcggcaagcaagacaccatttcagagaaaaacaacaacaacaaaacatatggccagcagccagtgttgttatctcaggatgggaaccaggcactgcacctcctcattaggagtcagagtaagggggctaagctggttgacatgactggggacagagttgctgttgaaattgtcaggttatgaagggaaattagctgctgggtgtcaagaggtgcacattgctgcaggcattggcaactgggagccctggtgtgtctattagctcctcaggctgtgaggccttaatgacacccctgccaacattacaggaggcagcaagtgacagtaggaatgagagaggccagctaatctaatctgtacgccccacaggagttgggggctgaggacttcaagacctggcttctgctccctgtcacagtggcaaagacaatgacaataaaagcacagcctccagagagaagagccttcgatggacctgggtgttaatccaggggccaggcaaaaactgggggatgcagaataggaggttgggctggaggtgagtgagaagaacggatacggttaggaccaacatttaggcaatatgaccgtgtacaggattctaccaccatcgtcaccatcagtgttactgttccctgccatctgcctgtggggtgtctaccatctaaagtccagcactgcactgggcatttttaaattatcattagtatataattatatataataataatttaatttataactatatcatttattaaggtcctactatataccaaattctatcggacacatgtcctaataataaacgtgatataatctatcattatttacaaaacttcacactctgacctttattaattatgtgtgtgccaattatgtgcagggaactgtattaatcgtagttagcaatatcgtctctagtcctccaaccctataaagtgggcacaattattatttctctattgcaattgccatttagcctcagctggattggaaactatgtaatggagactctcaggccactgtcttttgagcagcattttctgcattgcattcttgtatgtaatcctaaaatgtagatgtagttttcccccttttagagataaggtaatcaaaacttatagaggttaaagggacttgccaaagcgacacagccatgaatggcaaagctaggatttaaacccttggacttcttctccttgccattccaccccatcataaattctaaacatcataagcagaaccatcataagtcagggtccatctggaagatggatggatggatggatggatggatggatggatggatggatggagagagagagagacagataggcagacagatagctagacagatggacagatagagatttttaggaactggcgaattggctcacacaattatggaagcccagaagtcccaagaagtgtagccagcaatctggagatccagaagggcccatggtagaaacctcatccaaaggcagaagacaagcatcccaggttgaagacagtcaggcaaagagagaaaattatttcttactcagacttttgttttattcgggccttcaacagattagatgagatccacccctacagggcagggcaatcagttttactcagtctactgattcaaaggttagtctcatgtagaatcaccctcacagacacacactcagaaataatggttagtcagatatctgggcactgtgtggcccagtcaagttgacacctacaattttttttttgccttctttttatttttggtgttgtcatcctgtgtccaaggcacatatagtcaatcatcacacctttcccttagcctgtactaggttctgtgccaaggattttagaaagtcatgtctcattcagttcccctaacaggtctaggagtcattatcttccccaacctaaggaaactgagacccagagattcagagtatcccaagatcctacaggaattgcagattgtagccaaaattggaactcctaattccagagctcctccctcctgctagcatttttctttgagtagttttattaatgagaaaagctgttgagcaccagagcaaccccgcctcttctaaataccatctgacatatacattcagcagaggaaaaatgatgtgaggtctggggcttgctttaaaatactttggggccagacacagtggctcacacctgtaagcccagtgctttgggagtctgaagtggtaggatcactagaggtcaggagttcaagaccagcctgggtaacatagtaacatagggagaccctcatctctataaaaaatttacatgaaaaaaaataaacaaaatacttctgcaacagcagcagcaagagctgccgcaatgaaagaagaaagaaaaggagggagaggatgaaggaaagaagcagtgttaacattctagtaatatttgcatctgaatgatatttatatggggttattgtcctccctttgtgtatgtttaaaattttcataataagcatatttatatatatacacataaaacatatatgtacatattatcataatgcctacctgctcttgagaaagtagtgccgtatggctgggggtttttctcactggtttctatggctctcccctcccccactttttctaagaagtggtagtacctatctgactattttcttggctgcctgaagaggcctcaaaattagagtaaacaaattacccattaccagggaagcctccttcctcccagcagattcccagcatcttctttcacctctaggagatattttccaaggtcactaaattaagccttcagacaatcgaaaaattgaatctcagtacctctattttcctaacaaaatttctgcagcaccgattggggctgacaggtacggccgtgcagctttctgggctgttcaggtcgatttggccaagcaggacggcatcagcttgtattggagggaacatctgagcagctcagggccccctgggagtcagagcgttccctccctccttgccactgtaaatgactatttctgtcgtttgcagagtgtccttttctttctcctacagccccatccttaccctctatagccatcaggtcaggtgcgtcttcttcatttatttatcaaaagggccatagcaatcattgcaaacatgtttaggaggatttggaaaccatgttcttttaaagggcactaatgatgcagcagtaatcacagtgctagtggaaggggagggcagaatgtgatgttttgggagtgaattctgtaagagaagaagggactgcgttcctagccctccagagcttgcagctatcacagcctggctggtggaggggcttgcagagctgagaaccactcagaatttgggggctgaagaccctggctgtctgagcaccatctctgtgactttcgaggtcatgttttccctccagccctcatttccccctttataagctgtgtcttagctagtgctttcagcaaagaatatctttaggctcctggaggattgatatcccctgaagtagcccctgaccagcctccaagatgtatcctaaaagctcctatggaagtttacatttcactcaaaatatctgtgttcatgtaaatgtaaaaatgatgtcttaagatgcttagcagtgaataaaatgggtgctctagggagatgcagtgagtttatcctgtggctttgagtatacactggtaccctacgtgggagaccccggtgcccatgcccgggtgcacaaagccagcatcagtgacctgcacaccaggaggcaggctgcatgatgattgggtgcaagtccttaggtgggtcactcagtctttcttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttactgagcatctatctgtagcactgcatgtcaagccaagctagagtacagtctcttaggagacacaggggaggaaaacatccttggcaggttcgcatattggtgatctcgtcgtaattttctcaaatacccttcctctttcctcacttttggtgataactacctgtgttgctcttgtcacttttgcctggatccactaactcactacctaggtatctgcaacagttatccattgctgcctaacaaattaccccaaaatgtaagcacttagaatctcattgtctttgtgggtcaggaattagggagtggcttagctgggtgattctagctcagggtcttttctgaagttgccagcaagctgttggctggggctgcagtctcagaatccttgactgaaggggaggtttcgtgtccaaggggctcactgatgtggcttttagcaggaggcctcagttcttcaccatgggggcctctctgtacagcttcaggagcagcctcacaatatgtcatctggtctcccacagagtgatgatctcagagagagtgtgaggaagatgtggcatggccttttaagccccattcttagacatcatgcactgtcaagcaccgtaactttagctacattctattgattagaagaatactagtaaagaccatagttaggagaggggaacctggctccaccattggaagggaggtctatcaaagaacttgtgggcatattctaagaccaccacactctgccactccacacaccctgactctcctaacacctgctcgcttcactggttcggctattggcagtggcatggagtgtgggaaaatgcgtccctctctccttcctggattagaaaagtcatcatcctgctagtgtgaatccatgtcctgtggtggccctctcaggagggattgtgattaaagaatggacaacccaagggaatcatgtgtcatggtggagcatacaggccagcaggtgagttggggaggcgcctttacagaggaaaccttgagcttcttctgtgatattcattacagaacttcccccaaagacagatgacatccatttataattatttcaccagtgacttttgagctcatgcagttctatttatttttctctctgaaagtaagaaactttctttaaaggatttctgccatttggacaatgtgctatgtccccattggtgttaatcagttggtgggatatagaaaagcaaagtggccaggctcagccttttctctcgatctttttttttttttttttcctttcttaagaaagggtcttgctcttttgcccaggctgcagtgcagtggtacaatcagagatcactgcagcctccaactcctaggctcaagcgatcctccagcctctgcctgccaagtatctgggactacaagcatgcactcctgtgcttggttaattttgactatttttttgtagagatggggcttgcttgcttttttctccagtctggtcttgaactcctggcttcaagcagtcctctcacctcattctctcaaagcactgggatgacaagctctttctttataccagtcctcaacttgcactctttcctgcatacagcttgtttctctaatgtggctgttctcatgtttacttaatggcccagccatctcctcctcctcctcctcctcctcctcctgctttctattctccttcctcatcattgtcctcttctgcgagttcagaaaattgggttacaatacctacaacgtgcagtgaggacactcttttatcataaccccagtaggcttatggtgcttgtatctgatttttcatagtctttcgcttgttaatttactgcacatatgttcctttctcttgtgcattactgatgtgtttaagaatcttgaatatctatatggtgcttagagatttcacagcagttgattgaatgctgttacctcagcatcctctgtgaaactgggtatgactacacccattttgctgatgaggaaactgaggcataagaggatccgataaattacccagagtcacacagctcacaagcaagtgcaggcttccagccaaggtttgctggctcatgcgtttcatgccttctctatggtaccatacaggcactttgtctcccagtggaatataagttctttgaggccaaggactgtgtcttattctgtgttgcatccctttggcttcagcctcattgtcttgagtttattaagcatttggaacatttcagctgaatgagtgaatgagtgaatgagtgaagccatcagtcaaatcagaacactgctcacacatgcatcccaagtccagctgtcgaacgtctggaactgagcagtatggagcctgttaagaccagtgatgctgtggcctgaataacaacaggataggaacattcccttcttctcataaatcttgtaaatttgcattgtttgtgccgaacagggcccgtgtgttctgatagcaaacatggagaggcccaaaaggctgatctgggaccatgtccccattgaacactgctctgtgctgagtctgcagaatatttaaataaggggttaatttataaagtgagctacgggaaagtttccaggattgtcgtgcgtgtgtctcataaatcggcacaaattgaatctaggtttctaggtttctgtgcccctcagctcctaagtaaaccaaaatttattgagaggtgtataggttgccatccaaagaaacatagtaagtgagaaaagtgtatcctcaggaggtctgtaaacaaggtctgaaggctggcagaaaggaccagggtctgcaatgtagaatccccattgccgatgatcagaaagtacagcgtagtttgttgcagatgaagacagggttccaggaattcttgatctttcttgaacattccactgacttcttaacagaataaagattttgtatattgcagagataatttatagatacaggtacaaaggggatacagacaaagagaaaggctaacttcaggatgttgcgtatgtcaaatcattacattagtttacccagaaccaaaaaaattatgcaatatataaatatgaagctttagtttttcatgattgttcgtaatgacattattatgataatgactgtttgtaataatcatgcgtaccaccttagtctgagcaatcatattagcagttcgtaattattgaagggctgtcaggaaccagacactgtgctgagtgttctacaaactgtatttccagtcttcttttttgttcaatttccactcaaatttttaaaggggtttggagggcgttagtgtgcccattttacagaggtggaggaggaagctccaaaaatgaagcccaaggatcttaaggtaatatatgggcttgaatccagtgtatcttgctccgacagccttgcttttgtcattatccaacattagctgtctttattatagtggccttcttaccacctagaaaacaagtgccagcattctagtaaaatttattcaccttccgagattatttactattttagtctgtagcttttatccctttaactacaccattcaaagcgttgtgcaaaatattctagtagtaaatagaggctttaaatccacacgttgataatggtcaaatcctcttaaaggggccagcaacaaaaatgactttaaaggggaaatattccttcaatgttacaagcgcccatgagcatgttagtagagcagttgtgtgttgaagaaagagaaggtggagtgatactgaataccccgtaaaatcacacaatcagcacttaagaatgttcacacagttgttcacacacatattgatatcagaccttatagcagtcctattggctagatcagttattatgaatgtgttttatagagtaggaaacagagatgcgacgtgacttgcctaagaacacacagcagttctgaaactcaccctgtgctaatctgacctcgtgaagaaattgagcaaactaggctccagggagaaacgaaaacaataacaacaaaaaatgtattgccaaaaaattgctagcagacatctagaaaaatgtcttcaacttcttttggtaggaaaagaggaaaaattcaaatctgaattcaacatatttatttttttgtttctgactttttacgtaaacagagctctgagttgtatcctcagatatatttgagactaacaacaaggaaatataaaattatgttactacctaagctgccacttcttcaaagcctcgttattcttgttcccttcaatgtatttcaactccaaaatacatagtgacatgaaaattgtgtattcacattgttctattgatttcgttgagaaagtgaccttgtatgcacacatgagaatttagagatctatatataccgcctggcctcttctttgtaagggtataacagcagtggttaacatgcattttttttttttaacagttagatttactcttcctttgcacagactaatagcacactgaggtaggatccagggacggctccttggcaagttgtactgctgtggcctagggagggacaactggcagggccacacaaggaggtaaaaccttatgctccatttgcaaagccagtggccccagcagagataggaggccctctctgtgatttcggcagtggtttccctgggattgaggtctcctgaaacttattcccgcaaggacatactactgtggacccacctgaagggtggcatccactcttctagtaggatctcacattggtattttcagacacttctgccccttgccatgtttagtaagtcatctatgttgtttgggaggaaagagaatgagcattcctcagttcctgcactgcaccaggccttgccaatacagtacctcatttaattcttgctaccatccttgaggtggctggcattaggccatttgcggggtgtagaaaatgacatgcagaaatactgtagcagctcacttaatatcaggcagatggtaagtggcagagatgaggctggaccccaggatttctgacctaatttctgatctctttaattattctatacaccaaaagcccctgtggtttggattcctaatcacgggactgagatgaaacagaatctcttagcatagggggccaagcagtagatgggcttttgcgaagaagttttttcttttttcagagtcagaggttggcagcaaaatatgagagatggaaggtcaagtgcagcagaagagagaaacagggagagtggaggttgttctctagaacatagaagccgcttcttcatcccacacaatggaaaccagagcccagattatattaacaagaagttccagaattgcagatggccctttgctgcttagggaggggggagaagaagaaggagaaaaagaagaaaaagaaaaagagcaggtggaaacttaaaaaaatgtttagctgcatgtagatggcttttattataactgctaggctgaaccagaagacttgagctatgtaaaaatgtcacttgctcttatcacggttcatagagattacctttcaacgcgagtttcattttcatttcttccaacacttagagaagtgaacgaggcagtgactcctttattccctaaccctcacccagcaacttgctttttcctctgtgttttgtgtcattctgtgtgatattgcatcaaggcaattcacggcagtggttgaaccaaaagcaatttaagtcaaaaatggacaaatatggatgtcacttataaggcttgttcaaaggcctttgacatcactcaaagcctgaacacttctcaggagtgggatacttttttttattattattttttattttctagcagtgcaagattgaagatttaatacagacctcttaggcgtctgcgtggttcttacctagaaactgtttattggtgaaccaaatattttgtatcttataccaagaaagaggggctgacaaagattgagtgattagaaatccaagtgaatttctatttattattttgacttggtaatttgtaataacaatagccaccatctatctatacttcctagatttgggcatggtgttaggagtcttatatttattattttacttaattttcatagtcatcctgtgtagaaatatcaataaatataaaggtaagtattattgtccccattttacagatgagaaaatggagtcccagggacctacctgctcaagggcacagaaagcttgaatgagtaaatttactttgtgttgttccaaaggtttctccaaaggtctttgcacctcccaaggctattctcattttgagaaagactggcacagttagaggccaggaacccatcttggctgtgtgccttctgctttgtctctggggttgtggggaaggctggtagcttgagagcctcctccttcaactctgtcaggctgcatgcacattggaaggtagcttttcaggttgtggtgggtggtggtgaagcagagggatgcaaagcagggtacgtggagggctgtgccttggtcattcccaggaagcaaagcgagcgtcaaaaaaagacagggtagttgggccatggcgttgcagagtgacagtgaaccaggaaccagaagagctgacttcagaggaggctttaggcgctcctgcatgttgattcttagagaactaaagacacagttgcatcttaaaatgttgagacttacacgtatacacaataagaatattttctttggctgcaaatgtactataaaagagtgaaaaagccaatcccaaaagattacattggtaggattccatttacataatgttcttgaaattagaaaattataaaaatagaaaacagatggctgggcacggtggctcactcctgtaatcccagcactttgggaggccaaggcagatgggtcacctgaggtccggagttccagaccagcctgaccaatatagtgaaaccccatctctactaaaaatacaaaaagttagccgggcgtggtagcacacacctgtaatcccagcaactcgggaggctgagacaggagaattgcttgaacccgggagtcagaggttgcagtgagcccagatcgtgcccctgtactccagcctgggcaacagagtggtactccatctcaaaagagaagaaaagagaagaaaaggaaagacaacagataagtgattgccagggactggagaggagtggggggtgagtgggaaccagagtggatttaaaacagcaactggaggatcctggtatagatggaaatgttctgcatcttgactgtctcaatgtcaatttcctggttgtgaaatcgtactagagttttgtgagatatcacctatgggggaaactggatcaagggtgcatgagattgctgtattatttcttgactgcatgtgaatctacacttatctcaaaaataaaaactttcattaaaatcaaataactgcttaatattttgggggaaaaattcaacaagtaaattcaaatcacccacgagcccaccacccagagagagtcacctgctctattttgatatattttctcttcctcccttccagtctctctcttctgttcctagatataaaatggagaggttttaaaatgtaattacatctaactatcccctggcttggtaatatccaaccttttcatgtcctcagagaggtccaaaggctttgctgaaacttgttggtttggcattgattttgacaaaagacagcaacaagatcccctttctaggaacccatgtggattactatggattcagaatggatgcattttatgtacagggctgtgactttttctttccccttcctcatgctaataggtgttaatactttgcaataaatattacttatgtctatgaaatgaactgcatcccagcctgtcagcacatatttattttctcattttagtttctccaggttctcactgttatggagggtggggagggggtagaataaggttaggctggagggcatatctgatttggaaaatacatccctggtgatgttcctaccaagtcacaggcttggttggtgatgctaaattgggactgaggaatgggttaggagaaggcttgaagaacccacctcctaaaaccgtctcatcatcgtctagagatatttctccaagtgcttttgtttccagtgacctcccaaccccaggaactagcgaagccttcaggcaggtaagcgcacaaatcctgcattttctagttaaccatatattattagctagtgacttgagcaagttgcttcattttcctgatcctccattcccttttctgagccacagtttcttcgtctttgagtagagttaacaaattactgggtgtttgaaagatcaaatgagttagcacatgagaacatgctttgcacaaacaaagttgtatgcaaaataagttatcattatggcatgggagaaactgtttgtggacattgcctcccagttgaccctcagtgtgtacttgtggaataattttttaatataaaataattaccatcactaatcctaactgtgcacattcttgactctgtgacactgagcaaaatcctgaacctctctgtgccttgatttctttcacgtcttgttctagttttgaagagcgattcttgtgtgaattcagggagaggaggcatgaggcatggtaaggccactgtacgtctgtggttgacaaattcagtaggcccacagtcaatgcaaaagtcctcttgcctctgcagcacagttacaatgaagaggagcgatggcatggcatgatcccactacttagggaggctaattatgtagtgtctacagagccagtggtttattttgcattgtttatgtcagcattaagcagtattgttacacagtttgtaagtcttaaaactcagtatctactctagtagttgctccaaatgtgatgtcctcataaatcaccgagggatcttgttaaatttggattctgattcagtaggtctaggtggggcccgagcttctttgtttccttttcttatttaatttttgtgggtacctagtaggtgtgtatgtacatatatatgtatatatatatgtggttttttcaaaaaaattgtgggcacttagtaggtatatatatttgtggtctgtgtttcttataaattggtaatcccccaggggatgcctgccttgttggtccaggtaacacacttggagtagcaaacatctagacgtagttctcaatagtaggactattgccagtggagggggcattttggaaatttggaaaggcattttggtggcctttggcacttagcaggtggggtccacgggtccatcctgtgatgccataggcagtccaatataacaaagaactgccctcgtcccggtaacatacacctgtgcccccagacattcatttcggtaaaaaacttgtttccattgatctgaccccagaattccctgtgcttatacagatacacaacgtgcactgggtcttccagaaatgcaggggccttctaaatcaagggaagattgtgtggtgttttgttccagtcttttaccaaggtctcaataccatcttgaaacatcatgcagcactgctcataatatttgagtcaccataatgtgatctgtctacatatgtagctgtttgtattcatggtgattaaatagttgggtgctagacatgcccttagcgagcagctcatgagagcagattttgcctgtttcttccaaaatctggattcagtgacatcgtgttggtagcttgaaactgaccgtggtgagaatatttacaccatggaaagtggcaaatgctactaataaggatgattgttttagttttcattttgtaattttcagagttggtttaccaatatgatgtctgtattaaaatatatgtaatgctgctttcaaaatgttaagtattatgagaatacattaacaaaactctggcgaattttttgtcttatgtttcttgaatccaaacctataagtaggtgcaaacattagacgatttcattttgggcttctgatacactcctgtccgagaagttacctttgaaaatgtgtactattttattgtcaattatgttttctttaaaaaaaatttatgacatattacttttgctaattatgtgtgtgggtagattatgttattcatgaattttatttcaggaccttggtaaggggttatacaatatttcttttgaaacgagggtctcgattattgggcttgagtatcctgatctaattaatgcactggacagagctggcagacgtgtgggacacccagctattctctggaagggaagggggatataagagacacactataaaggtgaatggtaattggcatctccccttcaaggggaccaggaggatctgagctgactgggtgcctttgtggaagtgtgttttgaactgagattagagagatcagcaatgtatctcttaaagtaatccaggaggagttcattttcaaccgattcagcagtggaacacttgaagaggaggaagtcaaaattcaaaatgggttgggtgcagtggctctctcctgtaatctcagcccttttagaagctgaggcaggaggattgcttgaggccaagaatttgagaccagtctgggcaacataggcagaccccatctctaaaaaaaaaaaaaaaaaaaattaaattagctgggcttggtggtgcacacctgtaggctgagctgctcgggaggccaagatgggagaattgcttgaggctggatgtgtgtggctatggtgagctaggatcacgctactttacttcaacctgggtgaaaaagtgacaccctgtttcgaaaaagaaaacaaaaagttggaaatgagtgggaaaggatctaagatgattggaaacagtgtacatagaatacaagaggagttgggcatgctggctcatgcctgtaatcccagcactttgggaggtcaaggcggatggattgctggagctcaggagtttgagaacatccagggaaacatagtgtgaccccatttctacaagaagtaaaaaaaatcaactcacacctgtagccgcagctactcaggaggctgaggcagtagattcatttgagcccaggaggcggaggttgcagtcaaccaagatcacgccactgcacaccagccgggggtgacagagtgagaccctatctcaaataaaaataaaaatagaatacaaggggggataaagatagacttaaaatacgctctctagaaaaaagaaagaaatatggaaagaaatctaatttagaaaaatgcacgcacccacaggcacgcttcacaggactggcaggtggagaggatgtttgttaacagggctggctattttactttaagtgctgcaaacattgcactaatgtttgggtctttgcttttggcaatcacttctcttgttaatttttttttggcaccatagaaatgtttccataaatagtgcattcaatggagtgtgttactttattactgtcagccactgtcctaggagaggaaaattcaataaacacaaaagcaaagattagaacgttgaaagcttccaattccagatccttcatgagcttgtacctctaaagaatgcgatttttctatttctccacctgcaaaattcttactttttgggctggtaaagccacctaggtcagtgccatgtccaacccaatctggaaaacgattattgtggtgcctgttttgttgacttaacaaagccaatcgcccattcctatgctgctaagatgcgaatgcccagctcaggggatgagattactgtcagctttgcctaagctttgggcattagcaccctccatatgcaacaaacccacaaatgacatgttttgactctttgacacagaatggttggaaatcacttccttggccagagcaggggtccggtgtaaaggaggaaataaaaataaaaaagcataaatgaatgaggaagtgagcaaatcacactcatcgaggagcaaaataattcattccctctccgtggctcagcatggatgcaaataatgtatcattaagtaagtccacaaaacaaagacagccagcataactgttgcatcaaatatttagccagagccaaaagcaatttattatgttttttaaaataagtttgatttactaaccttcagcacaatccctatttttagaggttggctcatatttttaatttgttttctctgaagcgctgcatccttggtagcgtttcagctgtccactcggttcctaatggcagagcaacaccgaaaagcgtaattacatttcctaattatgtgtaattaggcaaaacccagatgatgtattcaacatgctctgagaatagccaggggttaaagactgctggaatttggtaacatttttataaataagctggtgcgttatttaacgtggaggtctaaggtgacgctgggtgccttgtagaccgatactgtggttgaaatctatcgtatttgtttatttagccaagtaaaactgtaagtgattccccacctccataccttcccctcttttggaaaccagagtttagttgtgctattcttagcccaagagaggccctctaaacccagaaccataaagttctgcttactgacagcctaagtgatatttattttttcaaagcttaatccttttgaaacatggagaaataaatacatcctcttatctaccatatgcctgggatgggaaataaattcttattttcctgccgtgtggtaccagtgggttacgatgaataatttgggcagtctcactgaagataatagggaagccttctctattaccagtgataattatgaatctcataatggaaaacatcccgagcccgaacatcaatcagggaagataaacaatgggaaatgataggtgtacaaaagggaaaatggcaacagcacatgtggagggaaagaccgcagaattctggcagggttataaatcatacagtcaaataatttccgtgcaattaatatcctcaaattaaaacatacctttttaaagaaagattttgcagacttttaagctgggcaactgtctgccttacaagatgcgtctggaaaccccagtgccatcctccttttttagtcttgtatatttatgtatccccggccagagttggctggggcacagtctaacagtgtcaccgtgtaagctgacccagtgaccttgctctagctcaccagggactgagcatacaccaaagtggccagagctagtggttgctgactctcaggatctttggccctgagagaacaacaaagactggcctattgaggcaggaagtcttaacttccttggccagcctgaaaggctgtctccaaccatgcggacacagcgcagtgaagcggttggaaaagctacagacaaatggaaaaccttcattccaaagggtcgttgtctcctcctatttaatagccctgcattcatgcactttttttatcttgctgtctttttttttttttttaatcaaataccaaagtacttctatggactggtcttaaaaaaaaaaaagaatccattcataactgtgaaaaaatactgcctattagtctgctattgtggctcaaaatgaaacttaagactacatggctaatttatttactgcatcatgggtgaagaccaacaaggtttccagcctttcctcctatctgtctgcatgtagaaattcacagaccacggccattctgacatgaatatcaaatgagaagttttccattccaaaccctttttaggagcggcctggaaactggagtcaactgtcaaatatgtccttatggccacaaagtatgctcatggattctcttttacaggcttagcataatattttataaaacatatttttaaagaaagtgtaattttcccccaaaagcaagggttttccaatgccatataatttactaagtgtggctttgctgcgtaatagtccataatttatagtcagcctccacaaggcaaaaaataactccaagctatgattaagtaagtaatggacaaggtaactaatatttccggaagaatggccttccagacactcattttaagtgacaaaatggttgaaggttgagatatgtactaatcctgtactaatttaatggaatcaagaaatgacattataagctggcttatgtgggcacttaagacatggagctgagagtgaatatgagagtgaatattctgcacgtccattttaatgaccttgtgcctcattttccccatttaaggtagatgggtttatgcctaattgtgccaccagtttttcccataaaataattcatttggaaggggtggcctaatccagtctgaaccaattctaagatggtagcgtggatgcgggaggcactgcacaggatggaaagcatggagtttggaatctggcacaagtggatttgaattcagacttagtcatcaggagctgtgggaccttgggaaaggttggttggttggtttgttccagtttttaaattttgaaataaatgttggcttacagaaaagccataaaaaatactgcaaagatttcccatgtactcttcactcagcttcccctaatactaacatgatacatttttcagcactgagaagttaaccttgttatgatgctattaactacactcagactataactgaccaacagactttatttggatttgacggtgtgtcctcttccttcttttacaaccagataccacctggcatttattatcatatctctccagtcccctctggtctgggacagtttctcatgcattattttttttaatggccttgaaatttttgaagagttccggtcagttattttgtagaatgcccgtaatttgggtttgtctgatgtgttctcttgattagaatgacgtggtgcatttttgggaggaatatacataagtgatgtgccattcttcggccatcaagtcagaggatgtgtaatgtgaaaatatcttattactagtgatgttagccttgacctctcggttaacgtggtatctgccagatttctccactgtaaaggatcatttttttcctttgtaattaataaatatattgggggaggtactttgggactacttctcaaattttcatccattaattttagcatccctctggggatcttgcctgcaatgattaatactgtggtattctcatgactgatattgtctttctgtcatgccttctattttttggtgggaattcttctacatggaaggctgtttcttcttctccatttatattggtatggatacgtgaatatttagtttattctgtaggtcataatacgacagtattgtgatatattttggtgctcaaattgttccggctttggcccataggaggtctttcgggcaggttcctgcacccttttgacatgccccgttcttttttgagcactttcttattttttggcactgtaagaggctttacactgtcatcttggacttccctgcctcagtcttggaattaactcattctccatggaggcttggttcgttttattatagaatcatatttagaactaagatctaggtgctagttgcgctcattactgctggagtgtcattgcttctagaacttctcaacagagtttagaaatatgtgtattatacaaacccatgcacatacacctatctccatttattcctgtatctctgtgtatattataattttagtatatttatatttctttctggacacattccattatttgttcatatatttataacatatcagtatctattataaattatatatatgtacactttaatgtgtgtttgtacctaattccaatccaacacaacaactgggttttttcaaacttgtttctttgtttttttctttttgtggagagcagggtcttgctatgttgcccagctcagtctcaaagtcctgggctcaagcgattctcccgcctcagcttccctaagtgttgggattacagacttgagccactgcatctagccacaactgagttcattattctgagctttctttgggatgttatttaactctcagtttcttcttctataagatggaaataataacaactaaaggctaggatttggggaaggtatggtaaattgtaaaaatggtagcttgtttaaaaaaaaaaagaagaagaaaaaggaaaacagtatttccctcaccgcatcaacacctgtcctgtatgactggcattgcccagtggaatcttagcagcagaggcatgacaagcggtcagatactgggactttctgtttcgttgcttacaaccctgtgaccactgcacgaacaaccctgagctgacctgctggagcatggtggccacataaagggagagtggttgccccagctgatagcctgtcggtgcctggcatatgagtgaggtccctctagagtcatctagctactagccaagctaccacctgaccccagacacaccagagaaagagcacagcccattcgcggactcagaaactaaatataagaaaaatggtcactgttgttactcactgggttttgcaggggtttaatatccagcaaatgccaatgaattagagttgacatacggaaaacaagtaagagtaactttgtacaccgtgggctcccaatcagtgctgcttttcgttgttgatgttgttgttaatgttgaaaaaatcttcaagtcatatttgcccccacagaccttcccagacagtctaactaaatgcactgtatttgctaactgttggaacttggcttttggactagaccagcacctcgagaaagaaccactgttaaaatgtaaggctctgagtgtttatcagctcacaccaaggaagagagagctcaggagcgactgggcatgaggtggagtgagcactgtgaatgctggggaatggaaagtcctttatgtggtgttgcctaagggtacggggaacctggcctggtgttgggaggaaacagggtgcagagtgggaagggcaggagtatctaagtggccaaatttagcctaattaacagatttgcctagggctgaccctgaagcagaaagcaaagcctagatcagtctgctctcctcctaccaacagggtaatgatgaggttgaaccaccagttctcaatgccatacatgagattcccaaaatagacgggagttacacagagaccttttttttttttaacctcctctgagattttttttaacctcctctgagattctgtatttccttaatgacccgaaaaatctatttagcccagtttttatccttgcagataagttagtacgcttctttttctgctggttgtgatcatatttctatttaggggtaaaggtgctgaaaatcatttgctgcgatgactcgcaaagacatagttaccatgagcagcagtaggatgggtggccaccagactgccatgggcatgatcactgttgacaatcttgccacagctccccagggtctacttggtgtcccacggaggacagtctatacagtaactcaacattaactgtgtacccctcctagtttggccactgttctgcccaaacatacaagagtcaatgtaagtctctgggagcactcacctttgggcatgttgctacagagtcactcattcctagaaattgcgaagtcacgaagttgtcaaaaaacacaacgacaggccgggcgcggtggctcatgcctgtaatcccagcactttgggaggccgaggcgggggggatcacgaggtcgggagatcgagactatcctggctaacacggtgaaaccccatctctattaaaaatacaaaaaaaaattagccaggcctggtggcgggcgcctgtagtcccagctactggggaggctgaggcaggagaatggcgtgaacccgggaggcggagcttgcagtgagcggagatcgtgacactgcactccggcctgggtgacagagcctgaatccctctcaaaaaaaaaaaaaaaaaaagaaaacaactacaaccacattttgagataggccttccttggcaaactttgatttcgtttctgtatttgaggacaaaacacagtatggttgtttccctccctagactagatttctaatcttgatgcagtgagcaaagggcgaggtttatattgttcttacctgagccaaaggacccataaaaaatagagtgataggctgggctgggcgtggtggctcatgcctgtaatcccagcactttgggaggccgaggtggtcagatcacctaaggttgggagttcgcgaccagcctgaccaacatgcagaaaccctgtctctacttaaaatacaaaattagccgggtgtgatggcacaggcctgtaatcccagctacttgggaggctgaggcaggagaatagcttgaacctgggagatggaggttgtggtgagccgagacaatgccattgcactccagcctgggcaacaagagcgaaattccttcttaaaaaaaaaaaatagagtgatagagtgagaatttggcttttagtctacagaagttttcactaccagtttctgtgtgtgtgagtgtgtgtgagtgtgtgtgtgtaaaataccaaagagaaaacaataaaaaaatagagaaaataataataactagccaatgtgtcatcactccagacaacagccatggtcagtatttggttaacccattcagattttcccctatgaatgagttttttcgcctccataatattagttataatacattgatactacatcccgagtgtttcacttaacattatagcacaagtgtcttcccctgttgtaacatagtgattattaatgtcaaatatcagctagataaaagctgtcaagtgatagaaagtccttatagctcatgaactcttcaataactgggaatttataccgtttatagtttttttactgctaagaataatgttgcaatgaaacgtttgtatataatgctgtttagtcccctctcccccattgtttacgattccttggagttccactgctacttcatatttaccatcaccatccttgttcaccattgttgaagctttatgtaatgacgagcctcatccaggacctacttgtgtctctgtgccagtcactgcctgtgaaccaggggtgtgtggactcagggctcaattcaaaaaagaacccaatcttattgggacaaacagatattgatacccctggtctttgagccccactgtcttttcacactaatgagttcttagtgtctatttttggtgattgagtagaacttggtgccatattggctcaacatggaagatttctgtgatcacttattgatcagtcatgaataaggaatcgggatggcagtcgggagtgtgccaacacctctctcagtattctgggtctctctgcatgtagtgtttcttttgcagctcctagagataaattttttaatgtattacatgtgagttatttgaaagagggtaggtgtggacagtgaggccaggtgacttaatttccagaagcttgcctgtggtatttaccttgatgagttcattaacaatatggctttcaccctcaaacttgctcattcagaaattagactttgtgagcccactaagagtaggtctttctgttaggtacagactctacaataaccaaattcacagaaactgatgtgtaaacccagggtcataaacaataattttcaacaggagctataattatcacatagtttgaaatgctcttgttaatctgagtaggaagagaggatgagaattttcttataggtggaactacagaaaaagagtttacttataggcagaagtacgggtactgagccaagtgacattgtaagttatttaattggcaaatgattaaagcaaaggtcattgcctatatgactcaaatgcttggttgcctcagaagataatgagcctgatactttcacagtgaagctgtattgcacgtttgtgtttgtttattttccatctttcccactagacggtgagggactttatctgtctcattcaccactttgtccaacctaggacagtgtcagacacatagagatgctcaataaatcttggctgaggcaatacgtttcaaaatacaaggtgactccaaatataaaacaattttttattttcaaatgaagtggacctcccctaaattttgtgcccagtttataaactttaggggctgtagatgaactgttcaaaagttttattgtaggatttcacttgctaatgcattttcacaagtaatgtatttattttaaaagactggagtttttatatatccttacatttatgaaataatttcatttaaacccttcatgcccatcttcagcatcattgctaaagcctcttggtttctgtacctgtaatcttcattcattcctcagctgtttgaaacacagcacttttgggatccttgtataatactggccccacaatcaagagtgacttgaactgggacatgtttgtatttcttcaagatgacttttcattctctcatctcattcattttgaggtcattttgttgttgaaatgttagagttcaaccttaaatacttaagagcatggcactgtctagagaaagggagatgagcttctgtggtagccagaggtcaagatggcctctagtgaccctcacttcctgggttttacattgcagtatatttctcttctactctgaacaggattgtcctgtgtaacctacagggggaagtgatagcgcatgacctctgaagctaggtgacaaaatacatttggacttctgctttgcttctcttggatcactccttgtggcagaagctagacaccatgttgcgaggatactcaaacagcaccatggggagatccgcatagcaaggaatcaggcttccaacagtcagaccagattgccagccaacatgagcgagccttgttggaagcagttcctccaaccccctttaaacttttggatgaccacagatgaaatgaccatcttgacttaggagacacccaagtcaaatcagctagctaagctgctcctgaattcttgacccagaaaatctatgtgagggagtaaatatttattaatttttaagatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggcagaaacttttatacagtaataaattctttgttccctctgcatatagcactttctcaaaaagtagtttggtgacaggcttctttcttctcatcattaaatgacatactggagatcagtcagatgaactgcaatttatatcttgcccccacccagtgttgatttgcccggggtcatacagataattagtaatgtcttatctcagttttcttatctgcaaaatgagaatacctgatggggttagtgtgggagtttaatgtctgtaaggtgtttaatttgttgcataacaatatgttgtactatacgttataacaatatgttaatatgttgccatgtatagccatggcaaatgcatagtaaatagcaggtataattattattatttttttcttttttgttttttctgagacagtcttgatctgtcatccaggctggagtgcagtggcgtgatctcggctcactgcaacctctgtctcctgggttcaagcaattcttctgcctcagcctgctgggattacaggcgcatgccacgaagcccgactgatttttgtatttttagtagagacagggttttgccacgttaaccaggctggtattgttttcattattgtggttatcattatttatttagttattgatcatcaaaatccagaaatccagtttcagcaaacattccataacccggtgtgctaaaaccccctcactgctctccattactcatgaatcttcttgaccatgaggcagaatctttgtattttcttctcatcaaggattttatctgaaaaacctgtagtacttcgcctttccctgggtggagaagaggggcggataaatacttctaaagtaatgtagtatgcactctcctgcgtggtgggggtgtagtgggcttcctgttatgaaacccagcttgtaagcatgtatctacatcccagggaggttttcactgaaccaagagatgccataagcagtccttgttgtaataatttaatagcgaagccctcagcaatagatcttcaggtaaaatggatgctgactgtctgtctgtcatatgaagattcagacattgatgtaatttaaaatacttgtagtatcatggatacaaacatatgcctttttatttctgaaggaatttccagaatgttcgattaaaaaatgaacagaggaaatgaaaaataaaattgtctgttgtaccaccacctgaagataaccactactatcattttgctatatttctttctatatttttctcagcatttacacgattgtttttacatagtagtgactttgccgaacagttatttcatttcgcatcttgatattttttctcaattaaaataataattgtgaacattgttctttctactctaactactcaggttgcttataatgagcttgtattataataaaacttcattttattttagataaaatgaaaagatgttactatgcaggtaactttatttattatttgcatgcagtttatcaaatagaattccttggttcagcaaaatgaaacctttaagtcttttagcaccaaatgtttgaaattatcatgaaacacattctaatttggcagtgagttcaggagatgaagactgtcctttagttaacatcaatagctttctaaaatatgtagccagttaatattttacttctgcctatgcatccctcaaattgtaacacccctggaacataaaaattcctctattgagattaacacctaacgatacctgtatttgctaatttgtttcttttttttctttgaagcagcatgttgctttgtcacccagactggagtgcagtggcgcgatctcagctgactgcaacctccgcctcccgggttcaagtgattctcctgcctcagcctcccaagtagttgggattacaggcacatgccaccactcccagctactttttgtatttttagtaaagatggggtttcaccacttttggccaggctggtgttgaacccccgacctcaggtgatctgccctcctcggcctcccaaagtgctgggattagaggcctgagccaccgcgccagctctatttgctgatttttgaacagcagctttttttttttttttttaacaaaactttaaaatgggttatgtgttttattttcttagtgaagtaatggcttctcaaatttacactccattattttatttaaaaaaatcagtatgattcatcataaataagtcaggactatgattgacagtctacctagaaagattaggaaagtggggaccaccccccaattattacctttgtttttacaagtgtgtttaaatctctttctgttaatttacaatttgaaaggtgggtgaggagaagagtttgaaaaatagattactgtcttcattaatacaggtttgacctacaaagtcttcacgtacttaatgattaaaaaccaaagtactaaataataaattataagaatttataggagtcatcttcttgaaattagcttactgaatgttcttatcataataaatctgagtgggtgtctaatttagtgttagctgactaaaattgtatgttgcggggaggaaaaaaaaacacttttgtttgaagacaaatgcagtgagtttaatcacaggtgatctgaaaggcaccacctatcttttgctatgttcactttgcagaaactttggcgaaactggctgaatgaagatcgattccaatttgtaaatgtggcagacaataaaatttccccaagcactttgatgatgtttgtgttaatacttcctgctcagagctgtagcccatcagattctagagctaaccgaagagggaagacaacctgtcttctcccagtttccagcctgtatagacttaatcattttcaaggtttaaggttgtttttgtttattggttggggtggagagagacgcaccacctctcctaacttctgtgtttgcttccctcatgctgtgtggatcagaaaagatagcctgttcattcatcacttatttcctgacttccaccttgggtctgtcagattctgtgtgaagcccaggggatccagggaaaattgaggcccagtccttactctcatgtaactcgaagtcttttacagaagacagacttgggaacaaatcaatcaaaatgagttttgtacggaaaaagtcggtgcacgcacaaggtacccaagaaggaggtgactaactttatctaactttacttgcagggcaaggcaaataattagggaaagtttccttcagacaggggaagacaaatatgagtatccagggaggatgtttctggcagagggatcagcataggaaaggagttcagggttgaaaagagtcagtctggtccctagaaataatttttttggtgcataaagggccagaacagaatgacagaggaaaatgataaggatttaggcagggactgcgttggaaagggccttgcaacaggcctggacgttgtttgtaggcaagtaggggcaccgaaagctttaaagcagggagtaacaggcttgtagtgacttttatcgaagtagaagttgaatagatctagcctggcacagtggctcacgcctgtaatcgcagcactttggttggctgaggcgggtggatagcttgaggtcaagagttcgagaccagcctggccaacatcacaaaacctcatttctgctaaaaatacaaaaatcagctggttgtggtggtacacccctgtaatagcagctactcaggagtctgaggcaggagaatcccttgaacccaggaggcagagattgcagtgagcccagatcatgccactgcactccagcgtgggtgacagagcaagactctgtctcagaaagaggaaagaaatggaatagatctctttcagtacaatgggaaggggcatataattcagtactttaaaaaaatgtactatcttatgaaatagaaatatacatgtacatagatttaacacacatattcacgaacatacacatttacatatacagtcatcattgcttagagaggaggttgtgttctgagaaatgcttcgttaggccattttgtcattgtgccaccatcatagagtatacctatacaatcctagatggtataacctgccatactcctaggctaggtagagcatattgctccctggcagcaaacatgtacagcatgtttctgtcctgaatactgtaggcaattttaatacaatgctaagtatttgcatatacaaacatagaaaaggtacagttaaaatatggtattacaatcttctgggatcaccattgcatatgtggttcattgttgatcaaaatgtcattatgcagtgtgtgatagtgcttaaataatttatctcacatatgcaaagagttttggctaagggaaaagaaaaatgtgaacctcctaatagaaaaatgggcaaagataatgaacaagaaattcattgaaaagaattggcaaacatgaaaaaattctcaactttatttttaatcataaaaatggaaattgaacaatgagatactgtttttcaccatgacattggcaaaagttaagaaggcagataacttccatgttggtgagcatgtaagtataaaaaggtataaaaaagaagagttgtcctgaatctggtctggaatagaacctttttttccatgatgcatgatgtaattcacagcctcattcctgataaattgcttaagcaattttctgataaactttaatgcgattaagacttgttctgagaaatcagtcacccatctacccaagctgactgtcggtcaagagtctagtgaccttaaaccaaatgttattttccttttgtatctagcctaacattgactatcttgtcatttcattttcctataaaatgcctccaccaaggctgaatctttgaattgatcactagaggccttttccctagtagtaacattataataaaactttgactcatgctcataactcgattttccaaaaagttttcctttacaggagaaaagaacatctgctgtttataggagcataaattgtttttggttattttgaagaacaagttggcatttttgaccgaaattaaacacatgccttttgatcaagcaattccattctgtaccagaaaatacagaaatatttgaatgaatgtgccaggacacccaattagaagaatgaatgcttttttagcgttattttgtgtgcatacatatttatttagttatttgacctattacattctaaattgatattaataaagaggtatttgagttacagtttttccaaagttttaaatactctatagcaaaaaaaggaaaaatgaaagaaattaaaaagatacctctatatacatacattgtgtgtttgtgtgtgtgtgtgtgtgtgtgtgtgtataaattggctgtgcatgatataagtttttatttcaatcgttttaggggtaaagtggtttttgattacatggagaagttctttagtggcgatttatcagatttcagtgtacccatctgagcagcatatgctgtacccaatatgtagtcatatatatatatgtgtgtgtgtgtgtgtatgtatatatatgtgtgtgtatgtatatatatgtatgtatctgtatatgtataatggctgtccatgatataattttgagttggaaaaagcaaattgaagaataatacatgtattatcatgtctttaaaaaaaaactatacacatagctgaatgtttttgtgtgtattttcataaaatgatttggggttgaggtgataaacagtaattataaatagtggtagataacttctatcaccagcacggagtgtggcttaggagctgagaaggctttgaggagggaattttctttcttttttctttacctgtcatgtttgaattgtgttccatcaacatgtcctttttatttttttgagatagtgtcttacttcatcacccattctgtagtgcagggcacaatcacagctcactgcagcctcaaacttctaggcttaagtgattctcccatctcagcctcctcagttgctgggaccactggcatgtgtcaccacatctggctaattttttgaacttttttgtagttggggtctcaccatgttgcccaggctggtcttgaactcctgggctcaagttaccctcccacctcagcctcccaaagtgctgggattacaggtgtgagccaccacggctggccaatatctactagttttgaaatttaaaaaaaaaaaaaaaaaaaaaaaaaaatatatatatatatatatatatgtatatatatatatatatatatatgaaaaaaaggacaaacgatttcagttgcacaactataatcgatgaagtggctccttgatgttctcggggtaatctgagacactggggagaaccctccacctttgcagagaagcaggatgaaggggcctaaaatgagttcaactgatttcaactttgtttcccagcataaagcttgggctgagctgcctgaaagggaagtggagaaggcaggaatggaattgatttttcccccctgctgaattccccttctccctactcccttcctgcaatttctaataaattagaagagctctgccttccagaaaagagcagaggtaccttgcagtacttttgggaatcttaccaggaagaactgggtctactattgcaaaggaaaagctttttttacagtgttaaaaattaattaaaaatggaatgtgttatagctcgatttttatcattagcacccattccagagggcatgttgctgttagtaaaacttcagatttttcctgtcattatggatttggttttagggaaaataccttcatgttcagcattttatgtgtcagtccctaaaactcatgatcttctgtgattctcttggtttaagagcagggcgagtaatgtactcaaaaatttctccatagccttctgggttagaggatataacagctggcaaacagaacactaatagctattgatggttattttcaaaggatggacatcgatagttaagttttaaggaagaaaatgaagaggaaatttaatgtgatttaacagtgattttttttttaaagacattatttgcatctcctattttcacttacttataaacaggtggtttccaagtagacatattttttgcttgcttgaatgagaaagcataatgaactttgtgatttggtgacatatccagatagctatagcaaatagctataatgccttagataaatagcattttcacgagtaaactttttagttctcaaaagaaaaattgtaacaattttctagccgcatattagcattatgcacaaacacataaacttttggctggaattgtggaatatgaagtagctcccatccttattccatcgcccatatcctaaaatgtagattgtattagttgagaaattttaccaaatatttacttatactgtgctattatttatactatttgtcaattccactatagtagatgcttaataaatatttgtgaatcagtaaatggatggatgaatgaatagtggcctacttctgtgaaggtaattgaagaattcccacacttggccccctttggatataacgtctgttctgagcacctcccattcactatcttgatgcctcacataagacctagtatatagtaggcagtcaatgaagatcacaatgaattggctagactttgatttattcatttatgcaaattgcctgacattcaaagaaaaaagaaggaaaaaatggacctcttatcatgtgccagacattgttctaagagggaaagatactgtgaaaaagaaaagtccctatcctggtggatcttagattatcgtggagaaggtaaggcaacaaacacaaaataaatacttcatataagttcaggtaatgataatgcgtgaaaaagaagtgttcttcctgttagcagtgccaacatccgctttagtgctctgctgcactgcaaaatgtgtggatgttcttgagtatgtctgggaactagctaaaattagggagttaaaatgatccagcttagctcaggctatagggaggatttctctcccaggtgtttgttttgttttgtttttgagatagggtctcactctgtcacccaggctagagtgcagtggcctcaacctcccaggcccaggtgatcctcccacttcagccccctgagtagctgggactacaggcgcatgccgtaactcgcaactaattttttgtatttttttttgtagagatggggttttgccatgtttcctaggcttgtctcgaactcctgggctcaagcaatgtgcttgccttggcctcccaaagtgttgggattataggtgtgagccactgtgcacagcctcagaggtcctgtctgcctgcctgcctttcctccctctctctctttcttcctctctttgcttctttccttttttccttctctgttgaaggcctgaataaaataaaagactgagtaagaaagaattgactccctctgcctgacttcaagctgggacgtaagtcttctcccagtccatgcatccatccatccacctatccacctattaacttattcacactggctttaaaattatttttggctccagcttattattttaaaatgtaaaatgatttacagaagttgacagagagtataattaaatcccatgagtctaccatccagattcagtaattattacatgtggccattgttgttttatctctctccacccacttcccccatgcctgaaaatttaccaaagtaaatgcaagacattatatattgttattcatagacattttgagtaactaaaagtaaggtctctttaaaaaatgataattacagtatcatcatcacacccaaaaacatcacaaattatttaatatcatgaagtgaaggcccatttttccaatcattctctaaatattataaatgtcatctttcattagtttgtttgaattccaggtaaaaacctttaactcatttccttcttttgatttttcaaaagttggttgaatagtttctgtcttaaaaagtccagaaattgttgaaataggtaaagcacaaaagaaattaaatacaccatgtttccaggcctctaatgttttctattcaaggttgtaatatccagtgcaaggctaaaattgctttctggtgataaacatttgagaaagatttggttgttggtgatactgatggttgtagtaggagtctctggagaaattgaactaatactatatgtgtgtgtgtatctatgtatagatatagatacacacatgtatctattatatatatagagagagatatatgcatatctatacacacctacgggtgtgtctgtatctatacacacacctatgggtgtgtctatctatatctatacacacctatgggtgtgtctgtctgtatctatacacaccgatgggtgtgtctgtctgtatctttacacacctatgggtgtgtctgtctgtatctatacacacctatgggtgtgtctgtctgtacctatacacacctatgggtgtgtctttctgtatctatacacacctatgggtgtgtctttctatatctatacattatatgtactaaataatatatataaacactatagtatatagagtatacatatacacactatagtgtatgtactatacactgtgtactaatacagtgtataatgtatatatatagtattcaatatagatctataaacacacaagtgcatacacacacacatttttctgtatatatgtataaagatatatataaagatttttaaataaggaattgactcatgaaattacagagactgagacatcgaaacccaggacaaccaatggtacagttcatgtctgagtctgagcagctgagaagcaggagataaaaaggcatcagttccattccatatccaagtctgagtccaagggcaggagaagctgatgtctcagcttgaagtcaggcatagagaggcaattctttctcactcagccttttattttattcaggccttcaacagattgtatgaagccacccacactgggaagggcagtctgctttactcatagtactaatcgaaacgttaatgtcctccagaaacgccttcatggacacactagagataatgtttaacataatatctgggtatcctgtggcccagtcaagtggacacatacaattagacatcatggtggttatgccaagttttttttttttttttttgagatggagtcttgctctgttgccagggtggagtgcagtggtgcaaccttggctcaccacaacctctgcctcccaggttcaagcgattctcctgcctcagcctcccaagtaggtgggattacaggcgccaccaccaagcctggctaatttttgtatttttaatagagatggggtttcaccatgttggccagactggtctcaaactcctgacctcaggtgatccacccgccttggcctcccaaagtgctaggattacaggcgtgagccaccactcccagccagccaagtaagttttaacttggaaacaatgagcagacactcgcagtacattctctacttagtatatttctttttcagagtcatctcaaaaatctctaggccaagtgttcttaactatggaccttgatgaatggaccctgagtatcttagaatcttctgaaataatatgcagcattatattccatttgtacctgggaagagggtacttgtctttcatcagagagtcaccaatggaccactggtccctgctgatttagtgtcacagctcaaaaccatcagtagtcctcgtgatctttcggcattgtggctccctttgtgagaagggcctaagagtgaatctcccaaccataagctgtattcaggcaggcacgaagtctcttatttactcagtgtttctggagcccagcatagtgcctcgcacacagcaagtgctcagtgggtatctgttgaaccggcaaaacaaacaaatgaataaattaatgggtggtcactgtactagttttctattgcttcataaacaaactatcacaggcatagtgagttggaatgatggctctcaaaaaactatgtccacatcctataaatgctattgtacaatatatggtcttttgtgattggcctcctccacttagcatcgtgtttttgaggttcagccacagttgtagcatgtccatctctctttgtgtggctgaatatcattgcattgtatggatataccaaatatttttctcctttcatctgttgatgggcatttgtgttgtttttaccctttgactattgcaaataaagctgctctgaacatttctgtgtaagtttttgttggaacacctatttccagttcttagggatatgtatttatatcaagccaaactacctacctaaccacctacctgggagtggaattacggggtcatacagtaaatctatggttaattcatcaggaattattttataaatttttgatgttggatatctgaagataatacagaatggagcccttttttactttacagattttttttttttttgagagagaatcttgctctgttgcccaggctggagtgcagtggtgcagtcatggttcactgcagcctcgatctcctggggctcaagccatcctcccacctcagcctcctgagtagatgggaccacaggcgcatgccaccacacccagctaagttttgtatttttttgtagaggcaaggtttctccatgttgccaaggctgatcttacactcctgggatcaggagatccgcctgccttggcctcccaaaatgctgggattataggcatgagccactgcacccagccctggatttggctttttgaaacagggctgcacataacctccatgatgtgattctggctgtgtctgttgaggtcccattgggcccagctctgagattccctgttagcacagggtctgacacatcacagatgaacaatggatctttggtaattaaaaacagagctgtgtggctatttttctccaactccttttttttttttttttttttttttttttgagacagtctcactctattgcccaggctggagtgcagtggtgtgaactcggctcactgcaacatccacctcccgggttcaagcgattctcctgcttcagccccccgagtagctgggaccacaggcgtgcaccaccacacctggctaatttttgtatttttagtagagttggggttttaccatgttggccaggctggtcttgaactcctgacctcaagtgatccacccatcttggcctcccaaagtgctgtgattacaggcgtgagccaccgcgcctggctttcaaattccattttttaaagttagtgctttaatatgttaaacacccttattaacatattacatatgttaatatgtaaaataaattccgtacattttaaagtgctaaaggttgtatgtttgtgcgatggatatgtttaagagaatgatttaggatgcgatcagttttttttccttgacttactctcttcctttatttttttcccttcttcactttctctgttattccttgccaatctcataaataatgtaagacaacttgcaagacttattaaatgactgatttccttaaaagaagtacgtcaggtgaagggcagatagaggtcaacaccatagataaatctttacactccagtggactttgattcacatcatggctccttctcttccttgctgaggcttttgacaatttcaaatgctccctgaacctcagtttcctttgccacaaaatagcaatacaaatttataattccttagattgctgtgagaatgaattgaggcaaggtaggtaaagtgcaaggaattgtgtgtggccggccaggtgcagtgtggctcaagcctgtaatcccagcactttgggaggctgaggtgggtggatcacctgaggtcaggagttcgacaccagcctggccaacatggtgaaaccccatctctactaaaaatacaaaaattagccatgcttggtggcaagtgcctgtaatcccagctactcaggagacggaggcaggagaatcacttgaactcggaaggcagagtttgcagtgagccagattgcaccaccgcactccagcctgggcgatgagtgaaactccgtctcaaaaaataaacaagaattgtgtctggcctttgtgatagttactcaacaaatcatatctgtgattgttttggttttaacaataatggtttttaaaaaccgtaggtgatcacatactacgcagaaagggaagcagttacagcattcacagcatccgtgagtcatagactcactgcattgctccaaggtgcagattctagttggaaatgttaagttttttagagcaatgaaaaaattgatctctttctcttccataacatagatttcccatctagctcctgggctaacttttgtttagtagttgtattatgaaaacaccgaagaatccttctgccagtctccatagcagtgatataaatcagagcccgcagtttcatgaatgcctcgctgtgccaccaggattttcttggagggagccacggtcagatttcaagtggtcatttcactctttctccctctgggggactgagacatgattaacttgcaataattgtgactccctcattaaaggagagctgtagcaagggaagaaatcattgagactgatcaagacatcccgtgctattttttttttcttgcatatcagctgtgtgggtacctcttgttcctctgtccttcaggttagtaaaacgaagaacagttgctgaagctatgagctatcgataaaagctaatgtaccacacgaaattggaaggggaacaaaatcacttaagtgttcagggccaccaaggcactggtgcatcccctgtgagcctatttggctcctggcggtgtttttgttgccctggcttgcaacgtagcctgattgttctaagtaaatggcagagcacgcaaatcaaggacattggcaataaaccaggaatgcactgtttccagccacgggctatccagggaattggggacagtctgtaatgtatcttgagctaggaccatatccaaattactggcctttccagtttttcttaaaatagtagggtcagtaggtgaccacactcagaagccaagcctgcagcatcagggctgaggagcaaactctttctttggtctgaagcttcaaatatgaacccttgccaccagctgcataaatatgatagccaaagggtttcaaatttgtgatttgtcataaacgctcctattgcaggctgggtctagtccttcttgactttgtggaaggagaaggcttgaggaagtattcacaattggagaagggcgccttctgttatgttcttagctcactaaaagtggttaatgatgagaaggggtgggtcaatgacaagaaaagtggagaagatgagacagacaaaactgcaactcatcttcatggcacactggtgagtgggggagtgcaagaagtttaggtgcaaaggacaatggagtgaacatcttggcttggttaacagaagaaaagaataccaacgccgtctattttcatatccctttctattttatgtacatatttatcaatatactttttgttccagaaataaatgggaacttaggcacaatcttttacacatcttacctcaactggtgactcttcataatctagagctattatagtttccaattgacagatggggaatctgagactcagagaagttaaatgattttgtgtgtgtgtgtgtgtgtgtgtgtgtatgtgtgtgtgttttgtttttttgtgtgtgtgtttttgtttttttttaagacggagctttgctctttcacccaggctggagtgccttggtgcaatctcagttcactgcaactacaacatcccaggttcaagagagtctcccacctcagcctcacgagtagctgggatttcaggtgcctgccaccatgcctggctaattaagtgagtttcttaaagtcctacaactggtgagctgtgagctgtaaattgtggaactaatttttatactgccaatctgaggccttttctgacctcatcgctgccactgtaaaatgaattctagccccagaccatgacatgcctactagcttagctctaaccagaaagatttattatcccaagagttgtgaaaatgtggaagaactagaactgtcattcactgctggtgggaatgtaaaatggtacaatgaatttggaaacagttgtccagtgccttaaaaagttaaacacacacatatgtggctcagcagttcccttcctaagaacctactggaaagaaaataaatgcttatacaaagtcttgttcatgaatgttcatagcagcatcatccatgatagccaaacgccggaaatacccaaatgtccattagctggggaatggagaaacaaatgtagtctatcgacacaatggaatactactcagcaatgaaaaggaactaactctggatacctttaataacatagatgaacttcaaaaacattacgctaagtgaaggaagccggtcataaaagaccacatagtatatgatgacatttatatgaaatttctagaaaagatgaaactctatagacagcaaacagaatgatggttgcctggggctgggagtgagtggaggggattacctggaaagggtggggcaattttggggggtcaagaaaatgttctaggacaagactgtggtgatggctgcacaactggataaatatactaacatcaaactgtatatttacaatggttaaatcatatggtatgtgaatttcacattaataaagtcataaaaaatgaattccaggaccattaaatcaggtgactgagccaatagttacaggaacatagaaagattttcacccattctgtataattagacaaattctgttactatctgtccaacagtttagcaagagtcactctgagattgaagagaggaagggaacgttggaaccaatgctgatgagccattcataggctctggctcactatatatgtctaaaattcacatgcccctaaccctcagataatgaccattaataatctggcaggagaggaaagacctgcagctcttctagtccttatgctatctcattgtctcatggatttttaatatgtctttgcatcccttagaaatttgcacttttcccccctttttccattaaaacacacctgcgtgcaaacgtccatacacacccatgtacacacagacacacacacacatgcatgcgatctgtaaaaagtcacaaaggccaaagttttaaaggaagaaaataaaaatcacctgtagtcctatcattcagagataaccactgtatgtttatttacattagttttgattacattagtttagaatgaaattttaaatacactagtatatgtaattaaaattgtatatacgttttagtcaaccatcagctgacttattcatgttctgtggactctgtggtgggtggggtccaagcctccctgaagcagatctctatcctgtcaccctgctggaaatgaaacacttaggggttagaaggggatcaaggaaagtccgagagttggttgtgattatcttcagtcagaaagtgcctacttttccaagcatccagactgcaacctgtttttcctactcaaaatggtttttatggattctattcttatttggcaattgcctggactacagtcaccaacacaagtttatacgcaagaagtgcacacagccctccctcccagctcatccggtaacaatttagatgaaggatgtaaaataggattcatttcatgacccaagtctggtcaattgaaacagccgattgaagtgctgtgttgaaaaggattttgacactgcgcatgggctcgttgggaaagggtgtcatgatgggttactgattctgcggtatttttgtggacgtggggagtggtggcctacttacagtgcatcgcccactctgatttagatgagcaagagctgctgagttgtagatttctagtttctaaacaacaataagtcttgctcgcagatagcctcttagcagagccaaaagccagcagagagaagactcagcatttgctttggagtaagtttgtgtgtgtatgtttatctcccttttactcatgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtccatgtgtaaggccaggcctaagtgctctgacagggcatgactcaatcctcaaacaggaagggggaaattgctttccgtctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctaagaatcataagtttttcaaactttagaatcacaaggtccattaaaggacatctcccctgaccttcccattttgtagatgggaagactaaggtccaagcttgaatgacctgccatcatggggataaccggaattgatacaatgtcttgattcaagattcagagctcattttttctgtgtcagattaaaaaaaaaacaaaaaacccttactgatcttttaaatatgtaattcttcctcctcttctccccttgtctctcttctcacccctaccaatgtaatcagttctttttttcttttttggagacggaatctcactctgttgcccaggctggagtgcggtggtgcgatcttgcctcacggcaacctctgcctcctgggttcaagcaattctcctgcctcagtctcccaagtagctgggattacaggtgcatgccaccatgcccagctaaatttttgtattttagtagagacgggttttcaccgtgttgcccagggttgtctcgaactcctgagcttaggcagtctgcccacctcagcttcccaaagtgctaggattataggcatgagccaccatgcccggcctaatctaatcagttcctttaaatctgaaactgtctgcctgattctggtttaccacaaccaccagagtcttaagtgtcccaatagccagggtctcatagactctgcttatggttaattcttctggggaaattaatttctcgaggtaaaacaagtttttaaattatcccctatagctcatagaagcaattcagtaaatacttgttgaatatcaaatgaatgaacaaatggcattctacattgaatatagtaattcccaactttcgtgaaggttgttttttttttttttttaatgaggcaatcaggggtaaaaacccccgctgctgtcctaagacagaaagaggggggatttttccccccatggcttcgtccttattcttataacctgtatgcactgctgaacctgctgaataaccatgtcacagtggcaggagagggactgggtgaacttgagcctcgatgcctggattaaagccttgtaatgatgtttgcaaagcaccagggtgataactgaatggttggcacaggcttcgatgaagcttgtgtccaccacagtttccagtgcttctgcacctgggtggtcagaaatgagtcctgtgagacacaggtgacaagatctccaaggaagcagttcacgcttggatgactctggagctgtggtgacaatctaaatcctaaattgaggcttactaggaaatgcactaggtaacaggctctagagaaatggctattaccaggttgctcaggctggagtgcagtagtgcaatttcagctcactgcaacctctgccttctgggttcaagcaattctcctgcctcagccttccaagcagctgggactacaggcaggcaccaccatacccacctaattttttgtatcttttttagtagagaggggtttcaccatattggccaggctggtctcaaactcctggcctcaagtgatccgcccaccttggcctcccaaagcgctgggattacaggtgtgagcccccaggccctaccctgggcccctcctttctggcccctcaacctgttttcttccagccatgccctagggagagcttggctgtggccttgcagaccctctcagatgccactcaacaagggccaactggagagaaatctctagtctagggcacaaaatttctgtcaacccttctaaccagtgtttgaagtacgtaagacgttcatttccacttctaatgaggaattagaggaacggatttataaaggaattctggttataattgcaggtacttttagagacgatgtctaacagtgcaacccatagaaccaggctgcctggattcaaatcccagctctgctattactgagatctctatgagagctcagaaaagtttacttaatttctccaagtctcagttttctcataagaaagatgggcataaggaaataatgtagggaaaacacttgttgcagactgaggactcaacaaagttataattaaagctattactaacgtcattattatgaaaatagccatctttttttaaagaagggagttaaaggaaagaaatgccaggctgagagatgagacagtgaattacagtgggggataaaggggctgtggtgtcacacaggcctggcatctgtggccttgaacaagtgcattaatcactctaagcctcaatttctttgttttaaaaataattaactaaaataccttagggcacatggtaggaattcagtaaatgctcactgtctttctcatccttttgcttacctcacatttgcttgcagccagtgctcaaaaccatagacaggcagtgtccccaaccactccctgcgtttctctttctttgccttccgaagctgccatcttggtggtttttgaagcatcaacacttacttcacatgcagaggccccttttatttatttatttttaatttttttgagacagggtctcgctctcttgctcaggctggagtgtagtggtgtgatctcagctcagtgcaggcttggcctccagggctcaagcagtcctcccatgttgacctcctttgtatctgggaccacaggtatatttcaccatgcctggctaatctttgtgtttctgtaaagatgaggtcttgctatgctgcccaggctggtctggagctcctggcctcaagcagtcctcctgctttggcctcctgaagtactgagattacgggtgtaagtcaccacacccagcccagaggccttctttaaatgctagtcctttttctcttcctccatctgggtcttggttccatgcgtattcagtttgtgaaaaatttgagtcgtgcacttattatgtatgtgcttttctgcatgtaattatgcttgataaaaaaagtttaaaaatttgttttagatagaggtttgaatgtcactaattaccaacgtgtagctcctaattggaattaagaagggactagctcctattatcagagatctggtcatcacccttcaagttgactatctccttatgctgattttttttttcttttaaatagcagcacaaatatttaccatctagcagatgtggtaagaatgtaagttgttcagccatttacagcttagtctttgggagatatccattcattttaaatacttggagggccaggcacagtggcttataccttgtaatcccagcacttttggaggctgaggtgggaggattaattggggctaggagttggaggctagcctggggaacatactgacacctcatctctataaaatattttttaaaactcagctgggcatgatgttgcatgcctgtcatcccagctacttgggagactgaggaggacgattgcttgaggccggaagttcaaggctgcagagagctgttattgtaccactgtactccagcctgggcaacagagagaccctgcctcaaaaagtaaataaaatagtaaaataaaacgagatatttggaaggctatgtttttttgccaggccatgtgcttagtccctgggagtatagcgaggggcaatcacaggtcaggtcctagtgtctctgaagacttcattctagtggccattgaaaatgtgtaactacccacagtaatcaagttaaagaaaggttctggctgagcacggtggctcatgcctgtaatcccagcactttgggaggccggggtgggcggatcacaaggtcaggagtttgaaaccagcctgaccaaccctgtctctactaaaattatttaaaaaaaaaatagctgggcatggtggcacacgtctgtaatcccagctactcgagtggctgaggcaggagaatcgcttgaacccaggaggtgaaggttgcagtgagctgagatggcgccgctgcactctagcatgggcgacagagcgagactctgtctcaaaaaaaaaaaaaaaagcttccatttgagccgccaggaaaggaggccctgagttggggagttgaatagagagctgcatcctgaacagacatgatcttgggtgagtgagaggctaggagcggagggaaagcagacgcagttgctaaagctgtcaagtcccgctcccttggaatgcagtcctggttctgctacctccaactgggtcgatttcaaaaaattatggacttgtctgagcctgatgtggtgcctggccagggctcactgcagcgcctggtatacaggaagaacttgatgttattcatggcaaaagatgtctggatggtctccactacagattctgatggcaagtgacttaaagacatgttggcaatgggtagtggacaaaaattgaaacaccttcaactgtgtctgtgaccagaagatttttttctttttttttttttttttttttttggctgactgtcatgacttagtaaggccatcacaggttgccagaacatctactcaactgttccaagcataacctcctacacaggccttctacataggagtatatttggccaagactcaccactagaagtgatttccactggactttcctacagcaagtggtaaatgatccctcagataggcccaagagctccccttcaagcatagagacacaaccctgtgaaaacatgcattggaaccaggaaggcctgcccccatgacttcacgttgcatacatgcctttgaggacttggcctcttaaaggaatctttcaatatcctatgcttctgagaaagttactatttcatttgcagcaggacaactcaacaagctagctcttcctgcccagcagactcggtggattctgaagagggtctcgggctgactctctacttcatgggtttgaattcaggaatgttgcaagattgcatgagattaagccgctgaaacctttctgaggaagagccagctcaaatttcagtgttggatgttcaccgcttctttagggttctaccactcccagtaaatcaagtaataggtttctgttaaaaaccccagtgtgctgatctcagtggcagccatcttgctttgtaagccttctctagctttatgatgctcccagtatataagacatttccagtgtctagtccaaattagtatttctctaattctcgagtgtctgatctgcctggctagaatgattaaaacaaaaaaatagcaaatcagtttgacagtccacttcattaagtggaggacagtgttttgattgctatttaatctgtttttccttctgtctgttcttggctatatggaattcactttgcctctcttcccgactcttcatatcccttatctcaaggtgagtatcgtcagaatcccggtacatttcaccagccaccttttatagaagcttagaaagatggaggcaaacccataaacaagacttggtttttctaagccacagtggcaatttcctagtcgattacaactgtgtctaccctttcaactggcctgtcagtgtaggctctgcatgtcctggataatcctacaattggtgacacggttattgacttacaggtttctagggcatctcattcgttttttaaaagaatgtttcttccacacttttattgcttagtagaaacttgttctaattctttctcctgataccatttagcctattagtacctgggaataatcaccctcccttatctagtcctacagatttgttttgttttgagttatacccactttaggtctcccaccctctcttatttttataaacaggctccatggtactatatacactgcagatggacagctgccaacctgctctttttgtgctgaggaactctagatatttcaactagtttacatgactttcttacctacgctaccttataatccttttataaattttgctttacgttttaacaacggaaaacacttaaggtttttttcctttctttttttttttaattcttccgccagctatctttaaaagcagttctaaaacttcttattttaatattgtacccattgtactttagtctaagtgatggctgcttatggccatgccctttcttctgcactttgggtgttttgtctggaattttctctcctttccttttgtgaaaaaggatgaattttccaagactctgttatgacagaaactcaccagttctctgttgttaatcaacaaatagattgtgaatgcttgactcttctttttttttttttttaaaggagtttcaagggtaagatctgctgtcttgtgaatgtcaaagaagtttctcattcgcccctttcttctctctcccagtgtctttaatttgttaatgctttcgacttattttgctttggataattttcaaagtactgctttctctagagatctctaaaaggcagaagttctggctattaaagatttgccattctcagaacagcccagttagggtaccctcaggttatttataactggattttatctcagaaaattaactaaaagaagattaaccaaaaatctaaaggaaaatgccttaaacacctcatctattatgctgtgctcaaacagatattttcatcttaacagcttggcaaacccagtggaacgctctttctagtttggggcataaaataagataacactctgaattcctacaggaaatcttgtaactctacttaaaattaaggcataaagtaggaaaatgtgtttcctctgtatagtcttattactttgcctgttaagttaactggttcctatttctgctggttcgaagaggtccaggacatttaaatagctcttctagaaacaaattcttttccttacaagccctgccaggtcagtgggttcagtaaggaagaaggttttgtattttgacaattccttcatctgttaatttagtcagacgaggaaggaaacgagaaaagttattcctatttcatccatctaagactttatatcccatttcaggctgattaaaaggcaaaatcgtcacagtaggacaccaaaccctctgtatgccctgcctgcctccccccctctgacccgcctgcctcccccctgtgagctttttccacctactggcctcttgttcttcttcagctgttcctcagacatgccaggtgtgttcctgtctcagacgctttgcctttgctgctccttctgcctggagtattcttccacgtagcaccatgagctgttcttctccaaaaggctttgctcaactgacactttctcagtgaagctgtttctcaccactcactataaaatggcagcctgcctctctgagccttgcaccctctcttccttttcctgctttgtattccttgtggcacttattatatcacatagatacagacatagatgtggacatagatagagacatagacatacatgagttttgtgtttattctcctattctctagaagaatgtaagtttgtaagtactgagatttttgtctcttttgctcactattgtacttcagggcctagaggaaggcttagcacgtggaagacaatatttattggaggaatgaatctagaaatatccttggatgtataatgtccaactcactctaccacacagcaacataggtagttttatatacattttatagctaagcccagcagcccaaaaagctaaatgacttcagcgcccacagatactcctggatgagaggggattggaaaccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctcagtaagtatccactggggttcggaatacaactgccctgcctcttgagcagccatgcctgcttccgaggtggtgctgcatgctattcaggaggacagaccatggatggaaatcctgagccacaactccttagcctcatgacattgggcagatgactgagcttgtctgagttacaataaataaaaataccatgctgaatgatggcctagcatgacattgggaagtacagactttgcaggcaggcccctgggttcaattcctgcccctgtcattgagtaaagtaattatcataactttggaacaaattgacctctctaagcctcagtttattcttcagctaaatgaggatgattgataatcaaaactattttatagggcttgggggagcatcaaatgaaataacacatataaaaggcttggtttaatctctgaagcacattggcacttaataaatgttaactataattatattaacacctattttacagggttgctatgaggatatcatgagataatatgtatgaagaacctagcacactgtttggtgcatgtgagggttctgtaaatgttacccattttattccttaatttcctttatagacccctttccctgcaacacccagtagtctggcttctatcctgacaatgttagtgaagttgcttgcttgaaatttaccaggccaggcttatggctgtaatcccagaaactcaagaagctgaggcaggagaatccctatggtctcttgagtccaggagtttgagaccagcctgggcaagatagcaaaatactatctctacaaaaaaatgaaaaaaaaaaaaaaaaaaagcctgtcatagtggtacatgcctatagtcttagctattcaggaggctgaggtgggaggatcgcttgagcccaggaatttgaggttgcagtgagctatcattgtgtcactacacttcaccctggatctggaaggaagggaggaaaggaggaagggagggaaggaggaatttactagaaacaaattaacttctgtaatcctaagtacttgttaaggcagaaaaacgcagataagaaaatcgaagttgagggcaaggagctcatctttcacggtcatagacctcagttgcaacatctggaaaaagagctggttgggcatgccgggcaggcttttgtgacaatgtaagagcaagtgaagattgcatctcagtatgagacaccgtaagagcttgataaatggtggaccctctgatgttgacaacatgatgtcaaagatggtgtttgctgttgtttcaaatgtcttatttcaaattcccaattagtttcttcatgccataagggcaaaatccacatctcatactttttcaggatctgctctcacttccccaaacatgtaataccaccctggtcttcaagtccactctcaaaaaaaaaaaaaaatttggcctttggcctcgtgaccaccaaatctgatttccatccaagaggcaacattgtttgtgcttagaaggaattcctggctgggcatgatggttcacgcctgtaatcccagcgctttgggaggccgaggcaggcggatcacctaaggtcgggagttcgagaccagtctgatcaacatggagaaaccctgtcgttactaaaaatacaaaattagccaggcatggtggcacatgcctgtaatcccagctacttgggaggctgaggcaggagagtcgcttgaacttgggaggcagaggttgccgtgagctgagatcatgtcattgtactccagcctgggcaacaacagcaaaactctgtctcaaaaaaaaaaaagaagaagaagaagtaattcctaacagtctggaatctctagggtctctggtattatcctttagtttaagcctcacatttttctaaacattttgaaatctggtgtaatggcgttagatgaccaagaatttatagtcaaaagtagataaagtaaaagagtgaaaacagagacatgatacgagttgatgataccgtatgcaacttgtcaaacacttacatttgtgaataagaaaactggggtctatttggtggtttatttcagagatgttggatcaaatcagacatcagaaaagacaacagtaccaaacgaagatatctttgctgtatttgcagttttctctcttattaacatgaaaacaccttacatagatggaaacatctaaaggctattttttattttattttccattacttcactctaatgctttcacccgtacctgtggaaattagactgtcacctgcttttagcatcctgttttctttcgtgtttgtaatgaagccctccgggaattatgcgattacaaaaatgagttacaaatcctcattcggtatacgaaagtatatagctgctttccttctctgtttaaatagtctacaaaacaagaaataattagtcaagcactatcggtaattaagcacataagatgaacattaaacaaactgcaatcttgcatcattttgaaggtagataggcaggtttttgcatttggaatccagccaaaatgcccatcttcattccctttgctccttatttattattggtgagggaattcacttgccgaacttgctgatgtactcttgctggcggtccatctgagagttcacataagtgtgagtgactattttttgacaacactacctttgggagaagatggtttcaaagaactaactgtatcaaatggaaagacaatgtgttttcccaacatgggagtatgtttctaagttgggatcagttcacgattcagagaaatgctctgccttcttgtctatgatatcagatcaggtcagacgtaggtataagaccctgactcctgttttccaagcacttttttttttcattatgagtctatctttcggtcccctaaagcttctggtaattttttttcttttttttttttttttttgagacaaagtctcgccctgttgccaggctggagtgtggtggcaggatcacggctcactgcaacctttgcctcctgggcgcaagtgatcctcctacctcagcctcccaagggagctgggaccacaggggcacaccaccatgcctgcccaatttttgttgttgttgtattttttggtacagatgggattttgccatgttgcccaggctggtctcaaaactcctgggctcaagcgattcacgtgcctcagcctcccaaagtgctagggttacaggcatgagccactgtgcctggccctggtaaaattttgtctacatagttactgctgcccaggcaaaatctgaaaaatgttagtctaatttagttaagtttttcttgcagaccagaacttctaggaaactaatatacaggttttctccaaaatatattttcaaggaaaatcagagaataaaagtttccaatgcatttagactagaaaattaaatattcaacaaacaatttcggagggccaactatttgccaggatccttgctggaatagtctctaacctcaaggcaattgctgtctagctttaagatcaagagtaattgtgacttgatgtaaggtatctgtgttgctttgtattacattcttcttagctccattgtgttaaatacagatagacaatatttgtacatgataggttggctcaccattaatcacttaagaagtaatagaatgatcaatgattttctttctggcttgtctacgccaaaatggttcttctgctcagttggtttctatagtgattttatggatataggcattttcttctcgaattagaagaactgacagtccaggcacggtggctcatgcctgtaatcccagcactttggtaggccgaggtaggtggatcacttgaggtcaggagtttgagataatcctggccaacatggtgaaacctcatctttactactaaaaatacaaaaattaggtgggtgtggtggcgcatgcctgtaatcccagctactctgaaggctgaggcaggataattgcttgagcccgggagacggaggttgcagcgagccgagatcacaccactacattccagcctgggtgacagagcaagagtccatttacaaaacaaaaacaaagaactgacaataaatagttttctccgttttgtgacttatttttaattattaagaataagtgtcataaagccaatactttctaacatgtgtatagtatgttatagttttcaaagtctttgacaattatacctagggagccaggacagtatttgtatcatcatttcattgttcctggaaaacaggttcagagaagttaagcgacttgcccaaaatagcacagcaatctgacagagccaggattatcttccatcctctattttattacctgtgcctcccattaaatcatcctaagctccactacagctggagaaggttctgttaacacaccatacatctttttttttttttttaattgagatggggtctcactctgtcacccaggctggcgtgcattggtgggatctcagctcactgcaccctccttctcccaggttcaagtgatcctctctcctcgcctcccgagtagcctcccgagtagctgggattacaggtatgtgctaccgtgcccagctaacttttgtatttttagtagagacaggggtttcaccttgctggccaggctggccttgtatttctgacctcaagtgatccacccgcttcagcctcttaaaattctgggattacaggcatgagccaccgcacccggttatacatcttaaatataaagtttttacaatgccaccatttaaaaaaaaaaaaaagggcattaatgcatttagcaaagacttcctgagtgtctgcttggtcgagtgacacaaactggaacagagcatagcctgtcttccaggaaccggcaccagcgatgtcgtaggctgagggagaagccacagaactgtgagtgacatgtttctttggctgctcccgacacaaggaactgcaactaaattgaaggcttgaggacaggaagcaccttagcggttcgcctttcatttgagtgggcccagggtccagaaaagggtagatattcaggaagaattgatcaccttttggatgccaccacacatgcctaggcacaaaataactcagaaaacagtgataaaagttgtgattgtggttgttgtggaaattaaagtagcctcccctcttaagctttgtgaacttcagcaagctcctgaacccatctggaccctctctctcatcagtaacgcagtaacgtagagatgaaaccctaaatgccatccggtgacatcctggattagaccctgaatcagaaaaaggactgtagtgggaaactcgtgaaatcctaaatacagtctgtcatttacttaatagtaacataccattttcataagcataccatgggctgggcatggtggcttatgcccgaaatcccagcattgcgggaggctgaggcaagctgatcacttgaggtcaggagttcgagaccagcctggcgaacatggcaaaaccccatctctactaaaaatacaaaaattacctgagtgtggtggtgcccacctgtaatcccagctactcaggaggctgaagcaggagaattgcttgaatccaggagatggaggttgcagtgagttgagatcatgctactgtactccagcctgggcaacagagcaagactctgtctcaaaaaaaaaaaagaaaaaaaaagtaatgcaataagcgtaccatggtcatgtgagatgttgacattaggggaaagacaataaacagcgtggaggaactctgtgtactctgtttgtaagtttcctgtaatactaatattctaaactaaaaagataatttaaagggaaagaaaacctctttatgatagtaacatcagttggtataaccattttggaagacttgatttacataggatcaaatataagtatatctgatcccctagaaatttcacttctggccaggcgtggtggctcatgcctgtaattccagcactttgggaggccgaggcaggcagattgcttgagcccgggagttcaagaccagctgggccaacatggtgaaaccctgtctctacaaaaatattagtcaggcatagtggcgtatgcctgtagtcctagttactcgggaggctgaagcaggaggatcacctgagcccagggaggtcaaggctacagtgagctgtgattaggtccctgcactccagcttgggtgacagagtgagaccctgtctccaaaaaaaaaaaaaaaaaaaacaaaagaccatttttaagactatgactggtcaaaatgtgctcatacatttgccaaaagacaagtacaagagtgtgtttagcagcattattcattataacacactgaatcattattcatgattactcaagacatctggtaaaccacccagatatctatcagtggtggaatggataaataagttgtaataaatccacacaagaggagactactcaccaacaagaatgaatgacttagaactaaattcaacaatgtggatttatcttacagagatgatgttgagagaaaggaggaagatacagaggaatgtatcctatgtgattatagttacaatgagttgactaaaaagcaaactattcctattagaagtcagggtagaggatggatgggagcatgaagtgtcctccgtcatgttgctaatgttctgttgcttgttcaagctactgggtgtgttcagtttatgaaaattcatttaatgacacatgtatgttttgtgaatttttttgcatgtatattttactctaacaaaaagttcatggacaaatacaaaatcatatctgacagttgttgagagaattaaaggaaataataataatataaagcacaatcaatgcattccatttattcttctgcttttcccatcaattcatgttacccagtcattaatgcataccctctgagaccccaccaagccatctagccctcagctgtgtcactgggcagttgtttcttccactgtgcagtgtttcgttcttaaccaacatggcaccccaggttcagtggtgagagtgtcactggcaacttctgaaataacatctctgttagtttgtggagtgggctaaatggccagcccttctacgagctccctcatggttgcgggggactaccaatcactctctactttttttttttttttttaataggtcttgtcatttgtaaatgcagaaggaacactgaaaaaaaaaatactcttgccttcttccatctgtattttctttactaaattatccagtcttataaatatttgaataacatttggtcagtataaaatctttcctgtcagctcagtacaagaacactttttggctcctgagaccacaacagtcagataaattaatattgatttgttagaaaatagttttcactctgtctaaacatcttattctgggctcttgaaccaaaattatgaatttaaaagcagcaaaatagttcttcacagttttcccagtgaaactaattatgggcagattgtgagaaatgtgttggatgtgatttccaacatagagttctgctaaccaaaattcagagaaactagagcctcagtctctgatttatttgagcaagttgcaatttggtagactggagaatttatgtaaatagtttttgcagtttccatagggataactcaatacattaatatctcacgaatggcagaagatgaagggggaaagttttttttttaactgatagtttgatttacctaatagaaggatcggattcttcccccttcttacttaagtctatatattaaagaacagctggcttacctgctgtataaatatgcagtgtgtagaatttgactcagtttagagttgagttttaatcacatccacgtacagggatggggatggaattttttttttttttttttgagacagagttttgctctgttgcccaggctggagtgcagtagcaccatcttggcttgctgcaacctctgcctcccaagttcaagcaattctcccacctcagcatcctgagtagctgggattacaggtgctcgccaccacaccaggctaatttttgtatatttagtagagacggggtgtcaccatgttggccaggcaggtcttgaagtcctgaccttaagtgatccaccctcctcggcctcccaaagtgctcggattacaggcatgaaccactgcgcctgactgtacttttttttttttaaagtatacccatacccattgtacacatttggtattttttctttaaaaaaaaaaagcatttactttttgcctcatgaatctctgagtacattttgtgcattctgtattctactttatttactcaatattaattatatgagaaataaatcctaaatgtaattttgaatggtggcttcacaaaagaacatttcctcttcttttggacatttgctcccaattttaaataacacatcattgaacatctctgtacaaaattccgtatctgatcttcagagaagttttaagatagatgtctagaatttcatctcacatctaaactgttttaagacacttggtacacattgatatgtattgtccaattgctttccagaaactatataaaatattacaaagaaaaacatatatatatatatatatgtaaaatatatatatgaagggagaaataaatgtaaatgaaaagaaaaacatatagagaaagaatatgtctaaaagaaactgcagaggcagctataattaaagcacaaggaaaggctatgaaattctggttccacctgcaacagctgtatggtaaaaagcttattcagagtccttccttcttggaaagctttgttagagtcttatgggattgtgatgcacagatacaggggcaaggctactttttcctcgaactagttcaccaaagcttctatcctatgaaagtgaatataaaattcttaaagtttatagggtctgctgggtttaaggaggagaaatttgagttttcatattgtcagtctcaaaccttttctgaaattggaagtgatgaagtgacagtctggctatatgtgtgtgtgtgtggtgtgtgtgtgtgtgtgtgtgtgtgtgtgtgtgtgtgtgtgtgtgtgtgtgtgtgtgtatacctagtctagggctaggtttgggaactattttctcccgtaagttaaactgaactagactgtatgtcaaaaaagagtctcaatgtcaacttaatccattgtcatgactgtaaaatgctatttcattataccagcaattcccctgtggatttctcctgactctctatgcagcccaactctattttaatctgttgtagcttttctttcccctctctcccaactccccacgttttggaattattcagtgcattcgcttccaaggcacctgtttgatatttacacaaattatgaaagtaaggtgggaaggcaatgaaggcaacaaagtatataaaacacacacacacacacacacacacacacacacacacacacacacacacacaagaaatgactacagacacctcaacacccttccaaaacacttgaatcattttcttcgggagttgaacaagtggctgaaaatgccaaaatccatcagccaatgtgtaagtacaaaagggtcagataagatatatgtggattccataaaatagtgcatttgaattcccccaggtcttttaaagatagtggttttccagatgtgacaaaacaaaagaagatttccaaatcaaaattcccatttgcctttcgggatgttgaattttctccacatttgtgcaattaagagttttgctgagtgagcttaggactctgtctctttaagtgtttaacagtaattggttcatgtcctggtgttcattgaaaatcctagacatttcatgtaaaatcttcttaatgaggggatgaatttttcattcacattagaaagctcactctgacaaacaatttctaaataaaactttggcgacatgacatcccacattggacttgtcagagaggacaggtgcattagaatataactgtatggcgatccttcaagctgtcagccatgaatattttatttcttaatgaatcatctttgtgaaatcaactttcttgttgtagtgtcagtgccatttacaacaaaaagctggctccttttaaaaggtgagctccttaaagatgctgattcctgcataaaatgtttaaccctacccaaggtgttgggcaactgggggctttgtgctttgcttctcccttctgaaagtgacttgagaacccactttgggctagtgtgattacagtgaggagaaagctttccttgatttgttgtttccttctcagaactgaaatcccaggtacctgcccagaggcagctcccttggcccttgggtccctgttgttccaggtgttactcctattctttttgtagttgtctagggatttagtttctcacatcctgaggtccactaggtgctattagctggtgctaactgacagctctaggcagaaagcctttctcaggatcccagcttccctgtcttccagaactcaaagacggcttttgtttgttagttttgaggatggagacagctgtcattctaatgaggacttaaatgtgtccctgctgaccgagccagaacttatttttatgttgccactaggagtcttctgagatgctcttgtggctggatgtagaatccctttgctcatctctagacacagactagacaacgaaatacattcccctaaaatagcccagggttagttctatgacctttgtcactgttggtacagttctaagaggatattgattttttttttctttttaattcatagtctcaactatgtctcaagactgcccagcagtatttctgtttactcgatctaatttctcttccattcctcacagtggcaatttcaagcttctcctttttccccaagccccataatctccccctgatgcccttagaaagcttccctggtcagtcctcctcaccacctccagctccccctagaaactgaccatttatcccatcccggctgacttcttcccttttacaagaagatgtctctctttgaattcaactcagaggtcagcttcactgcctgccctgtggagtcgactctgtgtcccacccttcaggaatacggcttaataataagatgataaggattcgtaccagggattggcaaatgacagtcattttctgtttccttaagtaaaattttattaaaatacagctccactcattcatttatatattgttcatatctaattattttcacactgcaatggtgcatagtcaaatgctttctatctggctttttaagaagatctttgtccctcccccaccccccgccccgatttatactatggatcagcagcctaaaccctgcaaactgggtcccccatctaagagtctgcaatgaaacgcgagccgacttgatgtgtctcagagtgatcattcttgcccttggcggttgatgctagactgttgcagcttcaaatataatgtattttagtgctatacgacagccataagtattggcctgtgtccactggtctccactaggagaaaaccgagccaagcttgaaagtactaagcgtgcccaggggaaatggaataagctagaaatttgttgtttccttttcactaggtttaagtgagaatatttgtgagcaaactctcagtgtgggcaggtgacaatttctgcaggtattttccccccattttaacttgtgcgatatagttccctattttgttttgttccgcctcgatcacaacagctgccacccgaggtttaaagatactgttgtcctcatcttcagaacaagggttacgtttgctgtatctggagaaagtccatagtttatgatgaattttctattaatgtaaactcccactgtttataagtcacccaaattgttggtattaaattagatgtgtaccatcttatgtctcttctttcagaaaatgaatctctgtttttttttctctttctcctaaatgttaggaattttctgaagtttgaaaccaagtggcacaaaaacattgcatttattacataattgctcctagggaaatacacatacacacacatgtacacacatacacatacacacattttttcctaaacaacatcaatgtcataacagttttgaagcacatatacacactgacacatagattttgtaaatgaggcacatctattcttgaaatgcaattgcttaaaaatggaagttctgaaaataaataaaaagaaacatcaataaataaaagccccattttcatattcttatttgacctcttgcctctccatcattcttaaatttgacctccatcattcttaaatttgacctccatcattcttaaatttgacctccatcattcttaatcctcatgttcttaatggacatccctcccaccctatctgggccttctgagactgttcccccagccccagtcaggagggcttgtccacaagttgctgtctgaactgggcaagcctcctggcttccctgaaatggtgctgatgtcttcacttcctgccaccttggcaacctttgtagttgctctctttttgccaggggaacaaattaagagagagaagagtgatagtgtctacatgtggtctgctcactcagccagtattttccacagccagtctttccctagaccagcatctgagcgtgccttgtctatgggccacctatactattatttactgatgacttcctcattcactttctgttttttatctaaatgccagccttagccttgttcaaggtaacagtatacaggaaatcatgggtttcgagcatgttttgtcaatatttagtaaaatgcgttcatagctattattataaagactttaggtacattcctgcaccacttaataactgaatcaatctcctttcatcagggggaacaaacctgtctttggctcacactgtttgaggatataaaaggaagcatacagtgggcctcattctgacaaatttttagtaaatcacaggttgcctttcctaaatccctcaatatgatggctagtctgtttcatagtgaataaaaagtgatcctggatgaatgaataaagtgaaattcagataatttttctcaaaactgaaattgtttaaatcttcctttagttctcttttttctgcctgccccttctttcatataccctgtttttcacctcttttgtctcagtcccatctgatatttgaataacaatatgtaatttcaggtttaggattgttgatctgtaaatctcagcctagtgctttcaactcctggctttctcctaagttcaccctcctcccttccctcctttctgtaaggactctaaacgattgcgcttcattaagttatttttataatgagttcctgttaccagggaatacagagttaaaaaggtgatctcactaaaagtaattagcataagacctgctggacctgtagaagtgactggatggtaatcaatagcaatatgattacacccatgcagcaattataaattatttaaaacactacccctaggttactgactagttgcctttaaattaaattctctgtcgataattgatgcaaagaattaatgtgagaacaccttcagttactgcaactttttcaaggtggcataaaatattgaactattgcccgtcattagcagctaagctgtctgtttgctctaacatccttcttttctaaattggtcaagaaagagtctcagatcttgaaagatgacaaatgatttcgaatccactgctgggtattcttctaagagcactgaaatgtcccagtgagaaatttcatatatgaaggcaaaggaaaaaaaaattaaactttaaataatgaccagttatacttcatcaactctaacaaatgaaggagcagagttggttttccggagtttgcttcagttctttgatatggtcagtgtaggtcggggaggtcttccctagcttgagaaatcataacctaggatatttaagctgtcagtaatagtgttttaaaactccaggcctataataaagtaaaaagtgtgtctgataaaatgggtttttttccttgcttagtgaatgtcttctgtttctcgctaaacattgtcacttgccaaaccatgttttctgtttcatactaattttctactggcagtgagaccagcggaatctaagaaattgcatacgaaattcaaggattggaaagaagaagaggaagtcaaccattagcaaccctagctcctctttaatctcaagaggcaagaggtactcgatgaaccacatgctaaaataaaaaaaaatgaaccacatgctaaaatcaaatggcttctgcacctgtgtgcgttcctggactctggggtcacaggatggctgatgagatgccttcgagaaattaatactctaatgagggaaacatcctttcatgttggtgcaagagacgttctaggcctggttctacctctagttggaacggtggtcatggacaggtcacccccgctgtccagaacacatgtcaagaagtgggagctggacgacaacattcttgttcagagcgttcttcctccacattttatccaaagcagctccacttttacctgtgttatctactgagattctgcgtgtgtgaaacacaaggtcacctgccaaaagcaaaacaattaggccagcattgggctaggtgaggatccattgtcttttgggcaggtgattgtgatactataggagccggtgtcctgttgatggcatcccacaactttctaacctctgttgtagagttttgttagccacgatttggaccaacctgcagttaggccaagggctgctgatccaattggattaaggaactctgctgtttgagcatgttggcttcattcattggtatctcctacgccaagtcctaggcttggttacaaagggcaatgaagggtcttttctgtccttaagcactcacaggtagcttaacagtaatgccttggattccttccttcaagagcgacagcaggaagcccagcttctctggtagcagagcaggggtcctcaaagcagaccgtgaggtcagaggagcactggagtcaggagtttccatctccaccctgctgagtaaactgtagttacccacacagaaaaggaggctctccaggctgacagggtcacaaagacacacgactatgagatggaatgactatagctagaaaaaaaaaaaagtggggatgcccctcttgaccatcttatgcctgaaataagggaagacattcttcttttttatctgccaacctcccagtgccacagtaagcacagagtcaggcctcgaaaaataccagtcctttcgcctgtcccctctcacatggtttgaatccaagaggctgtcataccaggctcccccattcagtatattttctttatgtttaaatagtttggattgacttctcttttcttttatttttctgttgctacttaggaaaccatctccaggctagaacaagtgcctgaaatagagaagggtgaggtcactgcctaagacacttcctcctccacccactcctctctcagactcagctccttccacttctgcccacatggctgccattttaatttttgcttaaatgttgcagccaatatttcatgtattgttgttttcttccttgcctgggagactcttttgtctgaggttccctggtattttccaggggcccttctagcacttctgtgaactcattagcttccccttgttccagaaaatgtctgtcatacattacgtgcctttctctgtctttccctgcccctctcaccttcatcgatcacacttttgcttcacagaggtaagaggaaatcacactcacacagtatcttttgttttctagcaagctagaacacaagattttctagatgcatcttttgagttgatatgcaatattttccttgacagatttgttaccagctgagcagatattgtgtctgtgatgtatttgagtaccaggtatccctgattaccatagagtaatgtcttttattgaggcttttattattattattattattattattattatattttgagacagggtcttgctttcttgcccaggaaggagtgcaatagtgtagtcatggctcactgcagccttgacctcctgggctcaagcaatcctcccacctcagcctcctgaatagctggagctacaggcaagtgtactgtggcaattgttaatgttcacttttatttccatagttagccttgatcgtttagttttaaagagttatacaacacatacacacacatctaattgttgtgttattgggttaatgggaatattttagactcaagcctggttctttgcttctctccagcacagcaaaggatacacctccaagtataatattgaacttcaaagttagtaatgttcagtgatgcttaagcatgtagatcataaagtcctagactattttttgtctaaattattgtttgtagtcagcctctctactggttggaaacacaggcttgagtttggctttctgctctacctagttcattgctgcagctgtaatccagcctgattctaattttcaactggagatggttgtcttcttttttattccatgaaacaaattgattaatgtgtcgagggagcaaggtggtacttatacctacccagcctgcttgtgtgtgtctcaaggtggagagaggctgtggaaacaatagagagaatagcatggaaggccacgttgcaattaaacaagattgggaaagaagacgggactaaaatcatgccttgaagatgtttatcatatgaagttgaccttgagaccccaagaccggcttcagttttccacaatgcggctattatgagaaaaacagtgactaactgagcactgtgcataactcagttctcggaattttcaatcagaaattatctgatgacgggactaattcttattacgatagttccaatggatccacccaggatccacctccacaactaggtgtacagaagctggagatcccatcatgccgccgggcaccggtttacgagaactctatgtcttatcttggtagtacgattaggaaaacaaacacaatggtttctgccttcaatgtttccatggtgagggcagttattaggcatatgctaaagtgtaatatccgctttttcaaaccacatttcaaagttgatagcatcaacggctttaaaatcacttttaaagaatctgggcttacccagttaacagaaatagaacctgcctgtttatcagtgggtttgcctcacttttctgtgggtttcttttcttttcttaattatgcattaagaaaataacttaagtttctgtgcatacaacatcttcctttctcattcccagtaccctagaaacacagccgttcactgaagaggatttgagtgttgtctcctctgtggggtcaaaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatctattctcctttagaatttaataggagggtttggaaatgatgccatggaaaccctgagcagcttggcaatgctgaccccaaatgagaaataactatcattggtgttttccttctactactattatcttgcccattgatcttcaaaaagttcattggtcaaattgattgaggaacgcaagacttaaatgtaatatggctctggcaaattctgagatgctaacaaaaacaagttttcttaagaacaatgtcaactgactcacagtatccgactatataaagtcgagtgctctcatgccaggaagctgatacagttcatgaaacctcagtcattctttcgtattactcctgtcttctctttggaaaacaatctcatgaatttggtcttgacgctgacttaacatcccaggaaacagatactcaattccactgtcttttttgagaaatgaacagttctcaaactttgtttaaatttccttttcacagatgagtaataaccaaagatatttctgaaagggctctgaaaacatgcaggcaattgatctttaaaaataagatagaaatagtaggttttataaaagaaggaaatagaaatacttcagaagaaataaagtgtgctgaatcatgttttaaacataattatatccggaatgcacttacccatttgaaaaaaaaaaaaagtcaccaagttgtttccaattgtttttgtaaatttgcttagtcattttcagagacaaaaatttgggaaaaggattgtagaatgactggcttcccaaaaccacttggtgtttacaaagttatcaaaaacgggctgggaccactgatggtaataacaaaacctggggccctgaatcgtgtattctacatccgttagcacactgaagccacaccgcaaacttgtgaggccagcgttgcttcccctaccccttccgtcaaaaaccgtctgaggctgatcattaacttgcataaggtcacatagctaatgagaagcaaacgcatcataatgacctgggacatatgacactgaagcctactctctttccacaaagcttgatgtactcagatagtaattagtaaacattttcataaataatcttaaccttttcaagcatttttgtcgattggattgtagcactcaaaagtaaggtctgttttactaatataaaattgggcctgtggaataattctcttcacagaagtgtgtgtgtgtgtgagagagagagaaaatgtatatgcatacatatacatatattattgagacataatttacataatttatgttctataaaattagcatattttaaatatacagttctctggattttgaaaaatgtatacgtgtacataatcatggatccaccaccccagttaagatatagaacattccagggccaggttcagtggatcatgcttgtaatcgcagcatgttgggaggctgaggagggtggaccacttgaggccaggagtttgagatcagtctgggcaacagggtgaaaccccgcctccactaaaaatacaaaaaaaagaaaaaaaaaaagaaaaaaatagctggccattgtgacatatgcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatagaaatcatacctactgctttgtatgtgtcgtcttctgcttaatgattcacataatgtttttgtgattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaaccccccgctagaagtgtgtaagagtttatgttgcttcacatcctcatcagcactttgtaatttcagtctttttaattatagcctttttgtgggtgagaaacgctatctcttgctagttttattttgcattttcctagtgactaatgcctctttttatgaactcattggccgttcatatattttctttctgtgaactgcttgtttatgtattggccattttctaaaaattagatagtctttttaatattgaattataggaattctatatatattttggatacattctttttttttcatatgtactgtgaattttctcctttgtcttgtctatttattccttaatggtgtcttttgaaaagcagaagttataaatactgatagtgtccaatttatctttttcatttgtgtagtgctttcttgttctaagaacctttaccaatcaccaggtcacaaaaatattttcctatgttttcttctagacactccataacttcaatctttacattcagatctatgttccatctcaaattaatttttgtatatggtgtgaggtaatggtagaggtttatttttctctccataagactctccaattgttctagcactatttgttcaaagactaatcctcgcgctattcaatttccttggcatctttgtcaaaaatcagttgactatatatgtgtgggtgtatttctagactgttgtactccattgatctaattttttttcttatacttactgctcgattgcctggaagctaggtaataataaggattcaaactttgttctttatttcaagattgtttgggttagtttagatactttccttttacatatatatttcctgatcagcttctccatttcttttaaaaagccttgctgggagtttatttgctttggtattgaatctcttgatcaatttgaggaggatcaaaatcctgaaagtgttaagcgttaccatccatgagcatgcatctctccatttatttaaggcttctttatttataaacatttcagtgatatttgatgattttgaatgtggaggtcttatacttttttgttaaattaactcttacacatttgatttttttatgctattgtaaatggcattataaaatttcttttttccaactgtttgtttctaatatatagaaatacagttgattctagcaaactgctctcatatcctgtgatcttaaaatttatttattcaccttttcctttttgttaaatagattctgtagaattctctacatctctgaatatagttttacttcttctccaatttttatggcttttgtttctttttcttgttttaatgcactggctatagcctgtaggacagtgttgaacagaggttttgagacagacatcattgctttattcaggacttctctattatatgtgatgctagttgtatgttttctgtacctatacttcattagattaaggagtttgaatttatttctagtttgctgagagttcttttataaatgtgttcatatatatatgttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacacagtgagttctccataaatgttagttattattttaatattacagcatctgtggaaacagtgggtttatatttcagcgtcctgagaaacactcatcctgaacaacgggaacattggccacatccgccattgtcaattttaaataaaagatatgatgactagttggtgagttgatcttgtaagacttttacagatacccagaacggctctacttcttcatattccactttttagttttaaaagtttaaggagatctctgtgatccctgaagaattgtgtgcaaagcagcattaagacgaaaatcttttatatttgtgttgtagcttggaaaactagcgcgtggtctgttttgttccactggctcctaaggttcaggtattaacataaatacagcccattaacacttgttcctctctgtcaggacataaattaagtctgcaggtgttccatgaagctgtacccttggtactaattaagccttgataattaggtttgttaaattcaggactttaagcttatattccctccttgggctaccaaaacggagatgtgcaatatacaagccctcctgacttttttttttttttttttttttcctgcagagagcgttgctgctccttctctattttatttctttattactgtttttttaaatgaaggagtcagtaacaaaccgttcatcattttgccagagtagggtgtaaaccttcatgcagacctgtacatttgtttatgacgagattaaagtcttttctcctcctgttttgtgtcagctcagacactgaaggggaaagtttccagcctggtttctccatacactgaacatgttgaaatctatgccttaagcccaaatgagctgtcactcaagtatgcacgctcatattattaaaaactgtgcatgtaatttgctgggcacccaaataatttgttttttatttttccttaaaaatgagactttctgttaggaaagtgattcatgaaacagtgaagatcctgcctcacaactttcaagaaacccacagaggtccctattcacataagaattttctaagcagaggttccaatttggatatttcgtggccttcaggttatttgtaaccagtacacaaaccacaaagtcataatcagatagattttctttccagcctgtctttcctctttggttgctttgtaaatctattactcatcagatcatatgtttggcaaatgccacttttcattttgaatcaatggaatcataaaaaacaattctactagtaccactttcaagaatattcatagtggtcatgctaacgtaataacctctcttttttatttgaaggatattaaataaaattgtacttttaatcagagcctttttttgaaaaaaaaaaaaaagaaaaagatagttgatattgtgggagatggctacaatacagattcatcccatattctctttaatgttctattcccaagaagagcactaattaatctctctagaagggtaccacagtttccatgagcgttcatattttgaagtttccaagaacatgttctacagaatggaccactgctctcttttcagacccaacccttgtatcagagtttgcacacatctagaagttccggttctcccagtcattacctttctccttcaagctgggattcagagtccattttcatagggcaaaatgcagagttcgggttccttcctatccatgagagtaggtgctgaaggagataaaggaatgaagacatagactttgaaagcaatagtctggcaatcatccaaaggtttgtgggaggacaaaagatcacaaagtatgtgtttgtgaaaataagactatgtcatgaaagctttagaatatccaacacattatagaatattttcacggaaatatttcggatggaattttggctttaattctttctctttttttcctgttcttttccctctccccacaaccacttctgtttcattttctgttttgctccttcttttcataagtagctggtagtcagtgttctctttttcttcctgtgagacaggatctccctctgttgcccaggctcgagtacattggtaggatcttggttcactgcagcctgtgcttcccagactcaagtcatcctcccacctcagcctcctgagtaactaggaccacaggcatgggccaccacgctgggttagtttttgtatttttttgtagtaacacggttttttcatgttgcccaggctggtcttgaactcctgtgcttaagcgatccacctgccatggtctcccaaagtgctgggattacaggcgtgagccactgcgcctagcgaggtagtcagtgttctaaacactggtgtacaatccaagtctgtcgctgcccaggatagaggagggatgacgtgaattcacacgggcctctcctacaaatctgagtgtacatcaagtgaggggcgtccctccgcacctcactgttgggctgatcaatcccattcccactccattatgtgtgtatttctaagtggcagatttgccttaggaaatggaagaaggggatgaaatagtgaccaacacaaattactgggttggcgggagttgagagctggcaaaatcgtcttggagaaggaaatggtgcagatttcagagctggcagacagcatctacatccacctctgcaggaagcaagggaaacatttttcttctggagaatcgggcagcctgcagctgatccggtggtgtctgaaaccatcctgtgtgctgtagtgtcaacaacttagcctggttactttgccaccaaaccccaccaaatgcctttgtatctttttcagaactgcatctctgcagcataattgatattacaggaatgaaaagtgttctgaggcatattattcccagggtaaagagtcaccgctgattaattacctcaaggacaaggggacggtgactttttctcttgtatccagcagcgccacgcggggcgggcgggagaggcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaacgcttttaccatgggtaaaccattaggccggctctgcagggagggcaagaccacagcagctcagtatttcctgctcagggaaaaaggccaggtcttttgttggtggaaatccacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggacaggacacttcctcctagtgtcttgtaaagctgcaagggagtcgcggctgagtcgaggatccacattcctggatgagtccttttgttaccagcggagggtgtccgggttcttggcattttgaagaaatagttggacaaaatgcacaaacaaagcaagagaagaatgaagcaacaaaagctgaggtttattgaaagcaaaactacactccatagagtgggaacggcccaagcagccactcaggggccctggatagagaatcttctggagtctaaatactccctagatgtttcccattggccacttggggtacaccccttataaatgaagtggtggcctgcaatcagtcttattggttgcagaaagcaaccaatcagaggctgaagtgaagttacaaatatcacactcctatgcaaacatctgattggttttggaaagcaaccaatcagaggctaaagtgaaattacagagttgctcttttatgcaaacgaagactccgcctccagtcagtatgattggttgtgggcagcaacccatcagaggctgaagtgaagttacaaagttacactcctatgcaaacgtctgattggttgcaaaaagcaaaaccactcagaggtactttcaatttcccatctgccctgcagaaaaggtaaggggttgcaaaagagtagcccctcctccttttgttacttaggcgtggaaagttaagggtttcctttcagtttggttctaagaagtcagagtgaaatggctttagattccctgcctgcagattctattccccagcctcactttgagaagcacctggacacttcgctctaggcacgtgtcttcttcaagctgccatccattatgcatagtacaggagctcagaaaagtcacccgtgggttcctttctagctcaatcatgctgagagtccagtccatttataacataattcataaaggaacattctatttagttctcagaactctgtggcaggggactgttgttattcctcctttacagaggtgggtctgaaggtacagagtggataagtcattttctccgggccagccacacagcgaatgaatggagactccttgtgtgtagtaaatggctgcagccctataagctataatcatatatcatcaacacctttaccctgttattaacgtgtctgaaattagggaacaccacgtacaaaagggatcagggtccacctttctgaagaaaactgcagagcttttgcagttattaaactagcaacagatgtaaagtccaactgttagagtttttctttaaagcagaagttagcagttacaggtgcttgtgatgtcatcacttagatgatcttataaatgccttttttttttttttttttttttttagtcggagtctcactctgtcgccaggctggagtgcactggcatgatctcggctcactgcaacctctgcctcccgggttcaagcaattctcctgcctcagcgtcctgagtagctgggacaagaggagcacaccactgcgcccagctaatttttgtatttttagtagagatggggtttcagcatgttggccaggatggtcttcttctcttgaccttgtgatctgcctgccccagcctcccaaagtgctgggattacaggcatgagccaccggcctggccataaatgtcttttctgggtggggcatggtcactggaaatgtaaaccctcccttccccaggtcagcctgcctcccaggtgttggtgctatgattacagtgaccacataatttatcatccacactggcacctttttgagagaggttggggagcaggtaattatgctgggacaataggcgtatgtcaagatatctggtcaccctatctatgatctgtcacacttagtactttctaaaattctcgggcctttgcaccttctttttatcaacacttagttctatgttactgaatatttcttaattaagtgcaggaaagaaaataaccattttttctccttttaaagaagcacacacacctttcttttattggtattacattccttttcccagttggtgcccctgttggttttccaaattgtcttcccatccttatcctacctcccaatagagtacctcatcctatagtgttattataactacagaaaatatattttcattccttccacttcatgctttcagctagaaatgtgagtctctgagacttgtattcttggggtcacttaaaacatattgcataatgaggccttcaatgactctgatttggaactgaccctctatgaggggttatacccctggacaccaagctgctggcctgagcatgaggttgatggccaatctcaggagaggaggaggaagaggaggaggcggagaagaaaattgcgtgctaatttcagttgtatattgagcccacacatatttacttccaatatgaagcaaatctaagaaaaattctgctttaaagaaagaaatgtaaatcaagtgactgttgatggacgcttggaagaattcttatttatttatttttttggacaggctttcactctgtcagccaggctggagtgcaagtggcccaatcatggcttactgcagactcaacctcctgggtgcaagtaatcctcccacctcagcctcctgtgtagtggagaccataggcatgttccaccacacctagttaattttttattttttgtagaaatggggtctcaccatattgaccaggccggactcaaactccgagatgcacgtgaatctccagctgtggccccttccaaagtgctgggattagatgcatgagccacctggcccagccagaatccttccattaataaaaggatggaccatgaactcccttttatgatatgagccgatcaaatgtgagcagaatagtatcctatttatacaatgtagtttaaaaccaacttcttagaaccatgagctaagggggaatctggatttcaaatgctagttgcatcaaacacgtttccaccccctcaaaacgtggcccaaagtcattagtgtcggagcacccagccatccttggctccttcccacctatgttgattaattaaaggacccaagagctaaaagggagaagtagctgcatgcttgccacttagtaatattttgataagtatttttgggatgaatgcaatgatggatgaatgaatgaatgaatgaataacataggctacagtattttgtcttcttggttagggaccttgagtaaactgaggagtctgaggggaatgccatggaagtctgtaaacccaaaatcctcagcgaaacctcagccatctagggacatctggggcagcagagagccactggtgtggtgagttatctccctgggccttgagatagccatgctgttttgtctccacaaggaagaagtaggaggcatagcccaaggcagcttgagaggaaagcctcttggccttgaataagatgactttgttactgggcaaagaaagcccggctggaagtgctctttgatatgcaaatatagcctgataaggatttcctctccttcctactttccctccccaaccctcccccaagctaaaattctcttcccaggagccctgtcatcagcagggagttttctgtctttgtccccatctcttcacttgtgctgtgcaaaatcaggccacgattgcagggtagtccacggcttccaaagagaactgcataaatatacatctttcaggggaagagggagaacctggagaagtcaggagagcaaaaccatgccagtcagcttcagtgatgataaaggttactgttggatgaaagtttgcattttgttgtggtgtgggaaggaccttatcctgtcagctctatggatgtgcccagtttaagctctgaaagttcctttaacttgaaattgtttttgatcatgtgacaaggtcttctgaccctttatcacccacagtgttttattcatttgctctaaaccagcagtaggtgaagttaggaataatatgtcaagcttcctaactccatggtgctctcattgttgtgtgtgtgtgtctgtgaataaacacggaaataattacgcaaataagctattggcaggtggtgataacgtaaccgcccaatgggttcattctgcctgatgcccagataaagccgatttatctagacaggggaattgcaatagggaaagagtttaatgttggtagagccagctaaacgggagactggagctttattgttactcaaatcagctttcctgaaaattcagagactggggtttttttaaggatagttttgtggacaagagaatgggtactgctgatgggctgtggatgcaatcataggggtgtgtaaaacccttgtgccctgaatccgcttctgggtggggggcagggcacaggaccagttgaatggggatggggctaccagtcctcaaaaatgcaaaagccggaaaagacatttcagaaggccaaccttaggttctacaaagtgatgttatctgcaggaataattggggaaattgcaaatcttgtaacctctggaataatggctgctaatcgtttatgtccactctttagcagaattcaggctcctgtcctcctcctaacttggtggtcttttgctagctttacaaaggcagtttagtttgggggtagggccattatcatttaaattaagtactaaatatccccccaaagttagcttggcccaagcccaggaatgactaagggcggtctgaaggttaaaggcaagatggggctaggttagatcagatctctttcacggtcataattttcttactcttacaatttttgcaaaggcagttttaataactgctatttagcaaagacagttgggtaagttactagagggagtattaccttagatggggccaggagggtttctctgaggagatcccatttcaacagatctagaaatgtaatggagccagtcctagggaaacaggactaccaggaatcctcaccagccccgcaaagacgagggagcagcaagttccaaagcccgtggcatgtcaagggtcgatgaattcaccaactgcaaggggctttggtgaccccagtgaacagatgagaaaggggaggaggctgggatcagtgcacagctttgcaggctttgggaaggaatttcgagtttatctcatttgtccaggtatttggatgaagccctggcatactaaccgtatgaaagtttatagttcccaaattgcaggataacaaggctctgtaatcttcatttcctcaaagttttacaccaggattctatggccaagtgtgtggcagtgtcacaacttaagagccagtgtaattgcccaacgggttctccttgcccgctgcctaagcaaagccgatttatcaagacagggggattgccataaagaaagagtttaggtccaggcacggtggctcatgcctgtaatcccagcattttgggaggccaaggagggtggttcaactgaggtcaggagtttgagaccatcctggccaaggtggtgaaaccccatccctactaaagatactaatattagccaggcgtagtggtaggcgcctgtaatcctagctagtcgggaggcagaggcaggagaactgcttgaacctgggaggcagaggctgcagtgagtcgagatcacaccactgcactccagcctgggcgacagactgaaactctgtctcggaaaaaaaaaaaagagtttaattcatgcagagctggctgtgtgggagaccagagttttattattactcaaataagtctcccccaaaactcagggatagagatttttaaggagaatttagtgagaagagggtcagggaatggggagtattgattggtcaggtttgagatggaatcagggagttgaagctggcctcttgcactgagtcagttcctgggtgggagccacaagaccatatgagtcaatttattgacctgggtggtgccagctgatccatcaattgcagggtctgcaaagtatctaaagtactgatgttcggttttaccatagtgacattatcccctggagcaatttggggaggttcagaatcttgcagcctccggcagcatgactcctaaaccctaatttctaatcttgtggctaatttgttagtcctgcaaaggcagtctagtccccaggcaggaaggttgtttattttgggaaagggctgttatcatcttttgtttcaaagttaaaccgtaaactaagttcctctcaaagttagttagtcctacaaccaaatcaactttgaacaagacagcctggaggttagaagcaagatagagtcagttacatcagatctccatcaccttcataattttctccgttataatttttgcaaaggctgttttaataacagccagtcgttcatgtttccttgtgccacgtgattattttgtacagtcaacattaagagacaggcacttgtaaatgttgagatgccaagggggaaagaattttagaatccagatccgctttggtaagagtggccttcgagcctcatgtattctctgttcagctgttaagattgttattaaactttatggaccataaaccccacagaaacaaggaggttgaacaaccatgctattacacaagtgtcaaaacaggagctgtatttcatgtcctgaaaagtgtgcacggttggcctcctctaggtcccacgtgccttctggatggttttaaccctcagcctctctttggcctgtgagtgaaacccatcatttgacacagaggctttctggaaatgatgctcctcttagatgaaagttccctttcagaaatctttcattccctgacctctgtgtccatcccactaatatatttcttaccaggagtacatagtttgttctttaagcaaaaccatatgcatcgtattttaaatggaacagggaggttgttccatgcgtcaacttagtccaaatgtagagggtcaggaaaacagtgatatgagaaaagggccagttactgtctgggaatccataaatactgcttggcaaatggcacattgcatgcttattccttaggcatccgtttagcaaaataagatgtcaagctaattgtaatgatatttctggggtttcatcttctctccctggtacataaaagaatgcaattccacctatattttgatttaagatcaaatttttgcaaagtataattacatttgatgtaattgcccatgcaacccagatgtcatatatttatgttattattatcatttttcatgtgtagatgtggtgatcgtttgtgctttgttaaatattcctcgtctgtccttctggggatgatgctttttctccctttttggtcaggcatagataggtgacttgctttagccaaagaagcatgaactgtcacttcaagggggagatttacaagccagtgcaggtggattccctgctttctcctgacatcatgatcatggactcacatgacaaaatggatcctccatcttccagcatctctgattgagactaacaagggccctgacagccttttctggacttgtagtatgtgcaagaattaagctttttctgtatcaagtcaccgtgttatgggggttgttcctcactgcaggagaaccttgttcatccgtattagaacagtgtggtgtttcatgttagcagagtgtatcaggatcttttgtttttttttttttttaaattaaggatgctgtatgagtcttttctcatactactgagaaagacatacccaagactgagtaatttataaaggaaagaggtttaatggactcacaattccacatggcggtggaggtgtcaccattatggcagaaggcaaacaaggagcaaagtcacatcttacatggtggcaggcaagagaacttgtgcaggggaactcccctttataaaaccatcagatctcgtgggacttactcactatcacagaaacaacatggcaaagacccatccccatgattcagttacctctcaccgggtccctcccatgacgtgggaattatgggagctataattcaagatgagatttgggtggggacacagccaaaccatatcagatgcaaagttatgcatatgttgatcagctcaatttagcctttccatcatgtttacatatttcaaaataatgtgttgtgcacaatatatatgtgcaatttttgtcaattaaaaataaattaaaaaaattaaaaaatggctttcccacagcctgtcgacttccatccccatgtgtggctctccccagggcctcccttcttgttctccccagttgcagacctcagacaggagtctgcttgtcttcctaggcccttgtcagagtggaaggtggccctccaccacaccagcccactttccagttatcaaaaaggatctttgatttaatatttccagagcaattttggtgatttccattcaaatctgttttttgtcataactaccttgcttgcctatgggacatgttcccatttcagtgcatacttgacctttaccataaatcacatatttgtaaactgtaccctcctgctgttttattaggcatggagaagcagtcttttctttttcttgatggcctgggttgaccagatcctgacttttgtggagacattaaagtgctagaaatgataatggtgaaagattcagaagttgaaggagatataaggagagaaatggacaattcttttggtaattgaatgaaataagactcttaggaaaattctccccagtggcaatgttgtaagaaacaccaggccgggcacagtggctcacacctgtaatcccaacactttgggaagctgagacaggcagatcacttgaagtcaggagtttgagaccagcctggccaacatggttaaaccccatctctactaaaagtacaaaaattagccagacgtgatggtgcgtacctgtaatctcagctactcaggaggctgaggcaggagaatcacttgaacccgggaagcggaggttgcagggagctgagatcacgctgatgcattccagcctgggtgacagagcaggactccatctcaaaaagaaaaactcaacgaaacaccccagcttctatcattctcaagcttagtgtgtgcaagactcatggatgctgcttgttataaaggaagataaattatgaacaggcagactggtctgtgaaccttacccagaaaaatacacagtagtccagtatattggcctccagggcaaagctacctaggttctgagtccaattatggccttcatgagtcttgtttctttggacaggttttccagtgtctctgagcctcaacttcctcatgtataaagtggagatgatgccattacaggttgctgctttatggcacataattaatactagctcttatttataggaactgaacaaagccccagttgttttgaagcatgtcctatcattaacacaggtaatcaggatatattcattgaagtctcactgtgtgccaggcactatgctatgcaccttatgtgtgttattttatttcatccttccagctctgggaggtgatgactgtcatctgcattttgcacatgacaaatctgagggtcagagaacttgcccagggtcacacaattagtagatggcagctcaaggggtttttgcctgcgtcttcacccaaagccactaacacgggatctgtcaattgcattgctggtgatcaagaaatgccagctcctccgctcttccctgagtgccttgttggagacaaaaccagcagggttatatccccagcactgtaatttagtgtggcagtcaggggaaaacaccttgtagaatttcatttcttatcatttaatgtcccctttaattctcatttaagttcccctctgtaaaaggcagtcccttcagctctcataaaactttatggtctttacttgtgattaggcaatggtaaaattgattctctaaaaccaacttctagtcaagttatgtaattagccaataagggaggctgagagaggaagatatacaaggttctccctcaagaggtcagacgtattatcattggttagatgccgtatctttaaaacaccatcagcttggaaaacactatccattagcaagagatcagagcaagagaaacctcgaagggtcgaacggtccattctgagggctccacaaagaactcggcatcccagaaggatgattagccttccatctctcgagttgtctcagagcacaacaggtctgagtgtttttttctttaatgaattaaccctttggatttcagccctagcttttgcttcccacatctgacatcctgccctacctcctgccagaaaagattttgatttcgatcatggcagttgctgtcgctgaggtaatatgaggagatccgagacctcatccttgcagggagtgggcttgagataattctcgttacaagtttgcctagtgcttcacataagcagaggccccaagacatcagcaagcccgttttttgcctcttcctggttcatggttagactgcatttttgagcctctgcctgttaggtgcagccatgtgcctgagtcttggccaatggactgttggaagacgagacgttggccccttctcaacctgacctgtaaaaacctgtcttgcaaaaccctcacggctctttcccctgcagtcttgatgtgaacaagcatgatgatgttggaagccatacacaagctggatagagccagggtccctgagttcaccacccagagcaaagtcacttgtcgatcagaaatacagaactagttttggacttgatgtgagaaatcttttactgtatcatagtagcaagcattaccccaaccaatacctgtgctcatactgctacagttttttttttttctttttagtgactgggtcttgctatgttgcccagacttgggtgcaatggtgccatcatagctcactgcagcctccaactcctaggctgaagccatcctcccaccgtagcctcctgaatagctgggactaaagtgtgcaccacaatgcccagctaacttttgtattttttgtagatacggggtcttgctatgttgtccaggctggtctcaaagtcctggcctcaagtgatcctcctgccttggcctcccaaagtgcttggattatagacatgatccactgcacgtggcccatactgctattccagacaagaaattgtaccaggaaattcactgatattattggtccatctgaggatcatcagagatgaaaatgagatttgacaactgcatttggaaatggagtatgacagtatcattctgatgtagggaggatatcacctcacaggagtctttcctggctatcctgtccaaagtcactactcacaatttctctatcccataactctattttatttctctgtctagcacttatcactatctgatattttctgtctatccatccgtctattcattcattcattgctaatttattagtattgccttcccatgaactattagctgccagagagcagggacctcatctgtcctgtccactcatgtcttcagcacttagaacagtacctggcatataggatgagcttcagaaatatttgcaggtgagtgaatgagggagtgaatgaatgagggatttgcagcttgaacgctgtactttgaaacagttccagattcatgaaatttctttttaatgcagaagatttcttatgtgattaactgaatgggaattgatgctttgtggaatgaaatggattgagtacagagtgtgggatcaagaacttttaggcactgtgagtataagagggaaaccaggccgggagcagcggctcacacctgtaatcccagcactttgggaggcggaggcgggcagatcacgaggtcaggagatccagactatcctggctaacacggtgaaaccccgtctctactaaaaatacaaaaaattaactgggcatgctggcaggcgcctgtagtcccagctactctggaggctgaggcaggagaatggcgtgaacccaggaggcggagcttgcagtgagccaggatcgcgccactgcactcccgcccgggtgacagagcgagactccgcctcagaaaaaaaaaaaaaaaaaaaaaaaggaaccagatggccctgcccttgagcaggctgtggtctggcctggtggagagacagagaatcagttaattccagggtcatgtattaggtggtaagatagtggttcacaccaaaaacatagaaaatgatcacttagcctgatccacaagttcaggaaagggctctgagcaggagatggaagacctcttggctggttaaatggagatcaagtggcagcttggactcctgctgcaattaaaaaattactctccagttttcttcatgtgcctccccattcactccaccaccactcaccccaaatcagatcatgattcatttgggttgtaccgattaagagggttccctttacatgaccattccagtcatgaaacagagaatctggtcacctgtcctttatcttggctggtccaattccataagaagtaaatgctgtgtgtctgcgattcaaaagacccctttcacgggaggctgggagatttttccatctaaatagcttaattgttactctacagggcaatcataaatgtaaatcgacttaatatgacttgattgttagtaatgactgtccctctaatgacgctggccaatgagcctacacagaatgtcgcatgcagatcaatgagccaaatgttagcaggggactgggcatttgaagatttaaaaaaatgaaaaattgcactgtgacattgctggttcctattagcaaaataacagacagtgttatcagtcattgactcagaagatagtttcttaccgtttggggaaagtgcttgtctattcctctccaaagccatttaaaaaaaaaattgcaccagttctcatcccgtcatctgccttgatcaaacatttgcttattggaatcacttcgaaaaggaacttggtatcgttcacatgtgtttataactctcaaatcttcttcttccaatttttaatcttgatcaccacagctttataacaggaagaacgctcaaagaagaaaaatagaagaagcctgaattttaatttgctatttcttcacacacaaaacaccccaagctcaatcaatgcccagaaatgaaggccaatagatgatagtggggcctcagatttcccacctattgttttgaactctaattagggaaagggaatttggaaccattgtcttctctgagtgtgcagacacgatgctatcattgtgtttacagaggtggtcagattcccagcacagtgtactcccgcacagataaccgtcccatcttgataaaacaatgctctcagccgaatcctaaacacgctgcacaaggaagaccttatgctgacagtagggaggaagcgacatgttaacaaacaagtttgccggccaggaagttttaatcagcgctttctactgcagggggtatgatggatggagaccctgtttcagaggggtttcctttagataaaacaataataccatgctttcaagaagctcgttcgacagctgtaaagctatgattaatcccccaaaagtcaaacatgggaagactggcaagatgagattattcactgggtataattagccacaattatcgctaaagagaatttggggagattctgctctaaagggaaaagctttgtaaaggagaattaccagtagagtgaccttataatttaccatccaatggattttgaatacttctgagagagaaatgagatactgataataattataccaagacaacagacataaattgggattggcctagacgagcaaagatgaatggtcattctgtctgttagtaaaattccatcccaggcacaatatctcagacttgaaacaaaataaaagtgattctttctaggataaactctaaactaagtgtctgataaattctgggaaagtttatccaattgttacaacccagggtcaggaaaactgttttcaattttctgctgtatgaagttgccagtgttaaaccctttcgatagcaagtagaagaaatgttcattcaaacaggcttaattaactgaaagatataggtgtggtaaggggatcaggtaaagcttgacccaggggctaaactttaaggacctggttcccctcttttcatcccttggttttatttttctcagcattggcaccattttgtgacaagctcactccttgggtcttatgacaaatgttgactcttctaaaccacatctttccagattcaatatagtaggagaagaccagacttgctcttttcctggaatttagtctgacgtggctgggacaacatgcccactctcaaccaatttttgtagccatggagatttggaagtctggcaagtcttgggtcacatgatctaccttacagctgttactgcagacctcccaaagctcacgaactgagagtcaggaggcgtggttcccctaactcaaatcagaatttcgttatcaaaagaagagagggatggttctgtggtgtcccacactcaaataaacatcctttaaatacctctagatgcttataattcctgttgcagccttagtcagtgggagccactgacctgcattcgtgtaggaactgagcaaggttcatctagtctcggtagctacctaccccgagagctggctgatttttttttccttaaatttaattcaagacttcatgaagtcaacaaaatggtctgttggaaattattcctaacccccaaccactgtcactgccacaatcaaacatattttcattcttttgcagctgcagcccttctacttgaactttcccactcattgcccttataacttgccatttaatatctcttgctttcctacatggctgtgactactcgtgggcagggactgtatctcctgtttttggtagtgcctccagaaccaaacaccatatgtcataaggtctattaataaatatctgctagtttttaaagtttgagaaaaacccgtattgtggaatgaaaatgatactgacaaggaatacatctagatcagaaatactgatatcctaagtgagatcttgttttttaaaacaaaaaaaagtttaagaaattgtcatataggctgggcgtggtggctcacacacataatcttagcactttgggaagttgaggcaggagggccacttgaggccaggagtttgaaaccagactgggcaacacagtgagaccccacctctacaaaatattttaaaattagccaggcgtggtggtgcatgcttgtagtcccagctactcaggaggctgaggtgggaggataggaggctgaggtgggaggatcacttgagcccaggaggttgaggctgcagtgagctgtgattgcaccagcctgggtgacaaagtgagaccttgtctcaaagataaaagaaagaaagaaagccctatcaaaattttaaaaaataaaacataagaaaaaaataaatggatacatgatatttgtacttctaagaggcatcttctatacatttcctgtttctctcttccttttcctaaggagtccttgttgatttgtggccatgaaacctctctcctttccaggctggcttcttacctaggtcgtgtcctatccctttattttctggcagggctggactgtcacttggttgttctcggtttcaggacccacgtcttttgtctctgtaatgaatgtgttcagaggtctctgcacagagaagctggctgttaagaaaactttttcttctttccgagacaggctgcaaaatgcttgttactattttgtgtattcctggcaggatttgtattcttagttttattactaatgataataacagttaatgttgaaatcagctccatcctgaaagcactgcatccattatcttattctagtctcaggccctggaggaattttctctcactatacccatttcagaaattccagaattaatgctcggaggagtcaagttacttgtctaagctctatattacagaacttaaattggcttctctctttcctttgcggggtctcacatgatccgtcgttccaaatatgagcactttctcttgtcttttctgagctacctattccaagaacacagaggagttgttattgtggttacttgtggtaagaagagtacctttctgattggacccagggcagaaaaaagaactttcaggtggaaatacagtcgtggtgtcaggtagtgtgtaacttcgttaagttcagtcatagcagccgctgccaaggggggctgttcctgttcctcatttccaattgaaattaataactcacttgagatcctactaaacaacacacggaacaatgaccgcaataaccaacatactttgagtaactattacatgcatgggctctgtgctattctcttatgtgtattcatttatttaattcccttaacagttctttctggcagagacacccccccactcttagcccacttttatagatggctaagcagaggctcagagaagtcagacaactcacccaggatcaagcagagggcaagtggtagattctagaatttgcatccaggcagttgagtctagaattgtctttgtgtattttgctccatggtctagcacaggatcaccattggtagatcatcacttagaatgccatcactaccttctaacagcaatcagtccccttaagtggctttcttctcttttttttcttttatctttttgttttgttttttttttttttgagggagtcttgctctgtctgccagatggagcacaatggcgcgatctcagctcactacaacctccgcctcccgggatcaagcgattctcctgcctcatgctcccgaatagctgggattacaggcacacaccaccacacctggctaatttttgtatttttaggagagaggggttttaccatattggcccagctggtctcgaactcgtgacctcatgatccactcgccttggcctcccagagtgctgggattacaggcatgagccactgcacctgactaagtggctttattttcttatgtggggatcctggagacacagtgtgtgccaaagcgtctgcagaccagtctgtacagttgattatagatatattaatgaccacttctgagctaaaaaatgatctagaataatagactaccaaacacgtaagcttatttacggtttgcctccttctcatgcttttggaagggaagcactgagggtcattgtatcagtcagcgtagactaggtttgccgcagtaacaaacgaccccaccatgccatagcttgcaaaaacaaagactgagttcttgtctacactgtagggccgtcaagagctggctctgcttgctcttggtcttctccatgccaggatccagagtaaaagcacagcttctctctaggactccaggggaaagagaaaagacaagttcttaaagtttcttccaggacgtgacacctgacatttcactggccaaacacagtgacctggtcactctggggcagggatgtgtaatctccccatagctggagaagtaaataataatgcacaataacattgtctcccatgggtgcagatgtgatgctttcctccttgtgactgttttctgtcttgctgtcccaagtcctaaggtcccagccacctatggttctttggacctgtgattttcgctgaccccgaatgactggaggaactgctgcctgcatccccaacccagccctccttgtcagtcacgtagaaagcagttattgtttccaagttccctgcccttgttaaatgtcagctttgagtgaaaatgttcctaattttactcagagtgcaaagaacatccaggtcaggtacctgacctgcttgattcatgtcttggaaacactcctttgtctttcagagaaagtaaagagtgatggagacagagagagaaagtgtgacctactttttattatcagcaccatttcatctgcaaaacacgacttttctcttcttattacgctgagcatgaaaataaaatgttttccaaaagacctggctttggctgttgtgaggaaggccagggacttgttcaaaactctgatgagctcgatgagcaaatgattccaatttttaaaaactgtaattgactttcaaactgctctcactgtccacacataatatgtggtacttttctgcaaataccagcagcaaggtaggacaaaaccagctcccacactggctgtttgcttgatattaagctttgccagtccaatataggtcacatttccaaccagattttgtgcttatctctacattacaccttgtagcaagggggaaaaaaagagcttcttgacatctttttgaagaatggcgctctttaaaaaaacataagggaactttttttttcaaacactgtaatgagggtattcaagtctgcaggcaaaacagagctgtttgaaaagacattagcctcgaaaccgcactgtgccagaatagatacagctacgtcaaaatgccgcatttattttgccattacttttcactgactaaaaccatttgctaatgaaagttctagctgacataatttcagcacctgctgatggaaaggtggactcactggtcatggggagtacagtaaaattaggagagtagatagaatcctgaagcatttgagctgcaaaatcatagtaacaacagctcttaatatcctataattgaaaaagagattgccattttcaaagacctttcacagtcattctcttaatcaagtctcataataaagatgtcattgggactgagcagcttactcacattctcatttcactgatgaggaaactggagctcagggaggttacatggattctggatgacctacaggtcatggaggtaagagaggaatgggttcctggcaactccttctgagtactaactgttaaagtaagcagagtgtgtgtctaaacttctcatgggctactgtgaggagtaaggggtaactgcaagttagaaggcatgatgcccaagattgtccttactctgacacccactgcaagtttgaggtggtcctcaaacccatcctcatggctgatatttgctagaaggacttgtggcacttagcagaagctattgtatttacagttacagtttattacagggaaaggatacaggttaaaattagatcggggaagagacaaatggggcaaagtccaagacaagtaccagatgtgaagcttctattgtcctctacccatgacatcaggacagaatacttttctactatctatgtgtggcagtatgcatggaatattgtcagacagagaaactcacctgagcctctgtgttcagagtatttattgggtcttcgttgcgtaggtgtgattgggtgattgcccacatatttgatctcagcctccaagtcaactgataactgtggtacagtgtccctaccctaagcaatattgttggtcctttaagaatggttcatctgcaacctaaggttacatgggtgtagttaggccccatcctaaatcacattaagagtctccagagtatgatcagaggtgcccaagcaaacaaagactctttttttcaggaatatattctgcatatatttcagtgattttttttttttttttgagacagtctctcattctgtcgctcaggctggagtgcagtggcgtgaccttggctcactgcaatttctacctcccgggttcaagcgattctcgtgcctcagcctcctgagtcactgggattacaggcatgcacaacaacacccagctaatttttgtatttttagtagagacagggtttcaccatgttgcccaggctgctctcgagctcctgaccttaggtgatcccctcaccttggcctcccaaagtgctgggattacaggcgtgagccacgaccaccagcctcagtgaatgttttttaatttggaaaggattttataagaaaggattccaactttcccatttacagagaaggaagctgaggctcacaggtttcactcaaaccataaagctcaggagtaactaaaggaactggagcttgggggtcccagtcctgggcaccattgctaagtaatgtggcctattttcaataagggcttattaatcatactaaaaataagaacttaaaactaaatttttatttgcctagaaatctaacatctttagataaaaatattccatattcaggaggcataattctttctcttttcttttttttttttttgagacagagttttgctcttattgcccaggctggagtgcaatggcgcaatgttggtccacctcaacctctgcctcttgggttcaagtgattctcctgcctcagccttgcgagtagctgggattacagggatgtgccaccatgccaggctaattttgtatttttagtagagacggggtttctccatgttggtcaggctggtctcaaactcccaacctcaggtgatctgcgtaactcggcctcccaaagcactgggattacaggcttgagccactgtgcccggccatctttctttttcttcctctccttctaccttgcccaccatggcttaatttcaccagaatatcatcattatcaacatcattatttctagttcagatcattctaaaaatagagcagtcattttcttctatataagtcccaggtccagcctgctattttttgagcctacctttcctaatatctagtttatattttgttttgttctttcttgggattgggagtcagaatatcaactttttcagaaaagagctttggaaattctacatacataatatatataaattttccattcatagtgtgttagcagctttttctacaaatctcttggcgggtggggggatatttcactcttctatgaatcaaataatatatggctttttcctattggaaaaaattagtcgtgtgaactttattcttcaagaaaaagtagtttttatctgccttggaaatgtcaaaaggattcacaagtttcacaagtgatgatctgggttgattgctaggaactgtttttagttagtttttttttttttttttttttttcagacggagtcttgctctgttgcccaggctggagtgcagtggcgcgatctcggttcactgcaacctccgcctcctgggttcatgccattctcctgcctcagcctcccgagcagctgggagtacaggtgcccgccaccacgcctggctaattttttgttttattttgttttgttttttttagtagagacggggtttcaccgtgttagccaaggatggttttgatatcctgatttcgtgattccacccaccttggcctcccaaagtgctgggattacagacatgagccgctgtgcccggctgctaggaactattaatccatagacaaggctctggttagagaagcagaaagaaggctgggtagaccggggaaggtagctgggaggtctctgaagcttggtcttgaagctgtgaattcatagacgtcttggaaaagaactttataatgtggttagacaagttttataagattttaggattaggaaggcttttttagggggtggggttgcttttaaactttgtttgaaaaatggagcttgctgccatcatatcatcatcaaaaatggaacttgtctatccacaaatatttatttaaaagtcagactaatggcagaatggaaagaatcccagctttggagttaaaatatctcacttaaaacttgtcttcgctgcaggctacttggttgtacttgagtaatttactcaagattctcttcagcccagtttccttatctgtaaaatccttccactgttgttaggaggataagaaagccagtattggtaaaaacatatatcagagtccttttgactgtttagaaagtgttaatttactccacgattatccattcaacatttattagttggcttctgtgtgggagagtaaccattaataccttgaataagtttataatctggtcattctgtagagcttcctatatgatgtcttctgtttaagtatttctgtaataccttatagacatctcttttagactactagtgattgttggtgtcaacatatgtgtgaaaatgcatatatcctttattaggctctagcacacagtgtgctctcaatgtttgtcttttcaaataaacatacttggccaggcctggaggttcatgcttgtaattccagcactttggggggccaaggcgggaggatcagttgagctcaggcgttcaagaccagcctgggcaacatggcaaaaccctgtctctacaaaaaataaaaaagttagccaggcatggtggtgtgtgcctgtagtcccagttactggggaggctgagatgggatgattggttgagcctgggaggtcgaggctgcagtgagcaatgatattgccactgcactccagactgcatgagaacgtaaaaccctgacttaaaacaaaaacaaaaagaaaacgtgctcattggctaagcctggtagaagccacatgaccaaggctgatcattgctgccactgggtggcagcatactgggattgaggaaaataacccctcaactgcccggatgataaacacagagttctaaaatggcaacaaagggagatccacccttctcagttattgtttgaaaggacagctctcaggcaaaatatgtccacgaagttccatggaataattaccttccttggtgttaaaaaatgccctcacatttcaaacatgtcctgctttaagttcccagcgtcttaaccaggaactcgcttatgtgtgttgttttctgcttctttccactagggagctattgctgtaaaacagaaggggtagtattacagggaggagatgcacattttaaaatatatttctgcttcgtcaaactgtacagaactcttttcctcaatgagaaccaggtttttgcatgtatcttttgccaagatttgagaagggaagtctccaccttccagagctttggtcatattttgtttctctctaagggtgaagatgctgtttgttcttgcagggtgaggctttggccaataagaaagcagtgctcagaggtaaagagcctcgctgaagccctagttctagcctaccaggatttggtcatttcttggtttttcatttgatcccacccttgcctcccttcagaatgaaggtagaatgtgggactgtttcagaccatgaatgcgattgggcagaaagactgtgaaccaagagggcagggagaagggaagggatgtggggagagctaagtgtaaattgtagagtctatgaacaattctggagacagacaggacaggtaaggagaaactgctgctcttggtagaggtttacagccaattgtagaaccctaagaaaatacagcactttgggagtggatggacccaaaatgggtggatcatttgagcccaggagtttgagaccagcctgggtaacatggcaaaaccttacctctcaaaaatttacaagcttagccaggcatggtggtgcccacttgtggtttcagctacctgggaggctaaagtgggaggatatcctgagcccaggaggtggagattgcagtgagccatgctcgtgccattgcatttcagcgtgggtgacagtgagaccctatctcaaaaaaaaaaaaaaaaagttcctaagaaaataaagcctggcccatgcaatttgaatgtaactgtctataatttctcttggttactgaaattctgagtttgtgtctatggtttctccatccttgtctttgaggaggagcaggatggcgaagtcgcagccatttaaaaacttgttttcagtcattttgcagaaagcagacgtacacttctttgctgttggtctgtgatgcgggagtggtttgtcagttctttcattcaacaagtgctgatctttgggcagcatacactggtatgacctttatcatttgttcaggtgttgtggagaaagttgtttgcttttgaaagacttgatggagaaaagtctttctacatttctagaaagaccatgggtgtgagtattgagagctgagtgccagtttgtttttttgtttttgttttcgttttttgagaaggggtctcactctgtcacccaggctggagtacattggtgcgatgaaggcttactgcagcctctacttcctgggctcaagtgatcctcccacctcagcttcctaagtagctgggagcacaggcaccagcaatgacacctgcctaattttgtattttctgtagagatggggttttggcatgtttcccaggctggttttaaactcttgagctcaagccatccacccgccttggcctcccaaattgctggaattataggcatgagccaccatgccctgcccaggcaccattcttgactgcgagaaagtcactgtgatggtttctccagcctgagttttctcctgtataaaatggaccttgttttgaggagagaatgaggtatgtggtactcgtgagcaggattttcaatgcctggctggttgttacttatccatttagtccgagcttcagggaaagaacatgacaccggcctccagcagagcctgctcttggtccactgtttatcctggtgaccttaggcaagtcatttaatttccttgagttttggtgtaagtattgatggagcagaccatcaataactgttcttatgtctgttattaccatgtgtctgtctacatgtttgtttgtaaattctctgtgggtaaaagttctcttttcatccccttgcctcagcacggagcccagagccagactgcaggtaggcactcaatagatatttgataaatggatgttagtcatttgatttctgaagttgcgtaggtaccagcactacaaccctatgtagttcacataactatttgcagttgtattttcctttaaatctaaattggagagaaggaaggtaattaaggcataattatcagacttaatcaagcacttatttattgagcttacttggtgcctgggcttgtatcttttgtttctgatttttagtttcgtttcattgctccagcgtgggggaatttgcctgtgtatccttgaataaatgtctttctttggaaggcagattaagtagggatttctcttactgtttatttttgtttctaactgaagttcaatgaattattcttttacccagacacttacatattcctagccattccttttgcttaagtttgcagagatttgtgcttaaaactgaataaacaatctcagggtttttgtgtgtgtgtgtatgtgtgtgtgcgtgttatatgaagtcttgctagaatgcataaacaaacaaaaaaaatatcatactctcagatcctggatactgtggtcgcctggacttcaaaagccttttgtccgtatgtatttacataatgtattctccatgtttggttttcattaaacccatgagtttaataataaagtgtttggaactatgcttttccctaccacttttctttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatctgcccgcctcggcctcccaaagtgctgggattacaggcgtgagccaccgcgcccggccccacttttcttgttgtgaatattttttccccttctgaagtgaatactgatttttcgttacagatatttgatgctttgggggcctgttaaaatagttgtaaatacactttctaaatagatgaaatgaaagaaattctgagaaggggtttctttgacttactggaaaaaaaaataataggaaagaaaatgtgatcagttggtatatttggctctctttcatcaacacttttatggacctgcattgctgtgtttctgtgatgtgtataaaacacagtttcagtgatcgtgcaagcctcagttttagaagataaaaagatatgaacttgaacccaagcttctctgtcaagagaattataatgtgttttgactgtaggcttccttcgagttaaatttacagtattttcccctaacaataacaacaaccagaagtgcccctttaagttgagatgcttgttaaactttacatgtatgcatgcatataaatgtacatttctgtatatataatatacgttcacatatagttacattagatttttaaagaatttcctttttgccttcaaatcattgcacagaacatccaagtagacatcatgtcaaaataatcaaaatgtatttaacgctctctcaagaaatccatttaagaataagaacacggtttgggggtgattttcagaccgtaaattgaagtgtaaatattcgaattattttcataaactcttcagttctgttgggcttttatgttatcatacagtgatttttttttttgtatttaagtttcctagcagttctcttttttaagagcctcaagtgtccaataaaaagcaaatacttgaattttcagtttctatatagtgcatattttttctcctgcttgccttatttttataacagtgatttataaagacattactaaagaataggaaagaaggattttgaagaggaactgctatataacactgcttaaaaatctatttccaatgctaaggagaggaaaaaaaaatactggcaccgtatccgagtgggatctgggatccgagtgagatggccataccttcagtcattctcctccccaaatatttattgagcctggtggacaaggagggcgggataagattgccaggccctgcttctatttctggggttgggatggcgactaaagacccgcgtggactgcatgctgcagccagctcaggaaagatttcaggaagagcgtttaggaaggcagctttgaaaagaaaatggaaagatgaggttgcagagggtcagtccaaggtgaccagaatctgacctggggcaatgccataaatccaagaaagactgggtttcaggtgcaggaaatgcgattgtgcacggacccttgcctttttacccagtatctagcccatccttctttcttagaagcagaattttctaagaggtacacggtagttcaggataaaaattccctgtgctaactgcccttgcagctagctctctgtgaccgtgtgaccatgtgacccagttctagcgaatggggtggcagggaagtcccacatggacttcttgggcgtgtccttaggggaagcatagcttcttgccttcttcacactcctccttcccttcctgccgtctgggatgtggggtctggcagagaaacaatattgtgaatggaaatgggaggaacttgggtcctgaaaattacaccataccccagagcctggggtggattatttcaggacctttcttccttccttccttccttccttccttccttccttccttccttcctttctctctttctttttttattttttttttcagacagggtctcctccacacccagactggagtgcagtggcacattcatggctcactgcagcctcaacctcctgggctcaggcgatcctcacaccttagcctcctgagtagctgggactacaggtgtgcaccaccacacccagctagctaatttttttttttttttttttttctgtagagacggggtttcaccatgttgcccaggctggtcttgaactcctagcctcaagtgatccgccagcctcagcctcccaaagtgctgggatcacaggcataggctgctgcaccaggcaaggacttttttttttttttttaaacaaacttcactcagtttgaaggcaccattatttgggtttcctgttaattgcagttaatcctattgagtaaatgtatcaaggacaaagagcagaatgaaaaaatgagtgagtaaagttgagcagaagaactcactgaaaagtcctggcaaggttccacggcacctgtgatgcttccatcacacatatttgctgagtacccgctgttcataggtcagtcgctatgcaaggcactgaggtgacaaagacaaggagaatgacagttaaatgtaacatgggctttgtggtcaattagttctgggttcgttcccaggtcctatcactaactagtacccttatgaacctggacatgtcactagcagcctcagtttcctcatccataagatggggatagcaatatctatctcctacacctgatgtgagtatcacatgagaaatgcacatgaaatgttttacttagtgatgagcatatggtaaataagaatttaatagattttagtgaaagcaaaataaaaggtcctatcattgtccttaaggagcttacgaaaacagagctatacgcacatccgtagacagttaccacactcaggaatagtggaaaactgacaagaccctggagatgctgtgtggggagggataatgggaacgcaggtcagcatgctctaggaatggtaagagaaactcccaatctgaacggtagtcaaagaaggtcttcttctctttggagactgaaaggctgagagggtacctgccctgctaaggaaatgaacaggacggaagaatgatggagggagaatgggaagtcctcagcacataaaagtttgagctggaaatgaaatatacaactctgcatagtcagcagattttgctgggctgggccagttcagctcagcaaggattgctgggcatgtgcttgaaggagaaaggtgaggatacaaaggcaatgagtacatgatccttgaccttgagaaacctatagtctaatagaggaggcacatataaaagtaattaggtaaaatatagtgcagaatatgcagtcatggagtcatctacagatctgcctggaatacagagggacaagtgtttagtattttccaactgttcacagaggacaagacacttgggcagaagtttgaaggcaattccaggttagcagtacccacttgatatggtttagctgtgtctccacccaagtctcatcttgaactttagctcccataatccccacgccacatgggagggatttgaatcgtgggaggtaattggatcatgggggtgggtctttcccatgctgttgttatgatagtgaataagtcccatgagatctgatggttttataaagggcagttcccctgcacaaactctcttgcctgctgccatttaagacatgtgtttgctccacattggccttctgccgtgattgtgagactttcccagccatgtggaactgtgagtccgttaaacctctttcctttataaattactcagtctcaggtatgtctttattagcagcatgagaacaaactaatacaccacttgaattgctggtacgtctgaggggcttgactcccagtccttcgaacatggaggggtagctctttttctaagctcctcataaagtattgtatccaattcttcagaagggatgaaggtatctggtcctgtccgcaaacagagaagtgcttcttgtactgaccaggcagtgacctaacgcagtccttgagacaattccaggtgcccctcaggccgtttttccaccctggtgtttttctttgtatagacagcctatgcctggataagaacatgctgcgtcagagagttctttttcactttgcccctcaaaatgtgcacaccgacagccacagatagatcccagatgtctttttcctgctcttgcaaaccttgaagtgggccctgccggcaggcacacctgccaaggaaaatgctgtcctcgaaatgttcctggcaccgttttcaagaggtgccgaccaagcgctggaattgctgacctccctgaaagagaagcctgcagctgcggcctctggggtgaattccccccatgggaggacctggtggagttaaaacagactatatccacatcacagagagctggcccattgctcagggcctgggaagtggtagggagggaccttcccagaagagagatgactcaggctggtcccaagcccctcctgtagaacaaacagacaaggtgaggagcaaggaggcatttggaggtcatctggcccagcacccttgtctggaagacagatttaagttccataaagtcacttaggaggagaacatagtccaggttgaaccttgctgcctgccctctggttgaaacatcagtgttgaatcaatagaccacgtcctgtccataccttgggaattagactcacccagactctgagttaagagtttctatgagacagagggctggactgggggagcaaggcttgcaaatcgaaagcatcagttgctacccctgagcaccatctcccataggagactctttgaacacttttttaaaaggcaagatgttggcctggcgtggtggctcacgcctgtaatcccagcactttggcaggccaaggcgggtggatcacctaaggtcaggagttcgagaccagcctgaccaacttggcaaaacccagtgtctactaaaaatacaaaaattagctgagcatggtgtcacatgcatgtagtcccagctactcaggaggctgaggcaggagaactgctcgaacccaggaggctgaggttatgttgagccaagattgtgccactgtactctggcctgggcaacagagggagactccgtctcaagaaacaaacaaacaaaaaaagtcaagatgttgacataacagttctgaagaccaaggtggtggaataggttaggttaggatacgtcggaggagccagtgtgaactgctcctttaagacatgaattagcccattttcatgctgctgataaagacatacccgagactgggcaatttacaaaagaaagaagtttattggacttacagttccatgtggctggggaggcctcacaattacgggggcagacaagagaggagagcttgtgtagggaaactcctgttttttaaaactatctgatctcgtgagacttattcactatcacgagaacagcatgggaaaatcctgcacccgtaattcaattacctcccaccagcttcctcccacgacatttgggaattgtgggagttacaagttgcaattcaacatgagatttgggtggggacacagctaaaccatatcaaaacataactatagctgggtgaagtggctcgcacctgtaatcccagtgctttgggaggccaaggtgggagaattacttgaggccaggagtttggggctagccgaggcaacacatagagacaccgtctctcaaaaaaatttaaagaaacttagccggggccgggcacggtggctcatgctggtaatcccagcactttcggaggcctaggtgggcagatcacaaggtcaggagatggagaccatcctggctaacgtggtgaaaccccgtctctactaaaaatagaaaaagaaattagcctgacatggtggcacatccctgtaatcccagctactcgggaggctgaggcaggagaatggcgtgaacccaggaggcggatcttgcagtgagccgagatcgcaccactgcactctagcctgggcgacagagcaagtctccgtctcaaaaaaaaaaaaaagaagaaacttagccaggtgtggtggtgcatacctgtagtcctagctacttggaaggctaaagcaggaggatcacttgagtccaggaggtcaaggctgcagtgaactgtgatcacgccactgcactgcagcctgggcaacagtgcgaaaccctgtatcaaaaaaaaaaaaaaaaaaaaaaagaaacacaacttaccaaaccaagaaacttacagagaacatgattagaagctagcatctgtttttaccctaccctcttcccctatgacccaccaccacgcaggccttgctaatgtggggtctttgtggaggatcttcaggatcttcagtgccagaacccagcatttaaactcttatttgacagtggggccacagcagatttaaaaggacaatgacatgataaaaaatgtgttcctgagagatttaaatgcaggcctatagagagcagatgttaaaagagaagaagcagactgggcatggtggctcgcatctataatcgcagcactttgggaggccaaggcgggtgcatcacttgagcccaggagtttgagaccagcctgagcaacatggtgaaaccccatctctacaaagaatacaaacattagacacttttcaaaagaagacatttatgcagccaacagacacatgaaaaaatgctcatcatcactggccctcagagacatgcaaatcaaaaccacaatgagataccatctcacaccagttagaatggtgatcattaaaaagtcaggaaaaaacaggtcctggagaggatgtagagaaataggaacacttttacactgttggtgggactgtaaaccagttcaaccattgtggaagacattgtggcgattcctcaaggatctagaactagaaataccatttgacccagccatcccattactgggtatatacccaaaggattatatatcatgctgctataaagacacatgcacatgtatgtttattgcggcactattcacaatagcaaagacttggaaccaactcagatgttcatcaatgatagactggattaagaaaatgtggcacatatacaccatggaatactacacagccataaaaaaaggatgagttcatgtctcttgtagggacatggatgaagctggaaaccatcattctcagcaaactatcacaaggacaaaaaaaccaaacactgcatgttctcactaataggtgggaattgaacaatgagaacacttggacacaggaaggggaacatcacacaccggggcctgtcgtgggctggggggaggggagaaggatagcattaggagatatatctaatgtaaatgacgagttaatgggtgcagcacaccgacatggcacatgtatacttatgtaacaaagctgcacattgtgcacatgtaccctagaacttaaagtataaaaaaaaaaattagctgggcgtgatggcacctgcctgtaccccagctacttgggaggctgaagtgggaggatcacttcagctcaggtggtagaggctgcagtgagctcacatcacaccactgcacttcggcctgggtgacagagtgagaccctgtctcaaaataaaataaaataaaataagcagcagcagcagcagctaggttccaaaaaaaaagttggaagggtgtgatgggattttagttgctggatgctgaagttctgccaacacagtgggtttggagagtaggagtgaaagagtggagactggccataagttgggagggtaagtaattggttgtgattgaaaggaaagaaggaggtaatgatgagttttggtctgggaaccggagaatggtggtccatggacagaaatagagaaggcaagatgagaagatgcaataggcaaaggcagtgagtttaatggttgacttttggtatttgctgtgtatgccctctgtacctttgacctgggccttcaacccttggacagagcttaagatggctgcgtcccaagtggtccatcccaagcgagttttccctggacttatctggaatgactctgaaccttttgaagaccccaaaactaacccaagctttgcatgatctccccaggatgggtaagacttcttactctctagagctcttttctctgtaggcttagctactcagtgaataaataggtacataagtgcttgctagcaagcagctgaggcaacctattaaaactcatgccagtggtaaagttaagctgctttctggtaagaatttcagaattccaggacgtctcaaatttctggctggtacaccctgggcaaggtccacaggctggatgggttttggaacatgtcttgattgtactttttcctcttggtttggaaagcaacgtaccctaggtaaggagagatttctgacaacagctcagcaatcacagtttccagaaaatggctccagtggatcaactatgagttaagtaaaaaaaaagtcagtgctaccgtttgaagtatgtctagagtatggttttaatccatcgctgtcaggctcacataaaattccaggcttctgtaactctttaacttgaagtattacagggtgtcacctgctaaatggaagccaagagaagcaaggagtttttcatggttaaatcttgtaaagatgctttttaaagcatattaatccattagtaatccatttggatttgggaatacggtcatatactgtttggtacaatatgtactaaacctggtcctggaaaattaagtggaaatataggtttaaactactggaacttcaaaatagcttctcagtaattccttctcagcaatcattccaattcctagatttaaaaaaatgttgatatatcaaatttccatcaagaggaacatacatatggatttttggagaggggagcagagcagaagagaaaactttcaacttttaatagtatttcaaatttacctgaaagtgacccaaataatacaagcaactgtttaccctgattctccaatacacctgcatctttaattatgctaatttgatacaggtgtcagattatgcattaacaaagacatcctttttctttgagtatgtgttttctatggttatgtaaattatggaggtgctaaacatacctttagagaactttgtatttgtattaacttttttttttttttttttttttttttaatagcgatggggtttcactgtgttgcccaggctggtctcaaactcctgagttcaagtgatctgccttgcttggcttcccaaagtgctgcgattacaggcatctgccaccgtgcccagctatagagctttatttatttatttatttatttatttatttatttatttatgagacaaggtctcactctgtctcccaggctggagtgtagtggcatgacctcggcttactgcaacctccgcctcctgggttgaagcgattctcctgcctcagcctcctgagtagctgggactacaggcacatgccaccatgcctggctaacttttgtttctttttaaatagaggtctgtttttactatgttggccaggctggtctggaactcctgaggtcaagcaatctacctgcttctctctcccaaagtgttgggattacaggtgtgtgccaccatgtgtggctatagaactttttaatgtgccaaggtctgtgttcagtgttttcttattcctcatctgacttagttctcaaagtccttgcctaaggtattgctgtcctcaccgtcctatggggagataggtcactttcccaagtctgggcagccagcagcagggctaagatcaccactcagaccctgtgattttatttttcatctcctcacatctggcgctgaatgtcaggaccttcctggcctctgggaaagacacaggatggctgttttgagaggagtgtgaaatacatgaaggcaggacttccacacacctggacgtgaactagaggtgaggtggggaaagacaggaagtagatcagtgttgcccagaccctaccttttccaactagggtgtggaccatccttcagagcttggcctccaagttggaacccgtgtataccactgacagtgtttcctgggatggtgatatttatcaagtgcagaggcccagacacagagagcttgaggacctttgtgtgagacagtgaaaccctcaaaggcaagggctctgtttcatgagttttctatctcctgctgctgtctcggtgggcctgtttgagttgacctgtcccgtcggtattagcaactggcaacagtgggtttttgttaaatacggcaaatattaagagtcgtctctgggcattttagtttattcattcatttgttcatttattccacagggatttattatgcatttactgtgtactaactaatggggagatagcaatgaaggcagactaagtgtctttgttctagtgcagccatatagtcagtgaatgaatgagtgagcaagatacaggagagaagtgaggtatggcccattataccagataaagtgatagagaggggctggcgaggagagcagtctaatttcaggaaagtcagaaaagtctttaaggaaactgaaggctgagctgccagggccagccacgtgggtactggagagtgggaggcccagtcagggggaatgctggcttagcacaactgaaaaatacaaaggtagaatatgaagtgtaatgacatggtttagattgaaatctgatgtggatggaaaggttttgtggcctttcagcccaaggtttgaaaaagaaatggaatttctaaatggagtgggtagccacaggagggctttagacaggacagtggccccgctggattttctgcccattgacttgggctcgaagtcacgtccatgttgctattacagatgcctcccagaacagtttatataatcatcaacgtatattcatggagcatcttctgtctgctagacacagaattgggtgttgggctttaaagatggatgaaaggcagtacctggtctagagaggctgctacctggatggtgtgtttgccatcctcagtaatgtgtgtcccttacagatgatgcccaatgactctacaattgctgggatactttttagaattttctttttgtgcattacttttgattcttggttctttctttggcattagctcaccagtggcaaatatgtatcctttaagggtggacttaattttttgagaaatggccaaaagtttgtttcaagtctagtctgatgaataaagcaggagatttatttttggcaaaagtggcaaataaagagggctgatttttgtatatggctactgaaatggcttagaatgccattttatcacatggtcaaattattcaatgatcaaatatcgaattattaaaaattatcaaaaggaagttccctgaaacatgaaagtgtttgggctttgtaggtacccaagtctactgggaaaaatccccatttctgggtaacccagccccttttaatgacaacttcagttctccaaattccacttccccttttagcctgcctcccttccgtcatccttcatcaaggtgacataggtctggcgatctttttggcatagacgtgtggacgttgtttttgacatttgtacatgcttttgctcaagttgaaggcccaagtttacccaattcgactgcccccacccagatagaatattcatggttagaccataaactacataactggaaattttaaatctatttttatatgcatacaaaaactgcaggcctgaagcttctaaaaataaacgttactttcatcccattatacaaaaatgcatttgaggtggtcatcattttatttgggccagggtcttccgagacttgggacaataatatattttttctactttaggcaaatgtatgcagattcttaaagcatgaatgctgtattacacacattataaattcgagtaacagaaatgtttgtgtgtagaaatagaatacggagtatatattttgtattaaataacctctgtggtatttgtttaccctgattttttgatttatgagtcgtcattgctcgctatagaagaagaaaaataaatatgcaaaacagtggtagatttttaatggggttacttcccatcttagctcagtgtttctctaccaaagctgaccttgaaattgctttttagatacaagtcaaaatatgcaaattccagaatcaggaggagtatccggtgttaggagttctttcgaagtcacatttttacatcatttccatcgacatcccgtgttccatctgcttcttaatccattagtacctgagtgggggtatataggttttctcaaatgctctaatctccacagaagttaaaatatccctaaacaggcatgtgcacatatgtctttctttcttttcttaggttaactttttttttttttttccttttgaatgaccacaaagcatatctacccagcggggttactttttttttccctttcagtattcatgacgtcaagtccctgtttgttatcttattgtcctcttatcctggtccttagagtctttcaagagaagaggttgatcccggtgtaatgtacagcttcattctaataagttgtatcgatcatgtattttcagtcactcttcatgtctatgctgtccatttgcttggatcccaaggaattttcttctgcccccccaccccatcccactcatatttcataagggtcttctggaacctgcatggtgttgggatgtatatatcacttttcccttgttatgaccagaaagactcacagccatgaatttcactgaagtttatgattggtccctgattgcctcacatcttgcaaagaatcctcttctagaaagcgttcttgcagttagattaacaagcagatatactgaactggtgcatgaatgaataggaaatatcccagttgcaaaggataaatctatcatgtagtggagagcgtgttcaggcaaaacatttggttctgcggtcgcttggaggattgggcccgtgctataattaatgccactagcagtaaaaggacattagggatgtcgcgcatgttgattatttcttcattttgtttatccaagtttccccgccttggaagctccgtggccattgccaaagaaagccctggagacagagcgttagccgttgctcctcgtaagcgcatcattaccttcctccgaacaaagtcctttttttttttttgtcagtagagggtgaaaacattattggattcaggagttcatagtagtcctgtatgaagctggggacggggggatagagttatgaaatggaccatttcaaatggcattatcttcccacagtgaggtacacctttcataaatcataggagagtgctcagaaaatagagcatttgttattcctgcagtacattgtatttgcatcccccctactcacaggaaagaagaaattctcaggtttcctttcccaggtttgaaaaggcagttaatcgccttacaatgaaattatatttttaaaaaaggtatcataatcaaataaaagaagtacttcatgtaagtcaaggattgtgcttttactactattttttctttttttgtaatcatggtggttctttttgcccacttatttaggccttaatttaattacggcgctgattaagttctttggttttattttttactgtaaacattgtgctgtattccgtaggaaaatgtagatgaatgtgggtcattgggaaataaagtgggtggaagtattggcgagcatttctttcccactctctacctcgcctggtctagccgctgataggtagttactctttagtatgcccaagttcaaattacgtatgactgtgattctaacacggaagcgccctccttttctagtagcttggatgtgattggtatggagaagcagagtgggtgcgtctttgtgtgttcttgacatagttaaagagtttggtatagtcaattccctttaaagtagtaggcttcttaaataattctagttgttcctcgtgctgccaagccatcttgaagaatttttcttcatttgtaaggggttaaaagtcatcaagctgattgaaaagtcaagaacctctagcgcagcctaccccttgcatatttgatactctcttttgcactctcgggagcagttttgaggacacactgtaaaaatgtatgacagcagtttgaagataagtctgttgccccaaataatcataagaagaagacagaagaaaaattgattcccgtagctctctgggcagtgggatgggggtaaagcaaggaattaataaaaacccaccagaatacattatttcagacaatcaaggagagcgttacattttaaaggtacttcatctcagaaagtttgagacatacttttcacacgtggcatgaagagaaaatggaatggaatgagcactaatgaggaccttgaacttaactaactgaacttgatggtcatcgcaagacataggggagaaatattttgagacatcattgtgcaggcaaacatgagcaagaaattgagaaatccgttcatgcacttctctctggtttcccggaagggatgaattccaaatcccgtggctcaggtcctaggtcaaagacagctctttagaaagagatgttctttgcttctttgctgactgcccatcccctcctctctctcaaggaaataagatattcatttgcaagtaaataatgcagcagtcttggatttgtatcagatcaactttgaatgaaagcctgcctttctgcgtttatttttgcttatctctcctgcttctgcttcctgttttgttaaataagggcaatgacggcaactattttaaattgctataaagttttagctagacagcgaatcaaggtggcaacacatggtgggttcttaaataatagttgtcatttgagtgctttctatatgatgtacatttcattttgcactttacaaataacctcttcctttttctgtttaatcttaaaaaagatcccgggaggcaggcgttattgtgcccatttcctggataaggagaatgaggtacgctaaacgagtaaaaagcaacccgagatccaaaccctttggcattcaagattacactcttattcactaactgttcatctcctccgactgcatcgccactcccccaggccagataacccatccagacctggagaactcctagagggagaaacagggaggacccaggcacataaacttgcagagcagctgagttatcagatcttccaagccatggggttatcgagctttatcagagcagccttgctcttgcagtttctgacacatcaccattgatcagtcctgggaaacaaacaaaatagagggcgatggctccactctgtgtggccccgtcaatggcctggacgcagctgaaaaaatccagaagagtgtaggacactggaaaagtagcagggtgtgcgattgcagggatgggaccagcagtaaaaggtagccctgccaagaccattaagcttcctgcaactccttctggatcccacaatttgaaggggaaatctttcccaccgcacatcactgtttggtggactaaatggctccccgatgtcccgaaagagcacagcttctggaagtgtggtatgtggtccctgagatgaagcagcagccacaggaacccatcattcctgctacccaaggcctccattgcctggttttctgttgtcagaagagttcattttcaggtccttcaccagatattttagaagctcatcaaggaaaggacgtttgaagaaaaacaaataaacaaaaacacaaaatcaaggacgtattgatttctgagaattcctcctgggttttgtttgtttgtttgtttgggggttttttgctgtggtattgtctgagcctatgataagattgttgttgattgatttttgtctttcaagactcagcacaacacatcccatccttctggataatctcttctaccctccctttccagataaaagttgactctcataattgtaactctcccctactttatcagcatctacatctttcagcctctaccacattgaattggaattatatgtctgttttatgtaccatgctgtgaactccttgaagataggagctgtcttatcttcaaggtgctcaagacacgtttgttgcatcagttgaatggagtcaaattataaacaggtgatgggggcaaatatcacaatatgatactctgaacatcttctctgacaaaaactggtcctcaagatacaacaacatttatatttgatttgtcttgctgtatcgaatcaagctgtggtcttgagtttcgtacacatctatgtaagcactctgaattgagtgactctttcccaaagatcatactgggatctttggaatgaatggcgggtcacccatccaattgcttttgcggagattcgagcatgtggggaatgcaagtcacaatatcctgcaaaagccaacttgagacctcctaggactgcactgctgcttatgacactgatccttagcccatctaagtaagtgagcatggccctgtaagtgaaattggagaggttccttgacattcccacatagctgcttccctggtaattcacctgggtccagaacacagaagggagattctaattgaaaaacttttcctaaaggccaggcacagtggctcacacctgtaatcccagcactttcagaggccgaggcagggagatcacttgagatcaggagttcaagaccagcctgagcaacatggtgaaaccccatctctacaaaaaatatagaacattagctgggcatggtggcgtacacctgtagtcgcaggtacttgggaggctgaggtaaggggattgctggagcctgggatatcaaggctacagtgagccgagaccgcacctctggagtccaccctgggtgacagagtgacaccctgtgtcaaaaaaagaaaaagaaaaagaaagaaaaagctttgcctgtatatgtagaacaaatgaaaaccaaataacagtggcaccagttcttctttcagtttccatggaatatcaagcacgatttgagttgagcaatttgatttgattgatcttcttaaatgtataatctcaaactttacaataagaaggctacttgtctttataattgtgaaatccacccttagttttaatgcatctaaagtctctgtatcaaaaagatcaaaatcaggtttgaaagtctgtactgtaactaaaaaagttttggggtttgttttgttttgaccaatttttgtaaatctcttctgttactgtttatatacccggccacttctgccaaaatatgctggccttttagtcttttggttttttctctcttttggtttgttggcttatgttcgctgcttgatctgactactggttttatttctaaggatttttttttaagttggcatctttttttctttgactttccttgtatgcccccctttctcccctgcattgtcttgcttcattcatttctttccaggttcctgcaaattgtttttatttagggctcatctggtatgtgtattatgttcttggtagacagaagctgtctttagttcgtatgggttgagcatggagggaacttcatctcgtagtcactggataaggagccagtcctggctcttcctttaactgcccttgtgaccttgaacatgtcagttcatctcaccacgtagtcattttctcatccgtctcttcaggctaataatcacctgtcctgccttcctcacaggcttgccgggcaacccaaaagagccgctgatctgcatagcacttcgcaatgaagctgtgctctagaaacataccacgatctactggactttcttaaataaggtggttgttcaggaaattcctccagttaattttactttaattccccctacaagaatgccgagacacctctgcctattttctctttctgtgtttgttgtttcttttgtttttgttttcgagactgagtcttgctctgtcgcccaggatggagtacagcagtgcaatctcggctcactgcagcctccaactcccggctccagtgattctcctgtctcagtctcccaagtagctgggattacagggatgcgccaccatgcccagctaattttttgtatttttagtagagacggggtttcaccatgttggccaggctggtcttgaactcctgacctgagttgatctgctcacgtcggcctcccagagtgctaggattaaaggtgtgagccaccgtgcctggcctctttctgtttcaaagaaatagtcaagaagtttctagatgcacacaaaatgaccaaaccagtctttccgcttatttacacaatgaagaaacatcagagttcaccctggaagacagagtttctttctgtcttcatcctagggcacaggagagatgcagtgatggcatgtctccactctgcagacatgttgcaggcctggaaaactgtgtggtgcgtctgtttttcagagcgttgagagtcatgcgggccatatggatgcagtggtccacagaattggcagtgagcccccgggggagctcagtgcaagacaagattctggcgtaagaactgcggtagcaaggacaagagggcgtcacggtgtaagaatggccgtggcaaggacaagaggacatcacacgatgaccttctcagagtcagtaggatagtttcccttcctggaagattgagatgaaataaagctttaggagttggtatcgcacgcaggcattaaatggattgtgaagagggactttgttccccctcagtcttgtctctgcctccgtaaaggagtaagttaaaaaagaaagtttctttttttaaaaaaaagccttactgctcaataaatccctgtggaaaaaaaaaaaagagggggaaaaaggaatgcacattagtcttccattaaaaatagatcaaaaaagtacccaaaagagaaaaccccataacaatgaaataaattaggataatccaactggaggcctgcaaatgagtttgctaaatgttatattttctcaagccacttagatttttaactccctgtttctgcctgaagcaataaaggcaggaacgctgtcattagcttcaaacaccattttttaagcccctagctgcatttgttatttttctcttcccccccttagctgtatccctgcatttattacagcgcaggtgcatcttgcttttgagtgctaactgagatgaaaggagtgaggaaacgctctcttcttcttgcaggggagggctggcaaattcagtgaatgcagagtcggctgggagcctttcggctggaaagctcttcctctgatgagctgtctgttacagattttcagggatggcccttgataaggcaggggtgtctgtccacgccacactgtggtcagataacccccgatcgtaataagccggaggataatcgcttgcattgttcaataaagcaattgctttgtcccctcacttagccccttcagaaaagccaaaaagaatgtgccacctagatgctatttataaccattttcacctcttgcctccaggggctaaattggaaacctaattttagatgcataaaagccaaaatatgtataggagaagctccaaaataaaatatcccagagtggcttgtaagcatccttccaacaggttcaggttgatttaccttgctgtggatatttaattatgtcattgaaaaaaacaccagtaattaaatcattatttcttagatgtgaggtccaaggacattctagaggaagtcaaaggcagagggaggaagggtgggacgatggaggcctgaagggctggtggagaggaaagaaggcagcctgtgccgtcagagagagttcaactccatccgtgcagctgctagcatcttgccttactcagcctctgtgaaccttaagttgctcagaatgagacaggtaacacctgcctccgtggtttgtcaggacatttagaaatgcagacttgctcaagacctggatctcaggtggtaggttggtccacagacagtggcaccactagctattatttatttgttgtcactgtttgggacccctgttgctgtctcaccaaagaacttcttgtctcccttttagaagtttccagagcgtcttcctgatgttgcatagagcactcacacctaacagatctcagaacttgtatcttttctgggtggctagactgaaaaatccattttcttgtgagtgagccagaggtctgtctcttgcggcatttctgcttttgagaacctcccgtttcctgaaaggcaccagaccccaagacagctctgctgcctgattggtaggtgcccatgacagctctgcttcatgcctgctgcctcctcatccctctggatgccttgtggtcctgcttgtctgaagagcataaacttgggggttcccactcgaaaagaggttccagcagttccagcccctatgtcaggggagccacttttggggctggtggtaggcagaactttggccctcgacatctcctctgttggcattactcctatggtggtgttacgtaacatgacaaaagggaccttgcagatgtaattaaggtaactaatcagctgactttagaataggaaggttatcctgggtgattagcatggatcagagttctcacaggagcccttcaaagcagaaggggaaggtggacaagagaatcggagagatgtggcagagggtaggcagagagattgcaagcagggaaggatttcacgtactgccactggctttgaagatggagggggcacatggctagaaatatgggcggccctcagaagctaagaactagctctttctgacagccagaaggaaatagggaccttccacctacaatagcatggaaaacggggacctcagttctgcaactgcatggagctgaattctgccaataacctgaataggtttggcagcagattctttcctggagcctccaaagaagagcccaggctggctgacaccttgtgagtggccttgtgagacctgaaacaggaaacccacctgagccactctttgcctgggacttccaacccacagcaactgtgccgtcgtgactagatacgtttttttaaggggatgataatttgctgtggcagcaatagaaaatctgatacactgtcatggggccttccacagggtggggctcaaccagccctcagctcatctagcatgtttcctcctacaacctggactttttcctgttgtcccctcccgtgacactcagctccctgcattcaatagaattgcttttgtgggatgatgagtgtgttcagagtcatactcagcctaattattgcttttgaccaaccccaacacataatgctgtatgtcatgctgtactacttttaatttcacagatgaacacatttctgttcttttaatccacctctccaaggctcgtgttaactccatctggacaaagccttgaggtatacgtgtggcttcttttgagcatcgtgccatagctgtccctgatctaccttgcggggcaaacacaacaagtaaaaggttttcctcttgaaggattgaacgcctcaatgcgtgcatcctacattgtctagtgggagaaatctccgttgtagattctgacatgtcactccacatctttgtaactttttatggctctcagccctactttcttaatagtagcagcagtatttatctactgtttattgtattccaggtaaaggatatgtgaagcacttttcatgcattatttaacctagctataatactcccatttgacagatgagaggactgaggcttgtagactttccaaggctgtgcagctctaggtctagtctgccatttgaatttgggcgatgataccagagaccaagttctcaactatgatatactgcacatgtttttgtttttgtattttggttcaaaaagagagtatgatctcacttttcccttcttgataggttgtagattccatgtctaatccatccttttccaatattccctcctaatctttcagttgaattacggtctttagctcaaatgcatgacatgatgtgtgtgcctttggagtggggcggtattagtcagtcgatggttatttccttgaggagaaaggaaaggagaagttgagtacttttcagtgtttgttactacaaaagcatggtggcatgccattgttctgagaggaaggggcttttttgccttgtcagctcctgatgaaaaagatgttgggttggaaagctaagttacagcaggtgaacttgaatttgaggaaagacaaagcaaaccctggctattaaaggaacacacacacacacatacacacacacacacacacacacacacacacacgtttctggtattaggaaatggagatttctaacataataaaaaagattgaacttaaaaatgacttccattaaatagggtaagaattttgaggtggaatcctttttccttgggtcagtactttctgcaagcttctaagtaatggtttctcttagacactcacggtgataaaattgggagttttcaaatgaaatctggaatgatctactggcatcatgcctaggactttggaaaacttgaaggttggcacctttggggaaaaccagacttttgaagcaggggctctgattgtctcttcttattatagtgcaaggtgtttggcagaggtgtggtagctgaaggcccaaggataacattgtccagattttcagtctttggagccataaacatccggttctttccagccccgctcaaccgcctctcttaattcaccaccctgttagcttcatctcaggccagacattgtaggtggcagcaattgtaggacaatgagaagaggccagatgaggacagaatttttattttccattgccagtaacaaacacagccctaacttgcttagaccaaagatggggattgattggcaactgggaagcctaagggtggatctggcgtggctggatctaagtgattaaatggcgcggtcataattctatttctctgcatctctcagctgtacttccatctctgtaaacttcatttgcagacatggccagcatgcgcccatagccttaatgctcagggaatattggtgggagagaaagctcctttcctatagcttcaagcaagagtcccacggctgactctcattggccctcagtgggtcacatgtaaatcattgagccaatcaccgtctttctgtctggacctggaataaagaccaccttagagcatgggagcgggatccccttgatccacaccatatagactgtgaggtatgaagtacctcacagtaaagaagtcatgttattgctggaaaaggggacatgggtattaaaaagacaaaaacaacagggcttcatcacagcagctatactgctccatcaatacccatcccaggagacagtggcagtcttgatgtcaatcttgttttaggatcattgccagtggaattcaggactgcggttctacccagtaccggggaaccaggtgagggggttaagaggcctgggcccatggaaggggtgagagagagccacatacttacagttgtgaagggggccagccaggatggtggcttgcaggaaaggtctgagcagagtaagaggcagttcctggcaccagcatgccaaaggcagatagcaacactcttcaatggatgtgggtgagaggacagtggaatccagcaggggccattgtttccttccataatatttttaaactgtagcaaagtgatctttttgagacccaaatgtgagtatgccattctaatcttcccaccctcagataaaccacagcaatgattttatactgtctgtagggtaaagacagacccctaatcataacctacaatccctcgacccagtgacctagcccccgtgtaccttccctgtctcatttctcactgttatcattgtaaccctctaccctctcttttggcttcctgcagttgccctcctgcagcagggcttttgcacatgctggtttctcccttactttgcctctactcagtctttatatttcaactcagtggtcactgtctctaggaagccttccatgactgcattaaatccttctataagttttcatagttctgtgcatttcctcttggcagcaatgcactgagctgcagttttacatttttgtttttttgttttttgagtttttttttttttttgagacaaaagtctcgctctgtcccccacgctggagtacagtggcacgatcttagctcactgcaacctccacctcccaggttcaggcgattctcctgcctctgcctcctgagtagctgggattacaggcatgtaccagcacacctggctaatttttgtatttttagtagagacggggtttctgccatgttggccagcctggtcttgaactcttggcctcaagtgatctgtccacctctgcttcccaaagtgctgggtttacaggtatgagccaccacacctggcctgtttttgtgtttgtttattaattcctatttttcccacctgacagtacgctccgtagggcatgtgtttgtttcggttccccaacgtatccctactgcccagcagaaggcttagctgttaacaagtgtttattgaatgagtaagtgaatgagtacgtgaataaatctgcgctttagaggcacttgctcaggcttgtggaataattctacagagagaaacaggaatcaaagggaaacctgaagctggctcagaagatggatgggccagcaaaggcttcagcaaaaccacacaatgctcatgaaaaatcacgcatttctctgatttgtggttattgcttccctggattttttttttttccagttgttgttgttcatggtggtggtggacaatctgaccatataccaaccaaattgactgttaaattcaatcatcagtgaccactcctgataatctgacctcctaagttagagcccctgggaagttcagccgtggttctgaccaggcaggataactatctaagtgttcccctttggacctagactgagccaaagattctccttggtctatataggataatagatttctaaaacaaaccaatagctcaggcacaattatagtggggggtggggggcatgtttaacctactttagagaacaaactctttttaagggctttgcacactaattgtatgcaaatggatgctgctaattgcaaacacaaaattcaaacctagtcaaatttgaaacctgttcatcaacagtccctttaggacctctgccccactctatgtatgcagtttaaattgctgatttatggctacataatgtcttcctaacccccagtttactgttggcttccttcagagtcattgccccaggggactcattgacggcagagagtgtgtcccctccactgttgcctcaatgcccagctcagcccagtgggtaccgtacttcaaaacctcttattgaggtccacctctgtgccaagcatttcggtaggcagtgacagaagagagtgcatgcatgaatggataaactctttcctggaatgcctgctctcatcacctggtttcaaagtcgagccagacgttctgtctcagctcagattctacctaccctgaggttcgcagctgggcatgatcgagccactctccactctcctgtagcatttttgggctttgagtttatttgacacttttcacttgctgccttatattgcgtttatttttattaattacttcagtagtcatttacaaaatgctgctgaatccaagtccctgtgcaagatgctgcaggagacaaaaagatgaacaacacgtggtctttgctttcataggttatttctcctcttccatagcaacacatgtcaaggcaaggaccatatcttattcagttcctagtcatcttttctttcttttgctttttcttttttaaattgttaagatctgccataaaaatgtctgtcagagtaggcatgattgcatattctttagatggatgggtggatggatggatggatggttggatggttgggtggatgtatggttggatgattggatggatgatggttgagtgagtgggtggatggataggtggaaggatgaatggatgcatggctgagtggatagaaggtggatggatggagggatggatggttggatggttggataattggatggatgcatggatgtttgggtggatgaacagatgaatggatgcatggatgaatgagtagttggatggatggataaatgatgcatggatagatgaatggtgaaacttttatattttactaaaaatctgcattgatagcctagtggcttgctaaaaataagggagctgcccaaatgccccatttcctttatatacttgtggagcagcagcgaaggccaagccagtgccaggggctggaaacagacacataaataagaacaaataagatacagacctgacctcaatgattttttgatatagaagcataggcacataaataaattcctgtaatgggagtctagggtgaggggtggtgggtgccataataaaaattatataaagtgctatggggaagcaaagctacatgaccaatttgttctatttatttatttgttattattatgttttttgagacagagtctcgttctgtcactcaggctggagtgcggtggcatgattgtagctcactccagtcttgagctcctggactcaagagatcctcctgcctcagtttcctgagtagctgagaccacaggcacgggacaccatgccagtctaatttttaaattttttgtagggacagggcctcactgtgttgcccaggcttatctcaaactcctggcttcaagtgatccttctgcattgtcccccacaaagtattgggaatgtattctttcctgatcaggaaactccgcagagagaaagtgacagttgaagactatattgaattttggcccacaggaaaaggaaactttgctgttagggtcacctggaggagagactgcaggggtcagagatcagggccatatgctagagctgcaatgtgggtgctcaaatgatgttcagtgcatcttcacagatggacctccacatgtccctcatgccctaaaatagatattctccacagctgcacatacaacaacgtcagtgaaatccgttgagaggagcattgaggagatgagtcaggtgtgccgcagcactcaggtcagacttgaggcaagtgagaggtgtgagttattcagagtcccagagagcttgggccaaaagagattctatttttactggagcatgtgagggtggatcacaactaggatggcgcgaagttcacctcgtgtaagcacaccaggctgcagggataataactgcactttttaaaaccagcaaatcattcatatttactttatgaaacctcttttaactttattttttatattttttttattttcttgtttctttttatttttaaaatttatttttgttttttttgttttgagacagggtcttgctctattgcccaggctggatggagtgcagtggcccaatcatggcagcctcagcctcctaaactcaagcagttctcctgcctcagcctcccgagtagctgggactacggttgtacatcaccacctctggctaatttattttttgtaaagatgaggtctcactatgtttcccaggctggtctctaattcctggcctcaagcgatctcccatcccccctcagcctcccaaagtgctgagattacatgcatgagccaccatgcctggcctctggccttcttttcactttagaaaaaaacaaaaaacaaaaaacaaaaaaaaacacaaaaaaaacttttttttttagaactgttttagttggggagccaaaattgagcagaaagtacagagagttcccgtatacctccggcagagccctggctcactatctacatccccactagatccatgtatttgtttaggttttgggggtttgttgttgttttgagatggagtcttgctctgtcacccaggctggagtgcagtggcaccacctcagctcactgtagccttgacctcgagggctcaagcaattctgctgcctcagcctcctgagtagctgggattataggcacatgccaccatacccagctcatttttttttaatatatatttttagtgaaggcggagtttcaccatgttggccaggctggtctctaactcctgacctcaagtgatccgcccatctcggcctccccaagtgctgggattacaggcatgagccaccactctaggcctgtatttgttttaattgattaatctacaatgacacatcatcatcacctaaagtctataggttcattaggttcacagttggtgatatatattctgtgggttttcacagacatggaatgacatgtatctatcatacatcatatattgtatcatatcatatcatgtcatatcatatcatatcataccgaataatttcattgccctaaaatacctctgttttcactttttaatctctttgtgcacacatcaaaaattccttttgtgtttttgagtttcaaaagtgtgccacaaacaagaaatttgggatctgctgagcccagcctcagacctgtaggggaaacaaagagggcaacaggaggtcacgaaggcatgctgtgcccacttttggaaattgtgaaggagagtgtctcaaacatgtaggcttgagccactcaaaattctgggaaataggatgttttgtaaagaaagtttgctactgtcacttctgagtagttgcagtccctcccagtacgtgggtatcttcggtgagaacaaatttcctggcagcttgaggactccgtgtgttattcacatgctttatttaatagacttgcctcatgtgactttctatatcatcctttgtgtctaagtgatttgcactgggaagatagtaaacgctcccactttatatgcagaaggttgaaaacaccatgagtgttgcaatctgaggtatctgcccttaaagaagcaatatttactgaaatgcagggcacacgacttttccagcaaaccacaccgccgtccttttgtgtgacgaaataattattttgagataccgacatgcgtgacgaccagataattatctgagaaaacttagcatctaatgatgctgttttgagatcacaagaaagaattatattagcttgagctgaattgttcttttccccctgtctctctttagttgtaaaaacacccacaaatgtgaatgcttcaggcctgaacttgtcaacagccagtggctcattgtagacatagggatgtcgcctgtgtttggggctgagacaccagaacaggtgttctgtgggaactgagaatgtctactgctgcacacctttaatctcgggtcttctttctggtgaaatacccgtgattcataactcagtcacgttactgaggtatgtctcttcggatagattctatctctaaaaactacagattctatctctaaaaacttaagtcaagggattttcaagcagttgtttgatttatgtatgtgaacctctccgttaggagaagaacttttctttggcaaacaccataggaacggagaccttaacaaaagaattaggactctcttgtcctgttttaatctcaaagctgtccctgcgctggtgcggctggcccacttgtgcctttgtgaatttgcagagaagaggctgggcgtggggggacacatgactaatccgccctttcttttgtttgtgcaacaactcaattcactgtcaccacatcagcacatttgctgcaaatctcagtgccctctcactttcgttttatttaatgcgtttctacattttcccaaggccacatgagctgttttctggcgcgtggtatgcctgcctcaaataactaacattgcctgggtcttggaatctgagccttcatattctccgatatattatttggtcctattgttccttaacttgctcatcattcacacggcgaaggaaattccatttggtccttttaagaccgccagactagctgacttaaacactcagctccagctacttctgaatatttcggttctttattgaaatggtccttttaatgtcatctttaatttaatcaaatagtgtcatcaaaataacatttactctattactgaaaattcactgcattattaactagtgtaactagacaaaaaagatggtacaaacccccatggaaatatatacttactgtaaaaatggatagagttcatggatgttctatatttaatttgcactttcaaagtactctctatggagaggttttatggttctgaaataatttaaaaacacactttactacaatccatagcaggtagttttgccaatttgggaagttatggtgccttgcagtttccaaagtaagctgaacagtgttttttaacagtgctgcccctctctcccactagaaatgcgagtccatccttttaccaagtgtggtacaacaaaggtttctctggttttcttttggtattctcagacaactgaaatataaattacatggtatgtgcaggtatcaccaggatgcaattagtttgatgaaatataccaagtcgtcaatgccactttggatagtttaatctgaaaataggacatggttggggtagtgggcacaggggaaggaaggttatgtaattttaaaattcttcctttgattcaaaagaaaaaaacatgtttgttgcattcaactccatagggtgagcatagcttagtggggagagatttggactaaaaaataagagttctgggttcaagatctgaggtaaattatttgctaggccttagtttcccatctgtgaaaaaagggagttctataacagcaagacatttaatattaaaataatgtaatgtttttaaaaatgcttgtctacccactttttcttgagattagtaagaccatcttccaattagaatgtttatccgaacttaccgctaggtatttccttgtagagtatgaaagtaaaatatcaatgggccatctctacgtcaaggttctcgttcttctcattactgagaaattatgttcctggaataatattgtacagacttagaaataagggcattgaacttaattcatttatttttcaaaaggcatgtattttttacctgttgctatatctgctgccagccaagtgctgtgcttggccctgagaaagcaaagagagatagagatgtccatgttttggaacttgacgtccattaggggacataaacatttgaaaagataacactaacaagctaattcaggtatgataataaaaaccttcacagggttagccatccatctatctgtccatccatctattcactcatgcattcatccacctgttcatccattcatctgtccattcatccatctatccatccatctacttctaggttgtgagaacccgtagtattgactctcagtgtgataggaaggccagtgtcttggtgaaagatcaaagagctcatcaaaatttgtcggatagactgcaggctcagacactgatgagacccccctgcaactaccacatcaaaaggcctaggagcctttccatgaccaaatgcccatattgatgaatccgagacaagtgagggaaagatgtcctctgtcggtgttctgaaccctgtggaaatcatacggggaactataaaagatcctgatgcctggttttcttctggagagtctgatttaattggataaggatacagcctgggcatcaagagtttctagatgacctaagtaattctcatttgcaaccaaggttgagaataaagggtgtgtataaggtgagagacttctggttaactaaaggaaataccaatgacatttgtgctttaggtctaccagttagtgggtattggtgcatggtgggacagactaaatggctacaggtcagggtcattgtcaaagagtgagggataaggggttgtgctgtggctcagaggcagagtagactgaggaagaacagctaattccagaaagccatgttgtggtgtaaaagatagtacctgacttgtaatgtctgacaccaaaaatgaccttaatttgggtcataggacaaagacctccccacctccagctatgaaagacagaaaatgataggactaggcttcatattttctagcgtaacgtttggcttgtggtatattcaaaactaagtccgtgtttgttgctgctgagtgactgggctgatactacctgtccttcagccatctagacttgctctctaccatcctcaatacttcatatgaaaggagactgtcacttcatgaaaatcatttatttgctttagcttaaatctactggagattacaactgcctcattttgtcaccttcttaccccagaaggaaatatctccacaagagagcaggtatttattgagttatgactgtcaggcatggaacagatccattggtcagaaataaggaaattgtctctaccttcaaggttctcacagtctggagggaacagagagccatcagggacaataggtccctgtgccatcagctactgggatgtatgactttccagtagaggtacacagcacttgttccaaaaggagcctatgtagctttgggagttctctatttagtcaccttattttttttgtcttcttgttaaactagcatcctgttttactgaatctctgcctcagttgctttatttactgtatacatacatagctcttttgaagacttgatgtcaaaagtaaagaagttcagaacctacggggcttgctttgggtcccaaattatcttagctttctggaaagagaagaatctataatgtattctccatggagtatctttactcacttgtgatgagatgtctgtaaaagtaatcagctccatacatctgggcatgatgaccctcaggcccttgagactcaggtgttctcagctcatggtgcaagttcccctgaaagaaagactcaagccaagcattcaatggttatgttccagatcatagtctcctaaaagccaggggtcctttatgcagggatggtgacatcagaagttaaaaggtctatgcagattaacgaggaaaaatgagggaaattactgtaaggtttttaaaacatgatagttatatatgaactgatgattatataattgaacatgcctaaattgatgtagttctctgtaaaactagttggtgtaaggaaacttggtctttgaccatcaaggaggttgcagtttgtggcatggcacaaagataacactcagcagatatatagctatgggatacatggatggatggatggatgggtggatggatggatggatggatggataggtagatggatggatgcgtgggtgtgtggaatggtgggtggtaggtgggtacatagatggatgtatggatgggtgggttggtgggtgcatggatgggtgagtaaggggggataaatgaaaggcttgttcttctgaagggactctttacaaagagtctttgatcttccagcttcacgtgcaagagaatccccaaggtgagcttgttaaaataagcatattctgggtatcacttcctgattttctggttcagtaagtctgaggaggaacttggggaactttatcttttaaacaagtacctcaggttatcatagtagtcttgctgtcctgaatcttaatgcatctctatttctgctacatcttccatgaagttgattttgcagaaatcattctgtggttccacattgactgcatccaagacctattgccttcagatttacatcaagcacaatttggcaggtattagggatggacccagcagccaagtctttgttgccttaaacagatcccttgtctcttgtcaggacctccttccaggctgctcctgagcaagtctggatgtgacttctacctatgatccagtgggttgggccataaaggagctttggaaagggacagtcttagggtgaaaaagagggagaggcttgccatctgaacaggaatctctcccagaggagagaagagaagcctaggctttaatgaggacagccaccctgtggatgactttctgtgtgatgttatgtggaggtggcttcttttttctctatcccattagctgaattctgtgccagaaggaagagatttggagtcagcaaggcatccttttttttttttttttttttttttaaaaaaaaaaaaaaagaaggaatgtgattgtgaaggaagcaagaaaaggcccaaaggctctggacaagggctaggaggctgaggagttttacacattcataatttccttgtaggccaagcttactctcagggatgacagtcattttctaagaaagtgagattgcttcacattgcatttaaaggcttaaataatgtattctgtcagacaattctctgaaatggttttccaagtgaatgcatcagaaagtgcccagaaagaatgcctggcacaggaagaggagggcattcagaaaatgtgagctgcttgcatcagaatctaacttgagatgtatcattcctacggtaaggtgcacacacattaaatgtacagttcaatgaactcatacttatttatacaactgtgtaaacaccactcagatcaagacagagaacatttctaacacctcagaaggctcatctgttcccctttctaagcaagaagtaccatcagcattaagaggtaaccactattctgatttctatcagcatagttttctgttcctgaattcatataaatagtcacccagtacgcattctttgctgtcttgcttcttttactcctcattaggttgtgggatttgcccacgatatttcattctttattgtcattcttctttctctgccactgccatcctaccaacagtttgtattatgaaaaattgcagacgtacacaaaagttgaaagaattgtactgtaagtactctgatatgcaccacctagattctacaattaacatttccctctatttgcatctctatccatttaccattcctcttgtctatccatcagtctatcttgattcatttcaaaataagttgtaggtcaggtgcagtggctcacacctgtaataccagcattttgagaggcagaggtgagaggattccttgagtccgggagttgaagaccagtctgggcaacatagtgaggccttatctcttcaaaaataaaaaaaattagctgcccatggtggtgtatgcctgtggtcccagctacttgggcagctgaggcaggagaattgctggagtacaggagattgaagctgcagtgaactgtgactacactgctgcactcaacttgggcgacagagtaataccccgtctcagaaacaaaaacaaataaacaaacaaaaagctaaataagttgcagacagcagtcgcttcactcctaaacacttaagcaggtgtgtcatccttgaattactgaattagagttcagtatttgcttatgctagttatgttagtggtatgctttttaaaaataattaaggtgatgtcatgataaggctattaagagccaacatgcattgagtatggactttctgccagacattgcactatgcacttaacacacagacacatattgttttttccattttaagatacagaaagtgggccttaaaggtgctactgacttgctgatatgctttggctgtgtccccacccaaatcttaacttgaatcgtatctcccagaattcccacgtgttgtgggagggacccagggagaggtaattgaatcatgggggctggtgtttcccatgttattcttatgaaagtgaataagtttcataagatccaatgaatttatcaggggtttctgcagtttttctcttgccaccaccatgtaagaagtgcctttcacctccaccatgattctgagacctccccagccatgtagaactgtaagcctgattaaacctctttttcttcccggtctcaggttatgtctttatcagcagtgtgaaaatggactaatacagtgaattggtaccagtagagtggggcattgctgaaaagatatctgaaaatgtggaagtgactttggaactgggtaacaggaagaagttagaaccgttgggaggtctcagaagaagacaggaaaatgtgggaaagtttggagcttcctagagacttgttgaatggctttgcccaaaatgctgatagcaatatggacaataatgtccaggctgaggtggtctcagatggagatgaggagctcgttgggaattggagcacaggtgactcttgttatgttttaacaaagagactggcagcattttgcccctgcgctagagatttgtggaactttgaacttgagaaagatgatttagggtatctggccgaagaaatttctcatcagcaaaacattcaagaggtgacttgggtgctgttaaaggcattcagttttataaaagaagcagagcatcaaggtttggaaaatttgcagtctgattgtgcgatagaaaagaaaaacccattttctggggagaaattcaagctggctgcagaaatttgtgtaagtggcaaggaacctaatgttaatctcgaagaccatgaggaaaatgtctccaggccatgtcagagactttcacagcagcccctcctatcagaggcctgaagtcccaggaggaaaaaatgatttcatgggcccagccctgggtccctgtgctgtgtgtagcctagggacttggtgccctgtgtcccagccactccagtcatggctgaaaggggccaaggtatagctcaggctgtggcttcagagggtggaagccccaagccttggcagcctccatgtggtgttgagtgtgtgggggcacagaagtcaagaattggggtttgggaacctctgcctagttttcagaaaatatatggaaacacctggatgccccagcaaaagtttgctgcatgggtggagccctcatggagaacctctgctagggcagtgctgaagggaaatgtagggctggagcctccaggcagagtccatactggggcactgcccagtggatctgtgagaagagggaaagtgaactaagctctttaaacctcatatgtttccatcagtaacatgggaacaatagtaacaattccacagagatagtattgatggttgaacaagatgtttaaatcactagtaaaatttggccagacacggtggctcatgcctataatcctagcacgttgggaggctgaggtgggtggagcacctgaggttaggagttcgagactagcctggtcaacatggtgaaaccccatctgtactgtaaatacaaaaaattagctgggcatggtggcaggcacttgtaatcccagctacttgggaggctgaggcaggagaatcacttgaacccggaaagtagcggttgcagtgagccgagatggcaccattgcactccagcctgggtaacgagcaaaactccatcttaaaaaaaaaaaaaaatgcccgccttattcagatacacagtctaatgctttccactagaagattctggcactgttagcatctctggcataaactatgttactcaacccagttctgtcgtcgtcatttttttgtgttggctttgcccttcccgcattgtgacttgatcccatttaagcagcaacctctgcacacacaatcttttctctgtccttcactcagtgatgttataatatctagaggcttattgattatttgtttgattctattgtgggcacaggagcagttcttagattaacactattagattttcccaagcagtattgccgtggtttatacaattggacgaaatgggtgatctaatttggactcaatttgctccaaagtagagttggaggaaggagatgctgtgatttggttctgcacctgagaacaagaatggaaaaagttatctccaggtgctatctgtgtgcctcatcaattttggatacactgtgtgaccagctctgaggattccaagcttttttgcgtggcttcttacctatcagctaaagaacctagctttacttatccaacttagatattaaatcccatgatataatttatttttccgtgtgaaatatctcaggaacaaaaaagtcaggttgagttttctaaaggcactggtttaagaggctataggttaagaggagataacagacatgctcagaaacaaatcatttcctgatagctgtttcagatggaaccaaatggaaaacagtgcttctttccgtttactgtacaccccctatcctggcatctaaacatatttgtaatcatactgtctatagaagttttggttctgcttttgaccttaacactaaaatacccttccacaatattataggcttttcatgtacatcgtttttaagatggctataaattccacttagtggctatgactgtagttttttttttaactcttcccctaatagtgaaaatttagattgtttctaaattttccttactataagtaaggctaaaaagtaacatgtgaatgttttgaatcaataaatatagtatgtattaataatattgagctatttcttaagattacattttcagaagtaagatcactgagtcaaagggtgcacactgtttaaaggagcttaaatatattgcaaaactcttttcatggtctgctgatatcactgaaaatggaggtctggattcaaatcacatgtgccaactgttctactttggcagaattacctactgctttgggcctcgggtactaaatttgtgaaatgggaaaaataatagttcccacctcatagagttgcagtggagattgaatgagtttgtagataaaaagcgtctgcgttgtgtctggtacatggtaaggggttcgtaaatactgagttatttcttattaacatttattattgtctccactggaagaagagcctgtagaatatgcagactattcaaatgcttcctttggtccattgttgtcctttcttttctcttctagaactttccccatagtcatgcatctgtccctgggttatctgatatgtgtttcagcctgttttcccaagtttacctgcctctctgagaagcccatcagccctgagagatacctggaaggaaagaggaaaatgcgtgattcaaatcatgttgcaagtggatgaatctagccccaaacaactgggaggcaactactcctgcctgccgaggcctttttttttttttttttttttttttttgagactcactctgtcacccaggctggagtgcagtggcatgatcatggctcactgcagcctcccgggctcaagctttccacccacctcagcctcctgagttgctgggaccacaagtatgcaccaacatgcctggttaatttttgtggttttttttttttttttttttttcctgctgagatggggatttcaccatgttctccaggctggtttcaaactcctgagtccaggtgatccacccatcttggcctcccagagtgctgggattacaggtgtgagccactatgcccaataccccctatgtagacttttaaagaaatacaggaaacagccaagactggtgtcattcagatttagcttgggagagtctagtgggtgttaggttcccacaggatgaaggatcaccatgaacggtcaggacctgacttaggaggactcagaagctggagactgcagaggatggcacagagttccaaatctttggggtgtgtaagagtaggagaggcaggatgggagaggatgggagtgatgccacataaatcaactctgttgcagcctccggggccacatcagtagctgcaggaggaggagggaacagggagacagggagcctttcttcctttcctcacccccagttctgtgtttatacttctcatttagcccataccccactatattaaaagaagatgtataagtgtatgtgtttaatctaccattccttgtggcacagtgcatggtctgcatggcacagtgtgtggtctgtatggcacagtgcatggtccgcatggcacagcgcgtggtccgcgtggcacagcgcgtggtccgtgtggcacagcgcgtggtccgcgtggcacagcgcgtggtctgcgtggcacagtgcgtggtctgcatggcacagcacatggacatgattcatacatgcaagtgaatgagtgaatgggcgatttccagactatccagaaactgtgccccatagtcctacccgtaggaatccaacagggaactgtcaccaccgacccgaggcaggaaccatgtgctctgagccctggccattttgtgtagatggagataaattgtcattgctaattgccagagaccaggtcctggtggtagccaaactgttccctagggagttctcaccaaccttgcaaaatgagatggcagtcttcatcgtggatgcaattatgtttcattgttaaccatcacaagcaacgggacattatgatgactgttataagttggtttcacatgtaaactttgacctcagagcaatggggcaggcttttcccaaggaccctgttgagaggttcatgatggtgacaaaaagcacaagccccagctgccaaggaggctgatatcgggagaggcagaatgtgtcttttctttcttcttcctcttcttcttcttctttttgaaaccatgctcattggttttaggaatcattagcatggtgaagattaaagctattggagatagcacagattgtttcattttattatgttcaattggattggatccgagccatttgcaaagtgcagtattaccataagaagggacttggaatgtttgtcacataatacttcttcatggagaaggcagtttcttaaagaaaaaaaaaaaagacaacttgaaatagcacagcttttttccactttcaaatgtataacaaaatagaactttatatttccagatggactgcctggaacccggggagtggctcagctaccaggctccagtggcccttgtcttgttatttcctccattagagacctggcgtataattgtgggagggagaagccagtggagcagtcaggggactccctggctgtttctgtgtctggtcttatgggtctgggcactgaattcagtcacaaaccctagcatgctcctttgctacctcaggggacaaagtcaagaaaataacactaggattgccaccctgctctctctctctctctctttttttttttttctttttgaggaagggtctctctctgtcacctggctggaatacaatggtgctatcttggcccactgcaccctccatctccctggttcaagggattctcgtgcctcagcctcccgagtagctgggattacaggggcacatgccaccatgcccagctaattttgtatttctagtacagacagggtttcaccgtgttggccaggctggtctcaaactcctgacctcaagtgatccaaccgcctcagcctcccaaagtgctgggatgacaggtgtgagccaccacacccagccactctctttcaactagaacagttcctctcttctttgttgcatatttttgtatttcatgcaaggtgctgtttatgaacaagggagtttcctgcagctttaataaagaagagaaaagaaaagaaagaaaggaaaattcgcatgttgaaaacattgtactaatcaaaaaagccagtcacaaaggaccctatgttatatgatttcatttacatgaaataccccaaagaggcaaatctgcagaaacagaaagtagagtggttgccaggggctggggatggggcgtggatggaggcatttgggattaacagctaaagatagcaggattccttctaaagcaataaaaatgttgtaaagttgattgtggaaattctttcacaactctttgattgtactaaaactttgaacactttaaatgggtgaattgtatggtatatgaatcatatctcaacaaagctgttaaaaaattgtatgaaaactgtgatgggattcaagtagtctaacgctcaaatttcccaagtgccctcatttaagtctggaccacgacaggaacccagatgtggcctgagtagcacatcgtggaatgggcctgtcacctctaccccacacatcctcctgctgttaatgccccctttgaaagccattagctcttttgataaccacagcacggtgttggctctcagttagagactcagatttatccctgcccgaatcattttctttgattctctgcccttccccactacagtgtaaactccatttggactttctctagttcactgtgaatggtttttgaataacatcaattagcataacctcatgcccagcatcgtccttattgttgagagcacagcagtgacaaaggtgcaactcttgctcttgagcgatcacagtttatttggggaacctggtactacctaataaaaccaggggagactcgacccaaggcattgtgtttgagctaggctttgaacaatgtatagaccctcaccaagtatggaagtggaagagtaagacattcaaggtagaaggaacagtatgaggaaagtcagagagctaacaaagattatagtgtaatgccagaatcatgagaaatttgctgagaattcatttgaggccataatttaaaaagataggaggagccatgtgtagaactttcacagaacagtgtgtacctcccctccttcttccttattagtcgtgattcttggggggcaactaaacccagcttttggcaaaagggagtatgttggttcatgtaccaggaagtcttggagtgatggcttcaggcacggctggatccaggggctcaaaaatataatcagatgatttgtttgcttctgtcttttgctatggtggtctctgttttgcttacttctgcagcagattttctctacctggtgggagaaacagctgccagaaaatccagattcccattctcatgctagcttcataacagcaggagagctcctcactctgtttcccagggtgtatatatatatgtatacatatgtatatgtatatcaatatatatatcaggtaagattctagtccagtgtgagccatatgctttattcctgagcaatcgctgtggtcaagagatagactttttagggccgggcacggtggcctacacctgtaatcccagcactttgagaggctgaggcgggaagatcacttgttgaggtcaggagttcgagaccagcctggccaacatggtgaaatcccatctctactaaaaatacaaaaattaggtggcaggcacttgtaatcccagctactcagaaggctgaggcgggagaatctgttgagtccgggaggcggaggttgcagtgagccaaggtcacgccactgctctccagtctgggtgacagactctgtgtcaaaaaaaaaaaaaaaaaaaaaaaaaagagagagataggctgtttaacaggtgtcgtaggtcatgtatctacagccatggaaagagaatggagcactctaatggatccctgacgggtcaaatggagcaaagtgtgcttcccagaagagcataagaaaaaggaagggtactgggtggaccaaatctattgttacaatatcccttatattccttagggttcctttttttcaagttaaagcattgagtcatgtctctgataaatcgcccccccaccccgatccccaccctctgccgccctggccttctttttgtgctgttgggttccaaactttacctgaggattttcacatgcacatctgttaaatgccatttaaagagaacactaacaagagaaagctagttcatttttcttcctgggacctcagtttcctcatcagcagaatcgggatattagtgcagaccttgcaggctctttatgaggatccatcgggagcctcaggcgcacactcggggagcattggagctcttcccaggccgaggtaggagtttgtccacctgctgtttactccgaaacttcttgctccacctgtcactttagaagaccctgatctgccggaaggtctccccgtatacccagcagcccagacctctcaggaaagagcaggctgtcgtcctgcattggaggaggaagcttggggcaggtggcagagcaacttcatttccagatgaaactgggctccctggccatcagctgccgtgcttggaggggcgttcagacaaagagccaaatttaaattcatgtaatgttgctgtttgtaacattgaatacttaagacatctgctcagagtctcgcattataaatgaatggaaaggatccaggagggctttattggatgggagccgtgaagtgagcgccgtgtatttcaaagcaggatcttaatcagacattatttatatctataatattttacaaattaaaagcagtagaaatagtcactggaaggaagtcagcaagcaggggtgaaaaaaaaaaaaaataaaagaacctgaagccgccaagagaggctcactgaccatctctgggggagggagggtgaagagtagcaaatttaccgtcatcagcaggtgtgtaaatgttccatttacattgaatggcacatgtcataaagtacataccgctgcacatcccaccctctgtttctgtttcaactgcagagcctatttttctttcccttccagctcagctgccttctcctccctgacctcaggtcacccaagactcccactttattatttccttttacttttagttcattattctctgtgattcagtggaaacataaaaaatggtttttaattttaattaatggcaaacttagaacagacccatttaataaatctgtcctctgaacttaacacgtctccccgccttgtaagggctgcctgtcattttattagcgctggagcctcccgaccgaagggctgagtaattgacaaaaactgcaggtaaggcaagaggcccgtaattgattcataagatcccttcctccgatcgcattgaagagttaattatttttcctgcagttgggactcagctgttgtttcccctgggattaaacagctgtcagcattgttaatgacatcaaattcatgcattaaaatcctctcattcccttcccgtataaggtggggttgcggaaatctctgccacgtccgcctttatgaaggagtgaaatcctaagaaagataaaggcccttattacaaaaccacagaccggagcttgtgttgatggaatctcgtaatgagtaattaagccgctttgcagaagtccgggctgtcatcctggcgtttgggtacttatgttccctagtggagacagccgggtagactggggaaggtgataaaagggagaaaaatagaactgttctagaacgatctccacttttaacagcacaatacagagaacagagctactcaataattagccaaccaagtatgaattctcatatgttcttaaagtatctgctgatttcttcaaacatctctaacaacatgtctgatgaatacgaagcctccctttatttatttattttctttttgctttctttttttgggggcagggggcacagtttttctttctgtctcagtctctcaaactgtaggaggaccaacttcagggttttattttgtttgctttgctttgccttgtctggtttttcaaagtgctcttttaacaaatgaaagtttaaagcttgagttcaatttgagtaatttgttcccagagaaaaagtaaatgaaaagtatttctgggtatttttaatgacacaagtttctgtgctgatatgcgggcaggggttcgggagtgggggcaccagggctcatgagccgagagcccctgcttcccttggaaaacggaaatttctatctccaactagggaaaaatttgcatgtgtagaattttggttttttcttcggcgtgtttatttaatttaacattacctatcctacgattatttcaaggtgattttattactagtcagctttcttttccctagcacaaaactcatgcaacatttatgttgaatgtttaaaattcttttctaaatggtttcacctttctgaaaaaatcttgcattcaaaaagtgtaaaggactctcctcatttctgcgcttgaaagtgcagtgtgatttcacaaatcaaacaatatcaggaaaattcaatctcgttaatacttttggagggaaaagaaggcaagcgtactcttcagagaacggattcttttggatttgtgttagagaaaaactgtctctaatgaccgcacagcacaaagcaaagcagttaaatgaataaccgccttccagtacagataataaagcaggggaattttgtgtgtcacatcaataaacatcttaattgaacagtacgtgggttcttccctagtacctgccttgctatacactagccttggaaagagtcttggtaaattgttcagcctcaagttccacaacaaaatgggattctgttttctagaacctggcctagttatgatgtgatgaatccgtctctgttaaggttatcaactttaataaaccatgtattatttccttaaatattgtgcaatgtgcagggaattatttcagttttgttttttatttagcacaaacctaaatattacacgtagcaaatgtcacccgatgcaactgtctgtcctgaagaggaggacagattattctgtggctacctaatggtgtttacagagttgccactttgccaaaccccaagacccacacttggtctctggtgttgggtccgccagctctccacccttcagaatgggatgtttagggcgtaatcttctgagacccacaacctaagccgggaagcagaggcaatttattaccccagcttcctgtccactggaggcccggggagaccttgaaatgctcagctgcaagtcagggtccaccgatgcagcctcggaatttaatgaggcctctccggacccaaagggagatggacatttctaggcttgtggaagggactccccagcccctcttctctcctggtgagaccgttgttggatgtgaaaaggccttcactattgtcaaggctgggcccctgcttttgccttgttactctgcattttaactctggaccagaattgattgccaccaataaaagatactccagtccttaaaaagtcaacattgttatgttttacttagttatgacttagtgaacacctatacgaattagcctcatctggttcaagggttctcagatgggaccacttttgcacccagggaaggtgtggcaatgtctagagacatttttgattgtcataacttaggatgaggtaatagtgtgctcctgatttctgggggtagaggccggggatagtggttaacatcctacatgaacagggcagacccttgcaacaaaatcttacgtggtcctggatgaaaataacactggaggtaagaaaccttggcctagagggttccccaacctttttttttttttcattatggccccctcccccaggagccttttgagatacgactttcctaatggtctttgcccatgaaatctgaataccacagatgtgctgaatgcctgttcatgtaccatatacacatggtatatgcctcgtaaatgaaagggtgaacagtgtttattccccaactgtcgtccctcaaaaccaatgttaacacccctggatgtattgtcacccctgttgggaatacaccgctcagagaagggttttgtccataggcaacacagagccaattgaggcctttgggcaagcggaggtcatgatggaattcagcctttcagacaattctgccaggcccttggagggtgggaggaaacaggcaagacctctggctcctagaaccgtaaggacccttgccattaggaccaaacctcttccagctttctcagcagccacatgtcaccccctcttccaccctttgccctgccaccctccatcccctgataccctcctgccttttagttgccggtgcttggaaacctttgcaaagtctttttatggagatgccatgtcctttcaatggtgcgtttagccagcgccccgctctgggctccagcaacattagggcattgttattccatccgaatgacaatttcaagctcacgtctttgttgtccatcctcgaatatcctgcaccgttcctggcacagagtaggcactggataattatttcttggatgaaagaatgaacaaatgaatgaatgaatgaaagtttttttccttgcaaatctccctgcacactttaatcttaccagcatcttgtgaaacactcctacttctttctgatctttatttcttacgtagttttgaaatgagaaccgatgaagctgcttttgctcatggtacctcaggtcctcgctcactcccagcactcagggctgtgtggtcagagtctcagattcggagcatgtgatgtgcgtgggcctgtgactaacagccacatggcacgcaatggtggcagcctgggaggctgactgagcaagtaatttctgcttaagcaagaacgtgaggggtgatgtagttgcatgcactttgccatcatagcttgatctaggtctcagcctgggatcttgcagctgcgaaaagcatggcgttgcgtttccaagcctgaacatccacacccgcgaagataagaccatctcttggattaatgtgacgctgaaataaaataatccaaagagaaaatgcctgagacccaccaggagctcaccagatactacttctatcttccccactctaggtctttttactgcaactaccgtttaaaatactttttccatgaggcagatcttagtgctgacagtgtcagtgtctttaatgcctggttcagttgcaaacatggagggcagaggtttgatagcatccaaagtatgcacgccgcactccacctcccatgcccttttctttttctcagggccatcagaaaggaagtaactggcttagatttgacacctctttttttgttcgttttatgtttttgaatctagcatgtataagctcatcagagagctttcccctggcctgggacaatcaggtttcaactgaggctcacgcacacgtcaacacaggaacctttttgatgcctccaggcaatttcctacaagctctaatatcttcctctttactcccatatgtggtatctctggtaccctatatatcattcactcaagtgtttgttttgaaccacttattttggcaagacttcttcagacaggagagccctgagagctcttcaaaggctgggcctgatggtgtttgtcagagaggttcgagctcttaaatttaaatggcctcccacagggaagcagaagtccttttggatcctccagaggcctgagatcctccagatcctgttcatttgccttattcgttatgaccatagaagtttgtggggtggcactctttattctgtcctcgccccacaagcaaagcacacaccagaagctataaggagatgagctcagtaggcctgtcctttactttattttccctattagaatcccaccatagacgccctctctgcatgtgtccttgtctgggggagtcgcttaatttcctttttctttgaggggctataaaatttttgttgttacaaaaatgaaaggggagaggagatagaagaaggaaaacagtgaaagctcagcctcgaaagaagtgcttaaaggaaaggaggttctgacagagggctcggatcatcagcaggggcagggggtgcagggggtgcctgcaagtctgtgaccgtcctgaaggacccccttcctaggatcccaaacatgcactcccatcccagcctcacaccaagctcccatctgggaagcagcagacacacataaaagcaaggaaacttcaaggacgctttttgttttcccctacttttaaaaaattgaggtgaaattcacataatataagattaaccatttcaaagtagacagttcaatagcagtacattcacaatggtgtgtaaataccgcatctatttccaaaatatttgtatctccccacaataaaagtctgtaccaattaagcagctactacccattcctcttccctaccattctaccttctgtctcagtaggtttgcttatttgggatattttatttaagtgggatcatacaatagcatcatgtgttcaaggttgacccacattgtggcatgtatcagtacttcattcccttttatcactgaatagtattccactgtatattgataccacagttggttgacccattcatccatccatgggcatttgggttatttccacctttttgctcttgtgaatccatgctgctgtgaataattgcatatgagtatttgggttcctgtttttaattatgttgggtatatacctaggagtggaagtgctgggtcacgcagtaattctttttaactttttggggaaatatcaaaccgttttccacagtggctgcaccatgttgcattcccaccagcgaagtgcaggggttccagtttctcacactgtcaccaactctgtcagtctattctggcactgctataaagaaatgcctgagactgggtaatggctgaagaaaagaggtttaattggctcatgattctgcaggctgcacaggaagcatagaagcttctgctactgggggcgcctcaggaaacttataatcatggcagaaggtaaaggggaagcaggcacatcttacatcgccagagcaggagcaacagagagcgactggggaggcgctacacacttttcaaccaccgaatcgcatgagaactctctcactgggacaacaccaaggagatactgctaaatcatttatgaagggttcatcctcatgactcagtcacctcccaccaggccccacctccaacactggggattacaattcaacatgagatttcggcggggacacagatccaaaccttatcaccagcgcttgttatttcttcaggtacattttgatgtccctccccactttactctcccctacaccttgaagcaggtgcaatcattttaggctatgaggaccagcatcgaccttcatcagcatctgctctcctttacggccaggtctccttcgtcctccctgctcagaatttcagtctttttttttttttttccctatacagacacaggaagtatatattttcctctcgaatatcacttgggtcttatcttgttttatgctacatgcatgtggcttcccccgttacaaaaagaattcacattattagagaacatttggaaaacatacagaagtaaaacaagccatccccattcccacctcccagagataacgcctgtgttttagttcatctccttctaacctttatagttttttttctatcatattagttaggcattggtttggctccaagtgaaaactgcttctgttattaacatcagcagcagcaacaagaagagagaagtttatgtctgtctcggaatacgtacgtgacaggctcccccatcgaggtgctcagatatggtggccactgcatgattttgctcaggactgaattagaggcaggtgaaaggccctcactccctggaatcagctagcgatggctaaggctcctgtgacggtttctacagaggttccacccagagaggagagtcaaatgggagtttctaccgatgctcttgaaaggatcttgttactcagatgtctctaagacaatgatcagtacccatctctcagagcctgtgtagccgtccatgcttgaggcatgagatgctgaagataaaggtccccagtggtccaggtttttccttctcagcttggaaagcagcaggaaaactgcactgcatttatccaaagggtgtgattggtaagtgtgggtagtgatatagaataaatcaacgtggctgggtgcagtggctcacgtctataatcccattactttgggaggccaaggtgggtggatcacaaggtcaggagattgagaccatcctggctaacatggtgaaaccccatctctactaaaaatacaaaaaattagctgggtgtgttggtgggcacctgtacttccagctgcttgggaagctgaggcaggagaatcacttgaactcagaaggccaaggttgtagtaagctgagattgcaccactgcactgcagccttggcaacagagcgagactccatctcaaatcaatcaaccagtcaatgtgtgcccccttttcctccaactcccaccccaaatccttgctgaatcatacctatccttcacctttataagcatctagtttttaaatctttgctgtgaagttggctgtgtgagctccatttgacagatggaaaaactaaggtagtttgccaaagatggctctttgccttcaggatttccatgtctttattttgagtaaacacttgcactgctaattttattccaacaatgtccttggaatggttttagttctcttggctgtaaccaagtctacacgataccacttgaattgacaacatcacagtcaaacctcaattttcacaattaattgtgccgcagttaattaaattgactgcctggcaatccagtctcaattaaaatactaatagtttatttatttattttgtcttttacgaagcgttttcttttaccatctctcaggatcctatgtaggtatcctgatggtaagaatgataataccatgactgattattccatagttgcaggaaccccacatggcatttcaaatcacaatcagaactttgaccttgaaaggggacccggatcagctccattctcccaaggagactttagctactacctttcttactttttgaataagtattttgcagggcttattttcatcatctggaaaggaggaatagatagggttatcttgaaagtcctctcttggaagggattatggttctgtaatcctgtaggactggactcagtgggtaaatgtagaggtgatggtatctccgtttttattgtcttcagaaatgttgagatcgagtgatataaagtcacagggttggccccacagtttagttcttggcttatgtagaaatctgtgctaagaagcgctgtgttgcgtcatcatggggcatttttgtatgtcatgcagtcatactttgcagacccctgggagcctcattcgagttcttcctgtggagtcccatgccttggtgttgaaccagtgtcctagctgggaggaccgttgtactgcagcactttcctaaactctgcatgtggtctccatgatgtcctggctgtgttagcatcagaaatggctttgcccacatctcccaactctgccctcttattaggatttctctgcgctggctgatgcctgagccatctaatgatctttacgggaataaccaaaaatgctgggtggggggggaaaacgccagcagatctctttagggcagagtagggagggacacggacaatgtgggcagctgtccatgcagcacgtatcacatccaggatgatgtttatatgaagcatcatttttttttttttttaggtggagtcttgctctgtcatccaggctggcatgcagtggcacaatctgggctcactgcaacctccactttccgggttcaggtgattctcctgcctcagcctcccaagtagctgggagtaaaggcacatgccaccatgcccagctaatttttgtatttttgttagagatggggtggccaggctggtcttgaactgctgacttcgagtgatccaccggccttggcctcacaaagtgctgggattacaggtgtgagacattgtgcccagcttggagcatcttaatttaagccctctacatccctgcacggtagatacaaccagctccgtttccaaggacgaggagcaacagagtgaggtcatttccctgagttacactgaagatggtctaatttcaaagtccttcctgtgtccactttgccaggtgccccccgaaaagcaagaagactccttcaagcatcctgaagatttggatgctacaactgtatgtcctgctggagagaccctcccagaacattgaaggctccagtgttttgactggcagaatctcagtttcaacatctgtctctaagggctctggacctatgctgggtgaaacgtgttgtctgtaggatttggcccatctgagcctcactggggatgggctaaactccgtggggtttgtattccttctccttcattgctcagaggaaaagaagaaaaaaaataaaaagaaacgaccccaaacagcctctttcgtgcacacacgcctaagaaataggaacatgaatttgcattccttccaactggtgtgtttccaaaatacagacaggcaagtttgaatcactttgactttgaaagcgtgattttgagcaatcatctggggaaaaaaatacctcctcttcactaaataagtctgtcaaaaagagtcatagtacagcgtgccattgccagaatacacgtgtgtgctggtaagctggccccaaccaattaaatagtgaaatgtcgactgcattcaggcccttcctggtctgcagacagacttgtgttagttcattttcatagtggtgtgtatgtatctttagactttaactgacagattcccacagtgagtagagtagggagttatcaattacatggttagctaggcgctgctattgtatgctctatggcttcttgacaggagcaggcagagaaggagggaaggactaatatttctggtgcaggaggactgttaatattttagaccgggctcctcaaacatgtatgcttatttagtgaggagaaaatgtgcatttgaatcctgcaaaccctcgagaagtttgcattaataaatagtgattaccagaatattctcttctaaaatatattttatttatcaaatgaatacccttctgagcccctctttatccttcctgtgatggctaaactaatttcatcaaattttgatttctgtgtggtgatgttgtgaacagtgcctgaaataataaaattaccctgagcagattgcatataaaactgtttgcaatgggagaagcagtctttggggctgtggtttcctttggctgcagtgtaatatattcctttgtttcttttgtgaagtatttattgtgggtctcctgtagtctgagtttcttgtggaagtgggcttgtgttttgcttttgtagactgacactgagaatagcatccaaacatctttttcccaccaaggcatcaaactccatcgttaggaattccttcatagaatcaaagaatcagaaagagctgaaacatagaccacggacactcaaattgtttatcctgaaatgaatgggaaaacctaagctgaagaaaggaagtgtctggccaagaagctggcgggagagtagaatcaggaaccagggcctcctcgtatctggtctcacgcttcttccgtggtgttctttcttaagttgagcattgcattctccttggataggatggatattttcctgggaaggatgatacatgatgtatttatccataaaactgaacaggtgttatgtgtgccttttctaataggaaagaccatcatgctatgaaaagagaggaaggggagaagaaatggggtacgttaagatctcagaatgagttgtggggctaaatgttcagcctgtctcccttttctccttgccacaccactagattatattttctagactctcctggtgttagatttggccttgtgacttccagccaatggaatcggctgcaggatgaaactagtcttgatccctgaatgactgcgtggagcacatctccttctggtcaataaggcatttcaggagtgagagataaacttctattgtgttaaacccctgtgactttgagacatatctcctacagcaggtggagttagcttaactaatgcagaacgataggactggtgaagcagtccatctgttatgagagctattctttttttttttttttttttttttgtgagatggagtcttgctctgttacccaggctggagtgcagtggcgcagtctcagctgactgcaagctctgcatcccaggttcacgctattctcctgcctcagcctcccgagtagctgggactacaggcgcctgccaccatgcccggctattttttttgtatttttagtagagacagggtttcactgtcttagccaggatggtctcgatctcctgacctcgtgatctgcccgccttggcctcccaaagtgctggcattacaggcatgagccatcgcgcccggccagagggctattctttgtcttttatttgctttgagtccggtataaccatgtggcacatacccctgtacatgtttgccaagactgctatatggcagagcttggaattcttaggagctttatcaggtaattgcaagtcccccacctccaagaaagcactctctaggtcaagaatcagcaaatgttttctatagaggcccgtaaaattaatattttatactttgtgggtcatatagtctctgtttcaattacccaactctgctgttgtagtgcaaaagcagctgtagacagtaagtgaatggatgggtgtggccgtgtgccaataaaactttatttacaaaaacaggcagcaggccagaattagccctgtgggatgactcacatgagcagagagttctggcatcaactttgttcggagagatactgacatacttctactcaagtaagtcaatgtttctgtctcaactggttgattggaacaacatacaaactgacccttaggaaccttctaccaaaaatatcctgtgaatcttcatacttttgtaataccgtttagttagaagtggtcagactttcttcgtcctcttttcgtgatttcctctgtggtgtctgtggatcgataccggcagctcaggtaaggaacgtgtgcaggggatgtaacagaaaggagaaagacgaggaagaagggtgcatggagcgtgcaggggaagaactgattcttttttcagttaatcggctcatcaaggttctggtgttgaagtctgatttcatttgccatgttaagaggatatggacagatactgggcaaaaggaaaaaaaaaatattggatccttgcccagctccaagtgttgctgagtcccttgccccctccaccccgctctgtcaggagccaagctctggccgcccagtttttggactttgtaactgtttccgaacggatcagattccatctgaattgcagatggctttagccccagcagcagaggctgccatgacatcggcatgcgatttcttccaggacttaactctggagagagctccatttcctgttgatcatgagggttttacaggcacaaacgctgtcttctgtcactctgtcacagtgcattatgtcagaatagaggaagcagttcagcccgtaaatctgtgccaccggcacgcagggtgttgtgttgtctccaatgtgccttgtcaacaccacagggctaatagcagtgtcagggtccccgtgccatgaatcacttcacatctctggctagtacagatctctccctgtcactagtggaagtcgcctgcactacattcagaataggggccaggcgcggtggctcacgctgtaatcccagaacgttgggaggccaaggtgggaggatcacttgaagtcaggagtttcagaccagcctgacaaacatggtgaaacccagtctctactaaaaatacaaaaattagctgtgcatagtggtgcatgcctgtagtcccagctactcaggaggctgaggcaggagaattgcttgaatccaagagatggaggttgcagtgagccaaggtcgtgccactgcactccagcctgggcaaaagagtgagactccatctgaaaaagaaaaaaagaataggcacagacaatttacctggatcctcacattgcaatgctgaccactccggaaggagtgtagaagttgcagctcatgcctgcattccaaatggctgccttctgcagtcccgtcagccaggatccctctcatacaaacaccttgactggccgagaaatgcagatgctgtgtcaaaagttcatggctcagagccaacaatgcactgtgctgacctccaattttccttgaggaggggcatcccagggtcagaattttatgcaatgcaagcttgtccacgatggcatgggagcgtgtgggaatgtcaagatgaaccggggctccgggagacatttatggagtcaggagcacacatacattcctggttctgtcagcatttccctaggcgagatgagtcacacatttatatttttacatatgcagcgcgcttgcaattttccactggggatgatagaaaaacttattgaaaatagttaatcagttttacaaagatgccataggtagaggtgcttccagacctatagttttgaaagtcacctagaggataccagtctgactcagagctttatgaaggcatattcctaatatcctccctgtgctccacgaagaacaattggtttggacatgaactggtttccatttttagactccaggcccacagtattctaagtaggttggggctgtgctgattgtaccactctttggattttagtggattttctttttaggatttcatgtaagtaacctgtgcagagagtgaggataaataagaacaagaatgacaaaccgataggctacttgacatcattccttaattccaggtcactggcggacatcactcattcatcagtactctgtttttctcccaagaatggatctgactcttgaattctctttaatagagtgttctgggaggctgttaccaattgaccagggttgatgcacatgttgaaacatctttgccatttcttgatagcttcagaagagattttaaagtactattattttgatgttgttagctttcaaagattaattccacagagatttttgggcatctttttgataatacacattatgcttgacttgggagtttcaggatgcgcaagagactccttttgactgcaaggactcagtaaaacaaagtatttcaaggtcatgctacaaaaagtcccaccaagagcatggtcaggaggtacagtgcacttacccacacggagcagagagggatcagaggaggctggctggggaaatgatcctagggctttcttaaaggacacagcgccatggttatttaagtacagcttttaaggagaactaacttgccactttgatagcagtataggactccaatatttctcatttgtaattttcagaagcacacgggaggtctttgaaatttaatgtctccctgcatcacaaaccaaaagacgagtcagtttataagtaggctgtgcttattaactcagtcctggctttattgattgctttaggttccatgatctttggcatgtgagtggttttgctttgttttgacaatgatctttttgtaccttgtatcgggtaggttggaatgtgtttgaaaatttaagaatattttcctagcaaaggcaggatttttcaagtttgttcatgctggagctcctgccacgtattttgtccttttttcttttttctagcaactctcgagaggatgagacaaatggattgtgaaactggaaggagggtttctcattttttaatccattgttttagtgagagtttaaagctttcctataaaatatgtgggttgagaaaaattggaaaagacctcttcaaggactttcctctatgctccctcatgtttcaagtggcttttttgcatgatggtgcatatgtctttgtttctgtacagggccctccatgttcagaggcagagtaacgtgaattcatttcgcgctaatgagagttgcgatatgtcggcccaaactctctgtgtccttttcttcttgggctgatgaacttgtcaacttttaaaaaatgtgctctccaaaaatttccagcaggactttcccaccttgctgtttaaacagtgaatcagccctgtgggctttgctgcttacaacatgattccggtgaaaccacaggtctcgtcatgtcccttctgtatccatggtagtcccagtgggaaagaggtaacaaacccaaattgagtaatttcaagaaattttaataacaaaggggctattttataaagggggggtggtcaaggtgtagggaaacataaaagagagcgaatttctggtctggtgctgtgggtcacgcctgtaataccagcagtttgggaggccgaggctggtggatcacctgaggtcaggagtttgagaccagtctggccaacatggtgaaaccccgtctctactaaaaatacaaaaacttagctgggcatggtgacaggcatctgtaatctcagctcctcgggaggctgaggctggagaatcacttgaacccgggaggcagaggttgcagtgagccaagatcacgctattgcactccagcccaggcaacaagagcaaaactctgtctcaaaaaaaataaaaaaaaaaaaaaaagaaagaaaattaatttctcagaggtagtaataggggtggctgtcaccatccttggccaaggagagggagcagatactggagacagttgaaggtgccaggatggagaagactccttggaaggagctgtaacctttggttgaggaattcagcctaccactggtaatactccctctccccaggagaggtcccagcggaataaacatccccgccccttcaactctttgccattgttcaagccctgctagaaaccagatggcaaaaggaagttactgatgtgttcatattggtcaactttttcaggcacgaagaccagtacagaaggatggaaagtgcatttgggtagggaaatgggagattcctgcatagctgtcaagttagtttcttcccagagagaaagaccggtggctgtagtctgtgccccactcccagcctgtcctttctcagccgtggcttgtgtgcatccctggggccagcatgttgctgcgagccccaatcgatcagtggagaaacgagctctggtgggcagtcaggcaaagcagatacacgtgcttcttttcagctttgttggaaggtttcattttgcttcaggaactaggcaggagaattcctgagttcctgtacaacctgagttctctgttaaaacaaggaggaagtaatcatcctgagttcgatgattcagagtaagccatttaacttgtagagctttgggactaacaatgatccctttttggagtccttaattactaaaattatcagcatatttagagttctgaagatgctgaacccttattgtatctccccagggttagtgagtaattgggaatagtgttccatcttggatgcccccatccactaaccatctttcctcttcgggtggttctaagaattctaattcaattagaaggccttctttttagtttgattagttcaatatcaagagctaaatacattagcttatatatatgtctgatgaactcatctttgcttccttggatccccaagatagaatggccctgatgcagtcaaaccaccctgcagaatcttaacagcaccacaaatattgcatccaggcatcctgcccatgctggcttgcaggctggggatccctgtccatagcgcccatggctccaccaccagtcaaaggtagtggggccagcagtggactcctgtgtggttcagctctcaaaaatgtgaactgaaagacacagaaaaagacttgtgtttggggataaatactgagactgagcagtcttgtggattcaggaattgggcatccagttgggaccctttgcaagaagggtgttagggagcagagagcatgagtaagccagaagcagagcaggagagagaatggagcaggtgtgcaaagagggcggtgagatgctgagagtaatggggctggcccaggaggaagtgagaggaagcaaagtgagacagaggtggtgtgtgagcgtgtgtgtgtgtgtgtgtgtgtgtgtgtgtgtgtgattgagagagagagagacagatggagggaaagagaggcgggggattccaggtacagtggctcatgtctgtaattctagcactttgggaggccggggcgagcaaattgcttgaactcacgagttcgaggctagcctgggcaacacggcaaagccctcatctctacaaaaaatacaaaaattagctgggcttggtgacagacgcttgtagtctcagctactcgggaggctgaagtgggaggatctttagagcccaggaagtctaggctgcagtgagccatgaccttgccactgcacaccagcctgggtgacagagggagaccttgtctcaccaaaaaaaaaaaaaaaagagagagaggttgagctcaactgatcagcatctcagattaagggcctccattccccccatgctttgtaattgctgcctgttttccatgaagcctgactgtgcattggttctaagtcatgggctctgcaagatcctccttgtgccttgagaagggccctgtccgcagcctgaggagcctcaactgttctctgcacgacctagttctgggctagggaatggctgtctagcttcagtggatttccagagtccggagctactaaaggtcaacagctgtgttactgcaaactctgtggcctgcattctatcaatgccaaaatgcacatcacactgacaacagctctttgtttacaccggggagcccccaaagccccagggtaattccatcaccacccaagttgtaagatggtagagcgaacaggccagaatgtgataaagtaaaatgaaagaagaaaaaggaggaaggaaaaagagagagggagaagcacatagaggaaagaaggaagaaggaaggaggaaggagggagggagggagacagggaaggaaggaagtctggcaagagggcacagtcagacctgccaggatccctctgctgtcttaatcaagctttgcctcagtctttctggactgaatttgtctctgtgttcacttggcattttttaaaaggagacaaaacaggtgatgaacacagcatgagtgatttttcccttaagagagaggtgtcatgctgagaaagaagaaccgacctccaggggagcttgtcttcagaccaaaaccctggcaaggacagcctgtttggatcttggtcattttgttagatttataaagtgcctttgaacagagcaggacactctggggacaagtcaaagcatggcagccttcagcttcccaaagaagagttgtggagaaggaaaagtgaaggaaagtaccttactaagtcattgatggcacattcagcccttgtcaaagtcaaagaagaaatttggagaaattctcaccactgtgcttaggagtcaccctgaactatttcttggatgaaattaccaccctcccacttttggcaatgagacagcaagcttggaatttggagtccatgttaaatccaggtcccagccaggcacagtggctcacgcctgtaattccagcattttgggaggctgagatgggaggatcacttgagcccaggagtttgaggccagcctggtcaacacaaggagacttcatctctataaataataaaaaaattaaaaattagctgggtgtggtggtgcacacctgtagtcccagctactcaggaggctgagatgggaagatggcttgagcctgggaatttgaggctatagtgagccatgattgcaccactgcactccagactgggagacacagcaagaccttgtctcaaaaaaaaaaaaaaagccagattctccacctaccagtggtggggccccttgggtaacttgttttcactccctcagaacctcagtttcctttcctatacaacgcaagccataaggttaacccctcctcgtggtgatgttaagatgaaacaggaaggtgaggggcttaacacatttccgtgttcccataagctttcaggagatcttggtagttttcatctcggtgttcattaccatcatcactgcttcagactcctgtccatgtggggccctgtggtcttgcgatcacctccataaatgttcctttgttcccgcctaacacaataccagccacaaaataattctcaacacatattcattagtggatgcaggggcgaaatgaaactcagggggttgggaaactcacctgaaggatcttctccctctccccactttcaggctctcctttcacatgcatgcattaattcgttcattcttggaatctacacacctgtgatgtgctagttactaaagatgtagcaatgagtgaaaggtaatcctgtccttgaggcattcacaggtaaagaagcctgcttgggacattgggccgtgagctccaacgatgtcactattcttctaggctttgtggacctttggtcaccccttctgtaagaccaactcccttatctgcctgtacagtgttctgcgaatcccggtctctactaaaaatacaaaaaaaaattagccaggtgtggtggtgggtgcctgcaatcccagctactctggaggctgaggcaggagaattgcttgaatccgggaggcagaggttgcagtgaacccagattgcgcctctgcactccagcctgggcaaaagagtgacactctatctcaaaaaaacaaaacaaaacaaaaacaatttggctccagtgagctcattttacgttgtatgtaccagtatgcaagtgttgtatggatgtgagcgtctgcgtaggtttttatttttctctctcagaatgaaaggtttgattcgtaccagctccccatcccttcccatgatcccatcttaatgtctgttgtggaagttggcccacagaagcctcaagcctaaccaacaagaaagatcacttcatatgcattagctggaaggtagcaagaggaaatcgcctgccagggtccctgactcccggaggaaagtgtcctctgagccctccttgagggacataaatagcctcaaaagtcactgaatgctaagttggctttctccccaaaccttctaagtaggcagtcaggatttaacgacccgcaaatttccaattttttagtttatgaaaaaatatatctacgtataatttttgcctccattagagtctcatctttaaaaaaaaaattattcagtgacttcctccctctctttccaatgaggaaaactggactatttatgctgcattttaggctttttttcatatataatttttcatataaatgcacattttccccttctttcggggaggaaatttaacttttgtggaaatgtgatgtgtgtttaaattaccaatttcataggcaatatgtctgataattgcagagagatactgagttaacttgtagcaatgagtttctgtgacaaagggaaatcagtttgtttgcagtaagccgaggataacggcgccgaaactttactatttgggggtggggggaggttggggaagggaggccctgaaattgctttttataattaaaaagggaatctcagatgttttatatcttgaatatttacaataaaacctttaagtgcttgtcaagagggtaatgtgtcattaactggggactctgcctcgcctctcctctcggacatgacagtgcggctggataagagaagagtaattatagttaagcagggctgccaggtgtgataaatgactaatcagcacgcaggagcctcagtcctcaaaggaggactattacagtgttatcagctgcgggcctgggtgtacggagcccggaacagggatggggacaggaccttgcgctgtgcggcttggcatgctgctccagagtgagcccatggctgtctcttagttttgtcaccggcggctttatgtggctgccacggggggacaggaaacacacaggggctccagcaatctgcctggtgctaatatttatataacacactcgccagactccatggcctgagtccgggggtggcttttcgtggtgcagcttggatggcatcggaacctgcaagaagccaagacgcctgttctccacggcggagcccgctggtcggtcactcctgttcctttcgtgtccgttgggtgcaggcattatttccagtgtatgtgaccgcttcccccgtgggaacagtgtggcattgttccctgggcaagccaacagctcagccctgtcctagagaaccctggagctacgacgagggtaccctggacccctgtcctaaatgttctttgactctgcttagccactgaggatgtttgcatttgattcatttgcttattatgatcaagaaacgttacctgtcaacattggataaaccatccgagggaaattaatcaaaacccccttcagacaaactgcatcacatcgattctctccttataggccttcttgttttgtgttctctgtgtgtgttttttttcccctagcgtgctgaagggtggcattggagtaccatttaaagaataatttttaagaaatgaacatcaggacatagacgtctgaatatgaggaagtgcctcatgtgaaaaaggacgtaatgtgctttaaagaaagaagaaggagataggacgacacttttgatacaaaggttatttttataatacttgcatttttatcggttcacgtattttaacagggagccctgactgaagtcacaaaaattatgactccggcaccgaggtacttatctgacaaatgcaatgcgaatggtcttgttcttatcaatgagatcagatttcagaaatgaatgtgaagaccgaggcgttgctttgtgcacagataaccttgcaggcgcaaactcccaaaccagaataaaagaattctctatgaaataatgggccaggaagcccaatcgcgtcacactgtaatagacagtggggggtggaatcaaaagggggaaaaaactcatttcatctcagttaatggcagggaaacgaaggcagagaaggactttctttggagcggagctggtacgacaaagagcagggtttcgccgtgtcatgcaccatttgccgttgcactagggctcttttcaggagctgtgaagccattattataatgtgaaaaaggtggaaagaaatactcccttctggacactggaagggcaaatgaggtgcaagccttttttttttctttcttttcttcttcttcttcttctttttttttttttttttttgtttttcctcccagcctctctcctttcccattatgcacaatgcgctgagaaaggattcccagtccccctggtaaaaagtctggaggatgccgaggagttcactgtgcccttagataataacagtttgtcttggctctgatcactcctttttgtgacttagctggctgggaagtagcaaaagtatcttccaagctcagcttctctctgcttgcattctttccaaatacgtgattccaaagcccatgcccaatccttgcactgaagcttttagcaggaaaggtgaacagaggcatctggatgcatcgcggccagtctgccccttgcccaattccctcccctctcctgcctacaggtcatccctgagaagtgtgcctgtggactgcgttctttggggtaggacatggaatgggaagatgaaaagaaagccttcctttttctgtcctcagccgtaagaaagaatggtttcttcacagtgccgattggtaaaaccaagttctttgtaaattatggaacccaagctggaacttggagagcattcttctaactgaagataaatatggttgccactgtctttataaaaaaaaaagaaaaagaaaaagaaagagagaaagagaaaaaactgcaaaaccgcaaactggcttgttcttatgtggttgatggggacagcaagattacatatatagccagcatttgattctcaggactggtaaagtgtgaagaacagcagtgacattctagtcttcaataaatcactataaaaatgtttatgaaccctgcaatttactgtcttttatatgcaaattgaaaggggcatcattgcaagtgtaaaggagacccgaggtggcctgaaggaagtgtaaaatgttgcagtaggttttggagattgtgtgatcttaaatgggatcatttccaaacgattttgcgtttatacctctgtgacagttcgattaatttattaatgagattgctgtaagttgcagggaagtagaggccagcttggagttaaagggtggctttgaatgaaatacattttcatttcactgaaagaagagggaaactggtgattccaaatccagatccaaaaagttattttggcaaaatgaaatcagaacgtggccccttccatgaaagtcagctcaggcgtagaatgttcttttttttaattttttttttaacgaaactcacatcttctttaaataaaatctccatttagaaatttttgaagacttgtggatagaagaagtaaccttgaaaagggcagagctgagccagaccccttttcagctgggtgctccctggaagatggatcttgccttgtggatgtttttctaccgtgacagaagatagaaaggatgaaatagaaagagtgtgagtgaattctgcacccacccccgccccccagcttccccacctgtaaaatgatttgctcaaagtttgcaaagaatggaggcatattcaaagtgctcagcactgggccggacccatgggtatgcattcataatgatcagcttcattctctccctttccctctctctccacacctttccattcctcctaactaatgtgggagagaagagaaaattacagtgagagatggtggtcagtttacaacagtatttagatgagaattaagattatgtccattcagggagactctagtgtgctctacatccccccaaaatgtggggacaatatggcaaatatggccaggtacagtgacagaaagtaaacagcccatgaaaacaggttgctctgcaattctcccaactgttcccttcccgcttcccacctgcctcgtatggaaaacacccaaagtaggcactgtttatagagccatcgcttgcagaacatctccccggcctccgacacatgtgccataaatgctgcagagctgcgtccacagtccctgctccggagaagagcattttgcttgttttcaaacacaagcatcctctcccgcgcctgggagggcgaggtgcggatcttttcgccttggcagtccctcgctcaaatgtgcgtctctggcaagtcctgtctgctgatagttgatagtgctgccacagagcggctgtcagattccaaaggcatcataccatctgcttttccaatcttctgctcttcaatgtagacatatgttcgagtggttcgtgtgtgtgcctggtgaggggggtgctattttccgggggaagaggaggaggagaggatgcttaactccaagagtcctcaaagcaaactgaaataaaattttaagtgatgccaaaataagcagtcccagcaagacatgttataatataaggtcctttccttaaaaccatacctatatcagctttggaaataacgtacctcttaactgcatggaaaatctagaagattcgtggcttgggtctgtttctattcttaccacggtgacacgcaaaagaattttttaaaaaataggtttgttgttatttctgtatatctgtatgggcctgacctcccttttctctgggctttctactccagatttttattttatttttacactttcattgccctttgctctttctggctttcacctaaacaatagcatgtatatacaacagtacctataaaattgacgctcgtgtcactgatcatgccaagaaacctaatgtatggtgaatttgcactagtatttatttcctccctccctgtctctcccctctcctcccctcccttcctttccctcctacccctctttctttgtattattcccctagaaggaaatattcaagctggctttagagaggatagcaattgtaaggtcaaccaagtatgggatggggaccggaatagattttctctgcagatttcacgctgccttcccgggaatttctgaatgttttgcagcctaatgtttagcttccaacattctttcttttttttttagacagagtttcacccttattgcctaggctggagtacaatggcgcgatctcagctcacagcaatctctgcctcctgggttcaagcgattctcctgcctcagcctcccgagtagctgggattacaggcatgcgccaccatacctagctaattttgtgtttttagtaaagacagggtttctccctgttgttcagggtggtcttgaactcctgacctcaggtgatcccgcccgcctcggcctcccaaagtgctgggattacaggcatgagccatcgcgcccggcctagcctccaacattctttaagaaaactgcaccatgagtaaaatggggacgtttttctcttctgctgggacccaggacatgttggactgcacatcagttcattctctctgatctaaggtgttggctgctcttctcccttctccactgggctctgagcttcttgagtgaagggtctgtgggttttcacgctttgtactcgggcccagagcagagcctactgccttcacagaagatgctccacatgtgtttgtagaaggaacttggaagacagtcagttttaaagattttttcactgagggactaagagaaatagaaacagaggggattggccacacctgaagtcattctgtgttcaaatcttggctctaccacctatgatctgggagctgttagaggagttaatcgatgtagttaagactcaatttcttagtatatacaataggtgtaatagtaaaaattagatgactttgatgtgtgtaggtaagcggctagcacagtgctcagcatgcatgaaggactctttcattatcgttattaactgatgtttttaacttatacattgaaaggtggaaacaagcgttgcttctattgaatgacttcttgaaagtgccagtctgatccttgaccttcaggtgcatctctaaattctttcatgtcagggtctctgaaatctgaacacatctcaaagttcccttatgcctggcaggggcggtgtccgactttgttattgcctatgcatgtataaatgtcccaaatgccagcaaccaaacttgcaggatgggtgttgacagattccaggaaagtcccagatgtaacagcggaatattccaccttctaggaaccaaatggctgtgaagtggagagacaggcagagctagaaatattccggacgtggaaatcaaaagtaggtttgcgcaacacaactgcagagccagctcaagaacccagcgccagtggctgatgcttcttctttttttttttttttaatggattcttctaaggatggctgcatcagccaggggcagcgggtcatacctgtaatcccagcactttgggaggccaatgcaggcggatcatctgaggtcgggagttcgagaccagcctgaccaacatggagaaaccccgtctctactaaaaatacaaaattagccaggcgtagtggcacatgcctgtaatcccagctactcgagaggctgaggcaggagaatcgcttcaacccagaaggcggaagttgcggtgagccgagattgcaccattgcactccagcctgggcagcaggagcgaaactccttctcaagaaagaaggaatagctgcatcacttatgctcttgatggtacagaaaatgatctgcatggaggaaatctagacatcagcgattcagagtcaaaatgttattcaggggagagagacccttcatgtgaagaaattttaggaatactttaattattttttcacttacattttatagtatttattgtatgcaccagagtgattggtgataaaaatggaggcctacttaagtctaagagagttcttgtgaaagtgggagggggatgagggttggaaaattgcctgttaggtgccatgttcactattcagatgatggatacactaaaagtgcagacttcaccactacgccatatatgcgtgtaagaaattggcacttgtacccttgaaatacataaaactttataaaaaattaaaaagagttactgtaatgattataaaatgaaaattctacgtcatgagaaagcattgtgccatattttcaccgggagcatttttttttccttaggggaaatgaaaaataatggcatctatgatcttagatttagtaaaacgcagtatcttcttccccagctgaaatagcgaaagggtctcttcaggctcctgggataaaaaccaggatccttcatgtgtctgagcaggcttcccaccatttgactgctgctcctttgtccagacacatttaacaccatctccctgcaccccttcactgggctccgaagctgcgttcacacggcacgtcattggcagctcatctcagaaggttccagctttgcctggcaaattctcctccttcctttagatcccatctctggtagacagagtaatgagccccgaagatgtccaggccctactcctaattccatggaacctataaatatgggaggttacatggcagatggggaattaaggttgcagatggagttaaggttgctattcactcatcttcagattgaaagatcatcctggattatctgggtaggcccagtcgaatcagagatggggaaaagagaggcagatgggtcataatcagagaggtggctgagtaaagaggacttggcctgatgttaccagctttaaagagggaggaagcgtccaggagccaaggaattcaggcagcgtctagaagccagaagaggcaaggaaagagattctctcccagaacttccagaaaggcacgaagccctgctgacctttgattttagcacagtgatacccattgtggccttctgaccttcagaaaataaatttgttttaagccactaatttgggggtaatttgttacagcagccagaggaagctaaggcaccctataatataccctctaaaagcccctttcttgggaagttctccagccttccccattgactctcagaggaccctggacctctcttccatggcattgccatggtttgtcatgttgcacttatttgtgtgatgatttaattaatactcatctgccccactggacgtgggcaggaatagtgtgtggttcaactatgagattcctagggcctaccaccgcctggggtccaagaagagctcagcgagtatttgcagagtgagtgaatgcaggaaggagtcaataaatacattaattaattaatctgcaggagaaagaagggcaaggtactatgaactttaattaaacacatatcccacatccaggtgccagtcagggagctgcgatttaatttgctgctgaatgcacttttgaataaagggcctagaagatgcagtctcgaggaacggaggccggttagagacaggctggcagctttgcctcctctcccaagacaaaggcctccccgcccccctaaatccagcacacaatcagctgctctccctccccctattctcagcaggagagtcaggatgcatatttctttaagggatgctgttgagtttcttctggtggagcgaaggatttgtagcaaaacccagcatgtaactcgagtgttctgtgaagccagatattggtgccaagctaaatttgtgcgtgcagcttctgtttaaggcaattatatagtgtgtaatacccagtagagaaattaagtcgaagtacattttgcccatagagattatcctctcagttggatttattttaaacaagttttgccccttatacattaaggtgcatgcaataaatcacttatgtaataaactactctatattatgtgggaaaaaaaaaaggagctggtggcagggggagagatttcaaattgagctagacctcaggcatgaagggaggggagagagggggaaatgtggaggaagggggcgtttgtgcagtgggaagttggagaaagtacaaatgaaagcctctctgcagtgaacctcatgactgctttagagaggtgcttatgtaataactgcagtggtgtcgctttagaaaaagttacagagcttgtctttctagagcaacctcttggcttatcttaattaccagcagtccatagtgagactggagggaagaaaaaaagatgtaagcttttattaaatagaagaaaatcaggggcagaggacagagggtgtgattaggggtctggggtaaccacaaatctgggcaactggaatttattgtaatggtaaattacactaataataatctggggatgaaaacagggcaggcagtgaaacctgaatctcagctggacgatgaatgagttttaatgcaagtgtatcgacgtgctgtactcctaacacattatttgttatctgaaatttagatttccttgggtgtcctgcctttttttttttttttttttttttttttgagatggagtttcactcttcttgcccaggctggagtgcaatggcgtgatctcagctcactgcagcctccaccttccaagttcaagtgattctcctgcctcagcctcctgagtagctgggataacaggtgcacaccaccatgcccggctagtttttgtatttttagtagagacagggttttgacatgttgccaggctgctctcgaactcctgacctcaggtgatccacctgccttggcctcccaaagtgctgggattacaggtgtgagccaccgcacccggcccctgcctttttattttgctaaacctgatgacccttgccatagcagaactaaagtgatgatgatgattacagcagatcagttattttgagctctgactttgcatgaggccctttattaagtgcttcacttgtgtgatctgatttaatcttcacaagcaaactgggacagagggactgtgcctattcccatttcacagaggtgaaaactgacacttagttttcacccgggttctccctgtctataaggggaaaagacagggttcacaccaaggcctgtctggatccaaaacccatgctcataatcactaagttatactacctcttcgagatgctgatttggaaaataactccatgatgaaacatgtcaagggagactgcctgtactccgtaatgcagaaatgcattagagctcaaaaatctatgctgtttaggaaagaaaaatgatatcgctcagaaaatcatttaaaaacttcctggtgaatgcacccagctcgccaatgcatgccagccacagggcctcacagcacatttcaggagcaagacaattcagaccccactcttccccctgaaaaacctccttccagaaccctcttttgcagtgagcagagataagcctctccaatttacatgtttgtcattctctaactttgagagcccaataaaactaagtgcttagtgagaatcagacatggataagctgcttgtaatttatgatttaatgcagcatagtataaaaataggcaatgaaactgaaaggcaatcaaagtctattgtcacaaggaatgggaggaacggggacgtgatctaacatttgctgagatcctgctgtataccgggaacagaacatatatggtttcatttcatcctcccattatcaccgtgaggcctcttccgcttatctattgctgagtaacaaggtgtacccctcaatttactggcgtaaaacgacaacagttttattacatctcatgattttctgggtcaggactctggatagggtttggctggttgagtctcctcttgcagtggctgttgatggaggtcatttagtggaatccagttggcaggagagctggccttggagagtctaggatggcttttgtcacatgtccagggctttgtcaggttagcagggcagggagggctcagctggtctcagctcgtggctgctccagcaccgtggtctcagggtgattggattcttgtagggcagctgtttcagctacacagcagaagtggcacggccttttctgacttagtctcagaaggcagagggtgtcacttccactgcatctttggggaaggcagtcaccactgtatagtcctgagctcactgggattaaggggaagggacacagactccacctctcgatgagaggagaagcgaattgatgggcagattttatcactgtcctggggcctttgctctttgcccttccctttgccaagaaagttccctgtactctgcaatgctgagtacttctcatccttcaggtctactgcaagtgtcacttggccaacacaccatgccttcccagtctctggtgttactgtctgcatactgtagaccatcatcttgtttgcatacttgtctgttatctctttatcatccgtctacccacatcaggcaattccaagagagaagaccactggttttgtttgatctagtccctgttgagtccctgtgcaccttcagaaccacatctagcaatagaaggcgctgcacggggaattctggaatgaataaaaacgcttggcagtaccgcatggcgagccagtacccgtgaatgctacttcctccaaagagaattcctgggataacagagaatccattcatggctgccaggaggacttggatatttctcattttccattggccctggagtggaggaacagagccgaaaagtacgtggggggcaggcaaagctgcggtcagaggcagaccctgttggtgttggccgtgtcaaccagctttgctggtttctattatagccctggtgtggcaaaggacactgtgtgactgtgagctcaggtcagcattgcgatcccttcaggcctctggcttgcaggttcctgttcaaccctcttaaatatgcttttgaagcccgtacgttcggtccacgccaactcctgtttatactggtgcgaagtgatgcctgctcagattctgggcgtttcacgggaaggtattaaatgtgttttgaaaatacttgaaagtccagctgtgtatgctttattttatatttagccttaaattagagactccatatacctcaagtaataaaaaggcacagcaggcacttgggttttccctcagcttgctggggccgtgcacctatgtgagattttattatttgtaattttgggggggttaatttcacagcttaattctggcctttatgcatttagagctcccctcttgtgtttcagaaaggaggagttgttgttttcttttcacttgagtttaataaatgaaaaaggggaagggagagggaaggaagaggaaaaagcacaaatgtgcttgtttttggatcagcccctgtactgggcacatggatgcagtcagtcctcagtgtaccccaggaaagaggaaactgagtctccatgtggctttctgtctggcctttctcttttgcttgccttgtgctttgaatgcaggcctgatgtttgcctgtggacctcaggatttgtaaggccatctccacccacctacagctaagtttcccaagagccgatctccagccaaagtccaaggttccttgatgacccctgggaggagatgcaacacacagtttcctagaatcatttactccccaggctaagcacagtcacagaaatgaggtagctgtagccaaggatgatggcatagcacattcgtttcttaggcgtgccacgtactaggtggcttcagtcagcagaactgtattttcccacagttttggaggctcaaatttgcaagtcgaggtttcggcaaggccatcctctctctgaaaactctatgggggcgtcctctttgcctcttcccggcctgtaggtatttcctggcaacctttggtgtttggggcatgttgtcacctcattgccatctctgcctctgtcttctcaccaccatcttccttgtccatgtctctctatgtcttcaatgttcttcttataaggacaccagtccttggatttagagcccaccctaattcactgtaatcacatcttacctaagtccatctgcaaagaccctatttccaaataaggtcacattctgaggccctgggtggacatgcattttagggaccctttcaggccaccatatatggattccagagtgaccagtagaacatagctcaggccaagagagaaactcaaccttggtgaagttgcatgagaacagaaggcagccctggtccctgggagaaacccatccatactctggttacccactggccattcctggggacaggcggcaggtgtttagtcccctctctgcaaccatttgcggtcacctcttatgtgctaggcctggtgctcagcgctgagtgaacccatatcaacaaggcatggtcactgcgctagggaagtccctggtccagtggggtgagggtggcagtggctggcaacaaagacaatgagcgctgagattgaactacagaaagcagaagatggggtgacaagtttggcctgcggcaggaaagacttcccagtctttaaggataagtggcatttgatgagttgcacaaagaggagacctgtcctgggaatggaggagaagatgtgaagcgcgggaagtccagggacacacagccgtgcagagacccgggggcctcagcaggttagagtgtctgcatggcaccggcagaggatgaagacagggctggggaggggcatggggttagcctaacaagggcatcaggtgccaggttagagtttcggtttctaagctgtagataacaaaaatttcttgaatgcttttagcccctgatctgagttacgctttttttttttccttccattttccatccaacagacatttgtgaggcactgtatttgttttcaattgctgctgtaaccaatgattacaaatgtaccgtcttaaaaacctaaatgtattatctgacagtcccataaggcaggagtccaacacaggtctcactcggctaagatccaggtgtaggtggggctgggctttttctggaggccctagagggcagcttgtacccttgcgtcttccgtttcttagaggttgcccatcttcatggactcagggtccctttcctccatcttcaaagccaacagcacctggctgagtctttctcatgctggcatccttctggctctctcttcagattccctcttccgctttaaggacctttgtgatagttttgcacccactggatgacccagaatcatcttcctcttttaagatcagctgattagcaacgtcagttccacccacaatcttcatttccctttgtcgcgtaacctaacatattcacaggttctggtgagtgggatgggggtatctctaggggaccattatccagccttccacaggcactttgtcacaggccaggcgctatgccaagcagagaggtcacaatagcaaatgacacagacaagatccttgcacttccaaaacttatgttccagtgagggtgaagggcgttgaagaagtcaacgagaaagtcaagtttttacagtaagtgtaagttgtgtgggtgaaataaaaaaggttctttgctggagaataacaaagggagggacttacataaatagagtaatcaggggagggcccctgagaaactctaaaacatgaggaaagggctcatgatgtgaagaactggaaaggtgttccaggcaaaaggaatggcaaacacagtggccctgagacactcagagaaatcactcaggctgccttcgaaaggatgtattggagaagatgaggccaggggattgttagtaactgttgcaaggatccgggagaaagatgatgaaggccttgtagggcaagctggataagagcacccaaaatatccataaccgaatccccactacataggcatgctactttatatggcaaaagggaatttgcagaagctaagcactttaaaattattatctccttaaacctcactgcagagttataaggaaagcactgttatcagatgaagaagtagatttcatcaagtgactcacccggtatcatatagctgcttagcggcaaaaccaggatgtgaatggagagctctttctcggataccaaagctatttaatatttatcattgactaataatggtagagaaagtaatcatcataacctctgccctttattagtcactcatggtgtcacaagccctttacaaagcactgtgcatgcaaatgattcctcataacaaccttgggaggtagttactttcattgtgttagctatctcttgctgtgtaagaaattaccacaaatttagtatatttgttatctcatagctccataggttaaaagtcctggttcaggctgggacttctgctcagggtctcatgaggctgaaatcaaagcgtcagccagggatggggtcttatcagaggcccttggttattaacagaattcattttcttgtaactgtaggactgaggtgcttgttttcttgctggctgttgactgagggccccttgcagcccctagaggctattctcaggctctcaggccctatccacagatgacctcacaacatgactgttggcttcttcaagactgaaggaggctcccccatgctctgagtcactctcttcagtgagggcccagccccttttaagggcctagcgattagatcagtcccacttaggattgaatcccttttgattaatgcaaaaccaactgcgttcaggcctccatgacatctgcgaaattcctccccctttgcttggtagcctaactcactcaggggggcaaattatcccatcatattcacagttgccgcccacactcaagagaggggattctataggaaatggaagtcttgggggccatcttgaatcctgactaccatagtctgtgaaatccccatttcacagatgttgaaactgagacttagaagcattatgcaccatgccaaaggccatggaaggacagagcttgggcatgctcccgacaccaggtcatactgatgtcactctccctactcccttcactccctccagcacctggccttcacctgaaggtgctgaccttgctgtttgttggtttcagcaaacaaagggagatcacagcacctgtcccaggccttgtcttccagccccacaaacgtgcacctgcagccggagaccagggggccccgatcaggtggcagggcctttaattggagccacgtgtgtataatgagcagcgcacacacacaaaggcgagctaaaaatgtctccacccttctaaatatgggatgccttggccaggtattgagtcagctctgtgacgccagtgcaattatcccgattcagcatcagatttattcaccattaaacatgttctaacttgattgcaaacaagccttgtattatttagagggatccacggagctggcagagggggcagaggtgtccgcaggcctcctgcccttccaggcttaatggatgatcatcttccctgctaaaaaggcccattcactaggtgagtgatgtggaactgtttaatgaaagcaggaagatgatgtgaatgccagttcacttgagtgttacaaacggtttgggcactatagccttaaagtttctcctgctctttgcagatgaatgaaggggcgctttctggaatctttgtggctggggctgctgctctgcactgctgtggctctttttcacaaatgcttatggagctctaactgggggcaaggaactgtgctacggttgggaagagaggagtgggcaaaaggagacactggggcttctgtgactttagaggcccatcatcaaattttcttttttttttttagatggactttcgctgtgtcacctaggctggagtgtagtggtgcgatctcggctcacagtaacctctgcctcctgggttcaagcgattctcctgcctcagcccataggcacatgccaccacacctgactaatgtttgtatttttggtaaagacaaggtttccccatgttggccagccttgtcttgaactcctgacctcaggtgatccacccacctcagcttcccaaagtgctgggattacaggtgtgagccaccgctcctggcacccatcaaattttcaaaggaagaaatggaatggtgcaaccatggtacatgggaaggaggagggggacacacaagactgtacctatcatgggggcttcgacctcatctgggaaggtggttggagagagtgagtcctgacctgagctttggaacttatcaagttgagagagaaatttgataatttgtctattaacgtgtgaccttgggcaagtcattgaccttctctgaacctcagtatcctaggacttcagaagcgaaaggaagaataatgggtcttgagtatgcctagaattgagcaagctgctatgcttgcaaaggccttggccagctgctcacccaccatgtccctctgttcccactccaccttactcatgcctagacttcttgctttttaaaaataatccacccatgaaacaagtgtttatttacaaggctggcttccccaggaggctttcacaaatgcttaccgagcatctgctgtgtgccagacaagagtgaggagctggggactcagagaggagcagacgagggagacactcacattagagagtggcgtgtgctgagggaaggtgcctcaggcgacagatgggaccagggcctttaactcagtggcagcttcagagacagatctggaaccccaggactcaaaggacctatgtttgctaatcaagtgaacacggaggacctgccactgggcagggcatccctgaccaatccacaggtgatggcgggacagctccaggccctggggatcccccagggaataagccagattaaagcccctgccctgtgaggtgtggcaaagaaacagacaattcatgaaataaatatatgataaataacatatgagaaggcagggagtggtatgaaacaaatcagggaaggaggagacggagaagttggagaagacagtggattgtttctctgggtggtcaaggaaggcttccaggcagaggaggtttggccatgggtaccaaggggtagagatgggaaccttccagggacatggacccgatgctgccagcagaggggaaaccatggccctaagggcagagcacactggggcgggggtgggggttcagtgacagtctggtggcctgtgtggtgaggagtgcgggagatgggaacagagagcgagagggcagacggggtcatgttgtgtgggacctcggaggtcctgccatggctttggtttctacttggagagaaatagggaggtttgggcaggctctgagtagaggagtagcacgatctggcttacgatgatttctaacatctcaccatctttacttctgtatataaatatatgataagtatacctttatatatgtgacatgtatctttacatatgatatgtatggttacatatctactcactcacacatccacacacacacacacacacacacacacacacacacacacttttttggaaccattgaaaagttgcagacatcatcacggctcaccctgaaattccttagcaggcatcttctgagaataaggacattcttctatgcaaccatttcacatccacactaagaaaattaacactattacgtagtattatctaatatgccctctacattcaaattttcatgtctccaatcctgccccctttggaacttctgttggtgttcgatctggaatctgagaattcccttgcatttggttttcatcccccatagtcttcctttttttattttttattttatttatttatttatttatttatttatttatttatttatttattttttgagacagggtcttaatctgtcccccaggctggagtgcagtgacatggtgatggctcaccacagcctcagcctccctgggctcagtcgatcctcccacttcagcctcccaagtaactgggactactgtgatgtgccaccatagccagctattttttttgcattttttagagatgagtttttgccgtgttgccgaggctggtctcaaactcctgggctcaagctattcacctgctttggcctcccaaagtgctgggattacaggcatgagccaccatgcccggcccccttttttaaaaaacaaaaaaacaaaaaactcttttgtgttttagaaatggggtctcactatgttcttcaggctagtcttgaactcatggcctccagtgatcctcccgcctcagcctcctgagtcactggaatttcaggcatgagccactgtgcctggcctctgtcaacttccttatctagaactatctttttcctctattgttttgtccctcacttctgaatagttcagggatccctctggctactgtgttgagaataaagtgtcaaagccaacagtggaagcgtggacactgggtaggaggcttttgcagtgctctcggcccgcgctgtccaatagaactttctgcagtgatggatgtcttctatctctgccctgtccagtataaaagccacaagccacatctggctgtgtggcacttggcatgcaactagtatgacatcttaatttttctttttgagatggagcctcgctctgtcacctaggctagagtgcagtggtgcaatctcgactcactgcaacctacacttcctggattcaagtaattctcctacctcagcctcccgagtagctgagattacaggtgtctgccaccacgcccagctaatttttgcatttttagtagagatggggtttcaccacattggccaggctggtctcgaactcctgacctcaaaagtgatttgcccaccttagcctcctaaagtactgggattacagacaagagccactgcgcagacggacatatgaatttttaatttgatatcattgtgatcaatttgaagatccacatatggctgagggctactctaatgagtggtgcagctccaaggcagagagatggctgtgattaaccaatgaatgagggaacaaatatccaggcagaatgaatagtctatggaaagggctggaagttccacaaagcaggacgtatacgtgcccttttttcctcccctggtggccagccagcccctgaaacacagcaggtattcggtgcagccttctgttttcttccagatcctttgactcctgccccaccaacatggcccgtggcagactgggctgctgtttgtaagcctggctgaagaaaggcatcacaaagaaaatgccaccagcaggctgggtgtggtggctcatgcctgtattcccagccctttgggaggccgaggcgggtggatcgcctgaggtcaggaagaacctgggagattggaggttgcagtgagctgagatcgtgccactgcatgtcagcctgagcaacagagcaagactccgtttcacaaaaaaaggaaatgctaccagtgagcaggaagttggtggtcctccagaattgccctgttgagggtatctccctgccctggtctgaaagctgccacttgccgcccaccgcacagccccagggctttagctcactgtgcaggaagaggccttcctctgtgcatcctcccacagggtcgagagtgaatgccttgcctttaaaaataaaatgcatacgcctgtcctcatgcgctctgatctgccagcaggctgtgctggggagtggtgagtagtacagggatgtgtctgaccccaggagaactgccccgatccctatcttgtctctgctcagttctggtaactcttttatcttccctggagttatttttttcccttctttgtttctctttttctgtgtgctcttctaagagtaaaacgcatgtccccccatgaagtcactcaaagctcaggcgtgtgcaacagggacagcaaaagcacacacaatgatggccagagacactgctcagtgtactgtcttccaccgggacagcccactcaccaagggttaggtcctgtgctgcctgggtcccgggtctcctcggaggtcggtttgcatcacgtggatacactaatctacccaagttgacttggagaaccaatctgaaatcagatgggagctcccggaagcaaagcaattgcaggttcatttgttacttttattgtctcatttcttcttatttttttagcccaattgcctcctacatggggaaggttggggtcctctttattctacttttcattctcgctctgccgccctcccaggtgtttgtaatcacatatttttcatttggtttccgggtccagcgacaagaacaccagaaacacctcctccccagagaggaagagaggatgctccgccgcctgtaaggattttttgctctcctccttttgtcagttggcatgcgatatgcttctcaggcagtaatttagagactgtcaattcctgagagccgctggggaactgagcaatcgtctgcatttcgtcgctttagcccgagctgggtctttgagctggcagagaccaagatctttttctgggaagggatggtcctatttaaggaaggccctggattttgtcaagtttgaaaggttttcaacatcttcccgagatggtggtcatgggagtagtggttagggtggttatgacgcatgggacgggagaataccatgcccacccggtgatttataccaaaagatgctttcctggggtggttctgctggcagtcgggcagtgacatgttattaatgttttcctgttttctattgtccccgaatggaaaaacactgtggaacctttaaattttctcaagctgtctatgttttcctggatcgtccctcaattttccgtggtatgaaaaatgtaaatgttgctacattcagttcagggaaatccagccgttgctccagatccttctaagatttttcaattccagagatgttttcacctggaagattccccagatttggcaaaaacaacccaactcctagccactgctttttgagcagctactcagtgcctaagactttgaatagtttattaatcatgtgtcactgcagcaaaggggacatttcggccctgatttcagagatgaaagaaccaaggcatagaaattgagtcactttctggagtgtacacaactagtaagtggattcgagttagttttgctctattccaaggctacttactatgctatttttggtttcctacttttgttcaacttatatttatctgattatctgattctcttttacaagcacttagtgagcatcagctgtttcaatgagcatttatttactgatacctgtggtggcacccaggaaggactaggaatgctctgtgatatgtaggagaaggatgtatccactgggcaaaggtacctgcgagggatcaaagatggaaaggcagaaatccaaggactacgtgtgacatgaaaggggcctttctcctgctgtcatcctgaacctctgtctttcaaatttggatgtgtcgggggccacaggacactactgtgcatttgcctgtgatttgccattgggttggagtacttctcctgagtttctgcagtgttctaggtatggtcttaggccctggaataagacagtgtaggaaacacagaaggtgcctgatttcctgggcctagctaaggggaaaaagcgagacaatggggtcagaggaagctcagctgaacagatgaagttgagatgaacagaattccagtgccaccatgatttccagccgtgtgaccttccacatgctttttgatttttcttgaactcacttttcctttgtttgcaaaatagtaacaatattttccttccaagtgatggtgaggatttaagagttaacctgagtgtctgctgcatagtaggtgctcaataaactataacgtctttatttcttttccttccaatgagaagtcacttcctggagggaagccacctccaggaacagtcctggttcaactcatgaggagggtcactggttgggttccatattcatatctgcaaccagagttggaagcacaccactgtgggattagtcatgtccctagtccctgtctccgtatattttctccttctcttattagtttatcttttccaaaatgggctgtttcgtctctgatcctgatttatttttattttaattaaataatttatttttctgagacagactgtcgctctgtcgccaaggtggagtgcagcggtgtgatcttggctcactgcaacccccgcctcccgggttcatgtgattgtcctgcctcagactcccgagtagctggtactaaggcatgtgccaccactcacagctaattttagtatttttagtagagacaggatttcgccatgttggccaggatgatcttgatttcttgacctcgtgatctgcccgcctcagcctcccagagcgctgggattacagacgtaagtcaccacgcctggcctgatcctgacttagttacggttacctctctttgtatctctatatgttctcaaattccaacctgtctttgtaatcctctatttaagctatcgattacctccaaaaggccctgaatgtttcagaaagaaaggatctactggcagcttctgaaggcttctgtaataccttgtaccccaatgagtacaatgaaatcattaggggttctttcctctcctttggaatgaaactgctgcttaacttttctcccactgatgagatgcggtgatgctgtcacagttgggtggttgctcctcctgcagtcttcttcccattgcatgttcactctcttccccacttgcccacgagcagcaactcctgtttcttgtttttttccttttctttttcttttcttttgagacagagtctcgctccgtcgcctgggctagagtgcagtggtgcaatctcagctcactgcaacctctgcctcctgggttcaagcgattctcatgcctcagactcctgagtagctggtattataggcgcacgccaccatgcccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacccagtccttcttagaagatgatgacctcaactactgctttttaaagaagactgacgtcgtgttaactgagtttcgataacgcccctctgtgtattttctcatcgtcttattatgttttccaaaataggacctggggtcgaactcctgacctcaggtgatccgaccacctcgacctcgagaagtgctggcattatggatgtgagccactgcccctgccctagatggtatcaccttcaaagcttaattaggaagaataatatgagcactgagtgtaactccaggtcgggtatattatgtccctctgtgttctctagctagttatctatccatccatctcttgccttgtccacagaagttacaggtaggctgccgggcgcagtggctcacgcctgtaatcacagcactttgggaggccaaggcgggcggatcacgaggtcagaagttggagaccatcctggctaacacagtgaaaccccatatctcctaaaaatacaaaaaattagccaggcatggtggtgggcacctgtagtcccagctactcgggaggctgaagcaggagaatagcgtgaacccgggaggcggagcttgcagtgaaccgtgatcgcttcactgcactccagcctgggcaacagagcgagaatccatctcaaaaaaaaaaaaaaaaaaaaaaaaaaaaaaaaagaaagaaagaaattacaggtaggctagagcacggatgagcaaactgtttttataaaggaccagagagtatatatttcaggctttgcaggccctatgacgtctgtcacaattcacttctgcctttctactgcaaaaacagccatggacaattcataaattaatgtgcatggccgtgttctgataaaagtttatttatagacactgaaatttgaattccatatgtcatgaaattatatttttttgattttttttttcataaaaccagtctaaaaaagccatgggttattttgtcatggcacgttttgatatgaatatttccacccccattatttgcataacaaattacagattatccagaacaggtgggctgtacataaacaggctggtgggctggatttgtcctgtggactgtagtttgctgacatccaggctagatccttaatatacaatgaagtagtaaaacacatgtaaaagtaaaaagcaggcgaaatagaataaaatacacatttgcacaccacagtatccaaaaaggttatgtactggggctaaagatttggcttggagtttcctggtagtcaaggcaaaaaagggaaacaaaactagttacagagtttctcggacctatgagcaaaaggatttccatttctaatcggaggcagaggtatcatggccttcaagaatcttccggttaaacacggtactgaaatttgattttattgtctatcgttgagtccctagttattttgcctttaccaaggctagttgcagagtatttgttctagtatgtaaaatcagcaatcagccattttctggtcattgtaatggtgtaaattatatctgacagttgttaattaaatacctactcatgctttggagccaaagccaaatagtgctctgtaaacattatgatttgtcagtaatcaatgtgatttgtataatttgtgagcaatcagatactttatccaaaagcggattattgacctctgtgcccatcttgggagaaattgccacttggtctgtgtctacacagacccaagaggagaagggatttgacaatggtctgattaattgaatcagtggtttgggggagtgggctgtctgtattgatccaattaaatagataattgtcagaatcgaggtcatgtctataagacaccaccatttcaaagccaaagagattgtttcaaacatatcatgctcaccccaatcaatgtgggccgcctcctccacatgaaatcaaccagaaagtgattgattctgcagagccataaaccagggtctttcctattttcggcaagtggttctgtgctaaatacagtgctttgaaatttttgttccccatagacccaaggatgatgattcattatgcaaataatggggatagaaatatacaaattgaatgttagggctgggcgtggtggctcacccatgtaatcccaacactttgggaggataaggtgggcggatcgcttgagctcaggagttggagacaagcctgggcaacatggcaaaaccccatctctacaaaaaattttaaaaatttagccgggcaggcatggtggctcatgcctgtagtttcagctattccggaagctgaggtaaggaggatcgcttgaacctaggaggcagaggttgctgtgaggcaagatcacaccactgccttctagcctgggcagcagagtgcgaccttgtctcaaaaaaaaaaaaaaaaaaaaaaaaaaaagaaaaaaaaaagttggaatgacatcagactcaaaatgtgtcacttagcagtggggatgcaattctgagaaatgcatggttaggtggtttcatcattgtggaacatcatggagtgcacgtacacaaacctagatggtgccgtctactacacacacacttaggctgtatggtctagcctcttggtcttagcctacaaagctatgcaacgtgtgattgggctgcgtactgtaggcagttgtaacagtggtatgtgtatatctcaacatatctaaacatagaaatagtacagtaaaaatatgatattataatctttgggacagccatcatatatgcagtctgtcattgactgaaagttgtcatgtagcccatgactatcgtctcttttaggggaaaaaacaaaagcagaaagcaagcaagctggtatcctgcgtatctgtgagctcaggaagcagctgcatgtgcatactggataagcaagggagactccaaccccgggctctctaagggtgtaattgttgcaggcacactgaggggcagacctctgggtcttggttagtggtccagagagggaagagagcaaaggtagaaggcttgagtttaatttctgcatcagactcaaaacccagctaatcttttctagctggtcatttcaacctagctggtgatttcaggctagttaagcaacccctcggatcctcaatgttcttttccctctaatgggggtaaatatacttaattcactgggtgactgcatccataccaagcacacagccgtgatcagttagcctctcacttctctactaatccccactgtggggaagagctcatcattaacatgccttatctgacatgtggcaataacttctgcctttcttatgtcatctgcatggttgcagtggatagtcactggacaattgatgaacaactactacatgctagatctctccctggggagagtgcttgtctttgaaacagtcaaaggaggaaggaagaaaagagaggcagaacaattataataaagcaacttaacccattgagagacataaggatgctgcaaggcgcagtgctggatggagaggacagtgcctggggcagtcatggaagacttcttagggaggtgactttttaaggggttttgtgatcaaaactatggagtcttaagtccaaccagtggttatgaattccggctctgccacttgctataatagctgtatcaccatgagcgataacttaacctctttgtggctcagtttcttcatatataaaatggggatcatgatagtctctgtcccaggggagttaggaggattaaatgcaacagtaatccaaccacagtatgaaaagacaggctagcacatacaacacaatctataaatgtttgctattattgtcatcctttttattagtatatcatggtacaagtttgctgggtagaaagatggcgatggggaaggggacatttcaggccaatgtgataataaaatcaacagacaaaagaagggagagtgtggtgagtaggataaagctctgtacagatgcaaggggaagggtgttgatgtcaacacgcatgcagcttcccacacgtcgtgtggattcttttctgtgctctccattacggaatctccctgaaaataagtggtcactttgaggtttgatggtttaattctaccacaaaagtataaaaagcaggcagcctgctgtttatagatttttttttaagtgagggagtatgttaatgagcttagattgtcagggagctaaggggattcttgacatcaaattgtgggtagctaaataggtcaccccaagttattcagcatgggtggaagaccaagaggatacacaagcttcaaaaagttttcagggagagcaagagatgttcatttacctcattcaaaatggaatctttaatgctagtccagtgcttggccagtacaaggccattatatatttgttgaatgaatgaattcgtgaatatgtttataaagacaaggaaacgccattctgcaaatctacatgcagtaaaatagtttttcagtcactttgccttcatttgtttgacattcttggaatatttgggctctacaaggtgctagggtaaggcacgcaggatgcaagattagcgagatattgtctctactctcaagaaactcgctttctttgggaatcatcacctgtttttgtgtcacggaccccttgggcatttggtgccctttgcagaataatggttttgaatacataaaacgcacgggatcacagaggaaaccaatcatattaaaatacagttgtcaaaatattaactcatgggatctagtaacaaatgttcttccttcttaacccattaaagaacacagctcatggtcggtccattaactactaattatcaaaacagtgggtgaaaacgatgtttggaaatagctgcgactctcgcgtgataggaaaatatctgtgatttcgattgcgacaaacacacagatgcttctcacacgatcgcagtgcattgcctaaatgacagtaatgctaaactccagtcagatgttagtgaaaaataaagatgtaacattttggccatctgtgtacaccccctctttctagggttccagccacagaccctcagattaaggagtctgcactagcttgtagcttgttcaatcacacatacacacaaaaagtgccagttataaaggagcaggaggttttctggagccaggatgagctgggaccaacaccagcaactgtatcacccagttcactgagagttaaaatcacccatgtgacgttctctctgcaggcacatagtaagtgctggataaatgatagggattgatattgaccagctttgacacatgaataggagagggttaggcaaagacaaagagagatggggatgccaagtaccctctgggcagaggaaaccatgagtgcagaggcacgtaggcctgaaacaggccagaaagcaccaagcaatttgcttttgctggtgaaggaggtataaaaggtagagttgcaaagactggggatggagctttaggctgggatcagcgcccaatgggctgggatgacaagtgcttggggcacattggcagctgcgaaaagctcgctctgatgcctgtgtggggacagattttgggggcaagaggactctccagcaatctgtggcaaaaaaaaaaaaaaaaaaaaaagtcccgcttgttatcaagcctactggcttatctgttatttcttggacatgccccagtcgctagtaaataaagctgtctactttacattttgtctctgtgcccttttacagccttttctcggaggagctgagtcccattatattccgaaagcatatgttcccgatgattgctcattctctttccaataatatctttgcaggacaaagaggaatggggaagggaacatacttttaggatgtcagtcccagttttaattacaagtgttcctggttgtggcattcatgtaattgggggctgatttatgccaaatgatatgcactgatgtaaggggctggagcccaagagggaggggaggccaagaagaggcagtggccccccaccaagcccggaactgaggtggcacatgtcagcggctttgctcagaagcacccagggatgatggaaaaggcaaccgaaagggctcagcttctgcagatagagtctgtgctttgcactttctggctttgtgacctttctgcaggttacttctctcccctgagcatcagtttactcagctgaaaaatgcatctgctaataatacctatggcatagggtttggggaggattaaataagataatgtaaatagagtttagcgtggtactgtgtatatagccagcactcactgctgttggcttattgaaaaaacaaaaataatacctacaataaccacaatatagcaacagcaatcatgttcaagtctgtatttggtttaaggagggggaatgtgacccgggggctctgtcattagatatatgcacacacttgacctaatggaaagcttgaaagcaattggatgggaaaacagtccatcttgttggaaggctgtcaagctgtgtaataaaagaattactgttctccctttgcatttatgcattgcatgtctctgttgaattcagagtgctttatagacctctgatcagcttccagcatcctcttggtatgagttctagggggagatgaggaatgtgcctaattcccttgagtgatttacttggtgttaccctggagttgtgaggacaaaaggatggggctgactgagactggggatgttcatcacaaagtgttcaggttacatccaggctgattactggccaggagactaggcattcatagtggggcgtcctttaaggtctgaagaggacagtgaccatccaccacaggcaaacatgtgtgtgttaaaaaggaatgacgttttggtctgtgctacaactgggatgaacctcaaacattacgctggacgtggtggcttacacctgtaatcccagcactttgggaggctgaggcaggtagatcacctgaggtctcagaagttcgagaccagcctggctggtggtgataccccatctctactaaaatatggtgataccccatctctactaaaaatacaaaaaaaaaaaaaattagccagacatggtggtgcaggcctgtaatcccagctactcgggaggctgaggcaggagaatcacttaaagtcaggaggcagaggttgcagtgagacaagattgtgccactgcactccagcctggatgacagcaagactccatctcaaaaaacaaacaaaaaaaacattatattaagtgaaagaaaccagatgcaaaagatgacctaacatgtgaatctgtgtatacaaagtacctagaataggcacctccaaagagacagaaagcaagctagtgattgcagggggctgggaaagaggggactagagaatgactgctaaagcattcaaggtttcttttggggttggttaaatggtctagaattagatcgtgttgatggttgtacaaccttgtaaatatactaaaaaccactgaactgtacactttaagtgggtgaattttattttatgtcttatttatttattcttttagggacagggccttacgctgctgcgtaggttgtggtgcagtggcacagtcacagctcactgcagcctcaaactcctaaggtgaagagaccctcccaccttagcctcctcagtagctgagactacaggtgcgtgctaccgtgcccagctgatttttaaatttttttttctttgttttgagacggagttttgctctgttgcccaggctggagtgcagtggtgctatctcagctcactgcaagctccgcctcccaggttcacgccattctcctgcctcagcctcccgagtagctgggactacaggcacccaccaccatgcctggctaattttttgtatttttttagtagagacggggtttcaccatgttagccaggatggtcttcatctcctgacctcgtgatctgcccacctcggcctcccaaagtgctgggattacaggcatgagccaccatgcctggccctgatttttaaatttttcatggagacagggtctcaccttgttttccaagctgatctcaaaatcctggcctcaagcaatcctctcctctgcctcagaaagtgctgggattacaggcgtgagccaccacacctggccgctggaaatacatttctaaagaggaatgggagtcaggctggtgaagaaacacgtgagtgtgggatgaggatggggacacagagtgatgtgaggcctacacaacaggagttcaatcctaggacctgagctgatgtaaatgaagcaccgccaggcccagttggggaggaccttgtgttcctgctggagagtgagagtccctccctccccattccactcccaagagcagtgaagagtcaggaaggtgggcttgttttgttttgttttgttttgttttgcttgttgagcaagggaatgcggttcccctgtgtcggacttgtttcagaaagacaatgtcactgaggctggggcagggagattagctgagaggctcttgcagttatctgggaaggagctgtccataaaggcctgagttaagacagtagccctttgggttcgatttagtggtggctccccaaaagatatgttcactggaacctagacatttgagaaaaagggtctttgcagataagttcagttgaggatctcaaaacgaggtcatcttgggtggaccctaaatccaatgacaggtgttttcagcagagacagaagtgaagaaggcacagaagagaaggcggtgtgaaggtagagactgagatcggagtgattcccccacaagccagggagcactgagggctgctggcacccccagataccaggagaggggcacaaataggttctcctcagagcccccagaaggaactaagccttctcacacctagactttagacttctggcctccagaatactaagaaaataaatttctattgttttaagctaccacacagatgcaggaaactaatataccctttaatgattttctccatggcctttctgataatcctttcatccttcatctcccctgttgccgttttctttgctttgctttgcttgcttgctttttttttttgagacggagttttgctcttgtcgcctaggctggagtgcaacggcacaatcttggttcactgcagcctccgcctcctgggttcaagtgattctcctgcctcaccctcccgagtagctgggataataggtgcctatcaccacgccgagctaatgtttttggatttttagtagagatgggttttagccatgttgtgcaggctggtctcaaattcctggtcccaggcgatctgcctgtcttggcctcccaaaatgctgggattacaggcatgagtccccatgcccagcccctgttgcccttttcaaaacactaagtgcatcatgttaaccttccactcgcttctttaagtttcctcactccttttaggtgaacaacccaaaccctcatatgccctagaggcccttttcagccctgttgacacttcccttctctgtgctttagtcaccctaccctcggtcaactcctaactcctgcctgccacagggcctttgcacatcctctgccggggaggctctcccttcaccttcattaggttatcagatctcagctcacacatcacatcttctgagataccttccagactcccctggccacggtcacttcctttgctgtggactctctgggaactgtgtccccttccttctcacatcagcttgcagttctgtacttgttcatgtgatcattgatcagggtccattttctgctccagacaatgatctctatctagaaagaatcatgcctgcttttctgcactctcctgcctctaggggagagaacacagagcctggcatgtggtagactctttttttttttttttttttttgagatggagtctccctctgtcgcctaggctgcagtgcagtggcgcgatctcagctcactgcaacctccgcctcccgggttcacaccattttcctgcctcagcgtcccaagtagctgggagtacaggcgactgccaccacgcccggctaatttttttttttttttttggtatttttaatagagacggggtttcaccatgttagccaggatggtctcaatctcctgaccttgtgatctgcccacctcagcctcccaaagtgctgggattacaggtgtgagccaccacgcctgggcggcacgtggtagactcttaatgaatttttgctgaatactgagtaaataaagaaaagttaacacagtggagtccaggtacagtggctcatgcctgtaatcccagcactttgggaggtcaaggcaggaggatcacgtgagcccagcagttcaagaccagccttggcaacatggtgagaccccatctctacaaaaaataaaataattagctgggcatggtggtacatgcctgtagtcccagctactcaggaggctgaagtgggataatcagctgagctggggaggttgaggctgcagtgggctgtgatcatgccactgcacttcagcctgggtgacagagaaagactccatctcaaaaaaaaaaaaaaaggtagagatggtggagtggtgacatttggtagataatatagctctgcagaacttttcattgcaaaatgaaaattcttcattgttattataattacttcaaggagcaaggccattttgtgtaagctatcctgggcctccctgcctcccattttacaccctgtttattgatactaagaagagcctccaactgaataagaactaatgacttctgcctgccatcattttggaatgtccaattccccgttctggagagcctttgattataacatcagcctgtcatttggacctctgacctgaattatatgaatctgaaaaatctcttcctttcctatcgtgaattcggtcattgttataagccaagctttgcaaaggtggaacaccttggagatacttatctcctccttactctacccaagtaatgactcatccttttatacagaatgtctcttttttgatttagatgtctttttttgatatagatgtctcttgatatagaagcatttctcgggatggtttttgtggttgcctagtgtcttctaaagacccctgaacatagcatagaaacagcacgtgtcttaggcttggaatgagataatgtctcagtgtttgagtagaattagggagtttgctttattttcctttgtttttcttttttgttgttgtttgtttgtttttgagacggagtgtcgctctgtcgcctaggctggagtgcagtggtgcaatctcagctcactgccagctctgcctcctgggttcacgccattctcctgctctgcctcccgagtagctgagactacaggcacctgccacgacgcctggctaatttttgtattttcagcagagacggggtttcaccgtgttacccaggatggtctcgatctcctgacctcatgatccacctgccttggcctcccaaagtgctgggattacaggcgtgagccaccacgcccgactgctttattttcctttgtgttcctaatacctggcccagtgtctggcaaatggaaagttcccctggatgtagttgggtgacactatgagtgtatcgttaggcatgttcaaaatatagctaaattcagtccagacattctacctatgttttcacagaaacatgaggcagtgtacagcgcttatctgtggcatttgattaggacattttactgaagagttgataaaaaagcacaaattgtaggctgcaaatctatcatttttctttcctccttcttcctctccctccctcccatcctttcttgctttcttccctcctctctccttccttccctccctttccagcttaactaaaattttctgatacttttttcctgaattagggtatgttttggggggaaaaaacgcttcagtgcgtgtttctttcgacattacacataagcccccatggaaagcaaattgaataaatttactctctaaacttctttccacaagagtaggtttataatttattttctttacattatctggataattacatttggtttgcttacatagatggaggcgaatggttttccaatcttcaaaccaacctatatcacaaaagcattctgaaaactgggaagagatcacttcacagtttcctgaaccactagaaaaaaaaatgttcataaatttatagccgctgacattgaagttggagaaaagagcatatctagtacctatgctatgtggagaacactctccatgtctttgaaaaataagcacaatacaaattatatttgaggatgacctgccaaagggttgattatcctggaaacatgttttctcaatggtccatttgggcaaacaggccagctgaggtatctcaggatagcaacaggataagcagaatcgattgatgaaggagggagcctacctctggaggccccaggctgggactttgggtacagatgcacaggagacctttgccccaccccgtcacggctgggcctactcagttccacgtctttgagttttcacgcggaaactggatgtttcttacatcctcagctgcaggcatggggaagagacgcacatcagccattaagaaaaaggtatgcagtctacatgcctgttaatttcctccacatacacagtaaacccatcatgtccatcagcaccattgtcaaaacatgtgtgcaccagtaaagggttctgatgtgtgataaatttatttagctattactcatctgaagttatactattttaggatcttggggcagtgaggactttggaaatggaacaggatgctcctttaagttagggtaaaatgaagtctataaaaactgtttttctatatcctcctcctaccccacaaagaaagttagggtaatatattcttatataaaattgacatttttaactttaatgagaaattgcttgtcctttaaactttaggcattgatgcgcttaattatgcttttcaacaagattttgcatttttaatatttccttttagagcttccaggaatctcaattattaattgtaccctggatttattggtctttggactctcccgctagtataaagactgtagattcatcaaacattgtttactgtcttcaaacttcaacagtgttttaactatcaaatagaaaatcgaaaggaagcataaacgcatatggtcactttactggtataataggggccaagagccgttgtgttttataatttcttgatgatcctggtggtaggtaagccaaccgctatgaactctgatgagctctggtttaccccatagtccaaataaagaatggtttctgacattgtatgaccaaaaaaaatagcatctgcccaaaagatgctatttataaaactgttacaaatggagcttattgttcaccagaattttatgaataagtaatgaagtctaattttccgttatcatagccattggttaaaaatgcatgtctgttaggacattgtaattattttgtattacttaggaaaacttttatgattctactcttttaatttttttaataattactttatgacttcttcattagggtttctctcctccagtgcgtacgcagatcttctgaaaaggaatctgacaaatttagttgctgcatttttctaaattgctttcaagactacccagcacttcagatacttttcatggcccttttttcccaaagtgttctccaggatgccttttgatctgcacgggcaatcccattagcagtgatggcttaaggttcccacagaaactctgccacagaggcactgacaccagaccaggcgtgatccctaacagcttgctgtaccgactcatatgagggctgtcttggtccgtctcatttaaggtttggcttctccaaagattagacacccttgttttcgttcaacctttgtttggctttgaagcatcatgcacttgggtcttgaaatcttgggctcaccgctgcttgtaccagtatcttctaccctccggttgtttgtggccattatcaaacaaacaccatgccaactaggtgtaaatgcagactgatattctgaagaatccaggaagggctgggcatggtgcctcattcctgtaattctagcactttgggaggctgaggcaggaggatcgcttgagcccaggagcttaagaccagcttagggaacatagtgagacccctgtctctacaaaaagtaaaaaataaaataaattggctgggtatggtggcacatgcctgtagtcccacccactcgagaggctgtgatgggagaatcacccgaggctggggaggttgaggccgcagtgagccgagatcgagtcactgcactccagcctggacaacagagtgagaccctgtctcaaaaaaaaaaaaaaaaatccagtaggaaactatataaacactagggttgctttaaaatgtcaaggccaactcttatgatatgcggaagccttcgcccccttcttgagggtgtttagggattagatgagtgtcccatctgggtttcccatccctgcagagcccacgtgtggggtgctgagaggtacgtggtgggtgactccctggggagcactgtttggtactgatcactgtcccatcctggcactgcagtcctgggacagtctacacagctcctgcctccttcttttcttcaggattatctcgagttggtttgcaaagtgaaacgcattagacatcttcaagtgggctgaagaaagggactcaatttttgtgggtccatgttaatgtaattcttatgaatttgagataaagtggtcattaaagcctagaaggaagggaaaagctacacccccctgtggatgtgtatgctaaacttgattgatctgggcatatgtggaatttttacctttgttttgtctttatttatttttaaaattgaggtaaatttacttaatttaaaatttatcatttaataccatcttttttgaatggttaaatagtggatgtattttttctagtttttttgttttgcttaataggctctctctctgtctctttctttctatatatatatataatatatagaaagatatataatctatatatagatatctatataatatatataatctatatatgatatatatatcttattatatattatatatatagatagatatctatatacagatatctgtatacagatatctatatatatagatatctatatatatagatatctgtatacagatatctgtatatatatatagaaagagagggaactgaacgggatgctttttattttgggctgttattaggtagactctcctgggacattctacacagctcctgcctccttctgtatgtaatatatatattatatatatataaaatatatattatgtatagataatttatatataaatatgtgtatatatatatttgttagggtaaaacaaagtctataaaaactgttttcctttgtcattgcccccaccaaatatttatatatatgtatatacacatatgtatatatgtatgtatagagagtctattatatatattacatatacataatatatacataatatataatagactctataatgtagactctaatatgtagtctatatattatattataatgtatgtaatatataatatattctatgtaatatataatatattctatgtaatatatattaatatgtagggaatatgttacatattatgttgagagtgtatatattatatatgggtttctatatattataataaacccatatataatatacataatagactatacacatatacagctaatatatatacacaatagtctagtatatattatacatgtaatatactttccatacatacatatataatttggggggcaaaaacatatatataatgaatataattatataattcatataatatatgtaatagagcgtgtatattatttacatatgtatatatatatatatacacacacacacacacatttcaactttcttgaactcctgaaccagccttagattgcctagtaccagggttcttctttttttaaaaaatttatattttattttaagttcaggggtccatgtgcaggtttgttatataggtaaactggcgtgatgggggtttgttgtacagatgatttcatcacccaggtattaagcctagtgcccattagttatttttcctgctcttctccctcctgccaccctccaccctttggtaggccccagtgtcttttgttcccctctttgtgtctatgtgctctcatcatttagttcccacttataagtgagaacatatggtatttgcattttctgttattgaattaatttgctaaggataatggcctccagctccatccatgttcctgcaaaggacatgatctcattattttttaaggctgcatagtattccacggtgtagatgtaatatatatataatatatatataaaatatatattatgtatagataatttatatataaatatgtgtatatatatatttgttagggtaaaacaaagtctataaaaactgttttcctttgttattgcccccaccaaatatttatatatatatacacacatatgtatatatgtatgtatagagagtctattatatatattacatatacataatatatacataatatataatagactctataatatagactctaataattattttttaaggctgcatagtattccatggtgtagatgtaccacattttctttatccagaataaactattttttatactggttttaggctcacagcaaaatcgagtggaaggtacagggattttccagatttcccctggccctcactaccacatgcgtagccacccctttatcaacatcatgttaactattttaaagtggacagttgagtggctttaagggcattcatattgttgtgctaacatcatgaccatccatctccagaatgattttcatcgtgcaaaactgaaacgctgtacccacagaacactggctcctcatcacctccccaagcccagcccctggcaaccaccattctcccctactttgtctatgaattcgactactcttggtacctcatataagtggaatcacacagtgtgtgatgtgttcttttgtggctgacttatttatgatactggattctcagcatcatgggagttaggactgtctgtcgcaccatcaaacaggcatagctggctggctagaccatgtcacagggatgttggaactgggtggcactgactggcccagccaaggggtcacgcaggggactcctgattcattcctggggaaagtagttatgtcaggaagcacaggctatggctcacggctgtggctgtgcccacgtggtctgtgtgggctggtggtaatgggccagggaactgaatgggatgccttttattatgcactcttgacattttttatattaatctgttttcttctccatctataacatttcccacatgctacactgaagggatattttaagcattaattctcctaaaaagcctcatgcccaatgtaaaaatagttcactgtctcagaaaaaggcactctctataaatgaaaagcaccattattagtaatgtcaataactttcctgacatccatttgggcattgtatatgttttgataggattacataaataatgaaattgtatgcaaagcatcagaatgcaaaaggtgttttctccaaggtgtatacactgcctgggccttgtactctggccctcaattttcttaaacagctgcatcttttgggggctctgttaagacatgctactgtctttagtattttgccccctcaccgaatgatcaggagactggcttccccaatgccctgggcttaattcccagatatttattctgttgtggagtgattatctgttcctggattgtctcaaaggcattaatctttttggtatccaacatcttgaatgcttctgtgtcattttcctttctttttttttttcaaagcacttaattatttaaaaacaaaaatacttctctgatcagagcatacctgccgtgctcaaagcacttgcttacttggaatgccataaattacatgaaggaattattcattgtatcacgaaacataccttccagtctcccgagtagtgtattaggctaagtatggtcttttaaattattactttaaaaataaaagataatggaattatagcattaaatacattttgcaaatgatcttctagtaggattattgaaagacagtaaaggcaagtataaatcagaagcaaaatcattgtcctctaattcattaatggttaataatattgctgactcttttaacttgtcaacatttcctacattcaacattgtactctaatatccagtaaagtgaaacaaacaaacaaataaatacacttttttcaagaaaaaataaatatctgtgatctcatcatttgaccgtcagtattttcatttttgcatgtgccactttaatttccctaggcaacactagctagtggcccacaataagacgtagaaaacaagaccacgtaccttccagaatcattggccctggctctactcctggaaacccagtccatctctaatccctttgatttccaatgggaggcaaatccaggggagttctagactgtctagaatattgtaccaagaacaaaaggccaaccccattagacagtggccaagggaggtgaactaaagttggtgctgtgaacagggctaatggtttgtgatttacccataagtggaaggtgtactccggctgctcctttaatattttatgattagcagtagaggtgtgtctgggggaaagagtcagcttattttatttatttattaattttttgagatggagtctcactctatcatccaggctggagtgtggtaggtgggatcttggctcactgcaacctcgtctcccgggttcaagtgattctcctgcctcagcctcccaagtagctgggagtacaagtgtgcaccaccatgcctggctaatgtttgtatttttagtagggacggggtttcgccatgttggccaggctggtgtcaaactcctgatctcaggtgttccaagaacaaaaggccaaccccattagacggtggccaagttggtgctgtgaacagggatcctgcctctgcctcccaaagtgatgggattacaggcgtgagccactacacccagccaagaattcagcttcttaaaggagctgcctcagactgtctcaagatcttagaaggccatgcctacattgccaccagcatcccttggctttttgcttggcttaagaatctatcttttccgttcctccttccagcatactcagcacagtccacctctgtggtctctctgtggttttctttctgttttcctgctctctccatttctcattcaccacaccctgggctatctttcactctctatgaaataccttggatttaggaattggagatttccttgggtcaggtttcaccctcttcaagtagcgtctcaaacagtatacccactacagctttctccccactctgtcaaccatgccatggggcctactttttgccctgactcccaccagataatgcccatcagatggcacctcttttggctgaaaaatcgaaaactcatcactcttcctgcattcattagacagtaccctttatgttcaactttgtaatttaagtcccattcttgcctcatagaattattgcccgttgacctccatataagtatctgcatttgctgcatcattcatgacatgtgaggcctttgacaaaccctcctatggtgcagcttcctccgagcagctcctaaggaagtgccagagtcagggctttcctctgcctgaattatcggagctcttggcttaatgtgggagaagagatgaatgatctgtccttctatgaaaggcttaccaactccattcaattcacagtggctctctgaagctctgtttttggaaggactgtgaggctgtacctgcacttgattgaacgagtgctgggattgattagtgatgtctgcagtgagcgaaggattgggaagagtaaacaggcatgctgcatatctgtcatcatggctctgagtgtatcctgtttcagaagagatgaactgtgctgtagagatgttagcatcaggtattttagacacatgaagagaggatcagattcagtggaagtgccaaagggattctttcagatgggcaataagtggttctgaagatacgtatttctcagtgtgttatcttggctccatttagccacacaaaaggaatatgggtatagtgatgggtctctcatggctcacgtattaactgtatttgttgttactgcttctcaggcactctgttaagaatgcagggctcttcctcagactcagggcggggcctgggctttacagcaatggttttcagtttgtaatctctctcaaggaagggagaggagcacaaagctgccttgactgccagcaccatcagaaaagtgacagcagtcttggccctgtaattgccaacagtaattcatttgttcgttctctctctctcgctcctgctcctgactctgggggatgcttcttttcctaccctgcctggaaagtgctggggcatgggtgaaaccagaatggttttgattctcaagtctttttgtagagaggaagaatggatattcctagggtcagttgattgagggtgtgttgggggaatgtgattatcgatgatgctgtatgctgggtactagactgggggttcgttacatcaagttgtggggtctgtggaaaggaagttgtcataggagtctaggactcagcagctgtcaccttcccaaagtcacactgctgatgagtgacagagaccacatttaaatctgtgtgtttacaaggtctacaactgcaccctgctacctcccagaagctgaggcaggatgggcaggttgccacaccctcccaacctcctgcaaccttagttgttagtgaaaggttattaaataggcctcacaatcgcaagccaggtaaatatgtcattggagaggttggttttgtttgcatttctggtgaagttgagttgtttttatcccctacaaggtcatctagacatttttatccccaaggtcaggagatctttctgccagaggtcagcattccatccagctcctgcctgctctctgggtggccgactgtgccagtagaaatgccagctgcagccaaaggacaggctttccatccgagaaaagcactcacactcgcatttcttttctggttctgttcctcccctacataaccagaaaaagctcgttaacacatgatggcaaccaggctccaatatctgccagttcccctgtacagattcctctttagcattctctcggcttccctcctcaacaattaattcagatgagcagttgggagagtgcaggatccagttcaaaaggatctgtccccccgtgaaccccaggacagggtgagaggccacctgcacactttttttttgtcagctcacaccctgttggccctttgcaaatatttgtctttcctcatgcacgtggttattcccagaaagatccagtgaattgtctcctgaagataaaatacataaaagggcgtttcaaagtataaacagtgattttaatgaaaaataagaagaaaatgcttatgatacaacattaggtggaaaacgaaggaagaaaaattctgtgagtctaattatggaaaaaattactaagatatgttttaacatgccctagacatgcacagaaaaaaaagactggaaggaaatttattgagatgttattgtttatgagtgttctaattatgatttttaacaatatattatcagagttttctgacaaagaattaactttttattttttttgagacagagtttctctcttgtcacacaggctggagtgcaatggtgcaatctcagctcactgcaatgtctgcctcccagattcaagcaattttcctgcctcaggctcccaagtagctgggattacaggcacccaccaccacacccaactaatttttgtgtttttagtagagacagggtttcaccatattggccagactgctcttgaattcctaacttcaggtgacccacctgcctcagcctcccaaagtgctgggattacaagcatgagccactgtgcccagcctagaaataacttttaaatcagaaaaatacattttttaaaaagatgtaaagcatacatagaggataacttacaaatctgcatttcatgaccacatatatctattgagttgcccctaggatcatttttttcaaagctaatgtctgccacaaatgggagttttaataggttataattcatatgacttagtgttaaacctctacgttgggattcttaaatttaacatggataaactgaacttgatttcctgcattaaaaaaaattaaagaaatgaaagttctgactgttttattgtagctggggaattctttttgcaggtgatgctcatgttacggttttgaacccaggactttgcgttgcagttttgttcaggggttgcagaataccgatctgactttgcaggaatgactgtcttggtgcataagccattaacctctctgcgcccttggattgcctcctctcctgccagcagaagccaagtcacctcatctgtaagggagtttcattgaggactaagtgggaccaggccgaaaacgacccccttcccccataggaagtcacagaacagccaagccctggaacaggaggagcagcttcctcctgggcacagctgtgcagaaccagaggcgacgcatttgcccatcgtaaaggctgattagaaacagttgggtcccaagcagaatccttttgcccatgactgtgtccatggtcgaggtgtccattgtcactgttgccagatgccagcactggcgagggttttgccttcctaccgtaggcttcttgacccggcacctcggaaagtaactcctgtccattgttccttgtgccatctttcttaagaaaacatgaggaggagcagggtgatgctagatggaagcaggagagcctggggtcttagtttcagtggctctgacttcagttttctcacctcgaaatctcccttctctgaacctttttgcgtgctcttctgtctgtctgatattcatcatctgactcatctctaccagtcaggagttgcttcttccaggaagccacattccatggactgatacgctgggctccatgccatcctggggttctcttgagtacatctggaggggtgtagtgtgttgtaaatgcatacgatcatgctggtacatttcatcaaaggtggcagttacactaccagttgtgtgcccttgggcaattagcatcaccctgctgtgcctcagtgtttccatctataaactgggtataataatcattcctaccccataggttgctgtgaagattggctcacatcagtaatgtacttggaatggatcctggcataaaaagagcccttggaaaatgatagcgttcatccttggtatgacctccaagttctttgaacctcaaagagccaagtcccacatctcaggtacatttcagttcattctttctgagttgatttttttttttttttttgagacaaggtctcattctgttgcccagactggagtgcggtggtgcgatctcagctcactgccacctctgcctcccaggcccaagcgatcctcctgcctcagcctcatgagcagctgggaccacaggatgcaccaccatggccagataattgttttgcatctttggtagagacaagccttcactatgttgcccaggctggtctcgaactcctgagctcaggtgatctacctaccttggccccacaaagtgctgggcttacaggtatcagccactgggcctggcctgagttgataatttttgtcatttctttctcacttttctcaggaaaatcatgactgtaaaacagatcagttttgctttagttcccaccctcatcatcaacccctccccagctaccctgcaaaagagtcacagatcattgggataactagaaccacagagatccccctagacttgtcagccagggaacctgacactcttagaccttcttctgagtgctttgtccttgtccggagagctcggggaggagcaaggttgtactgggatttttttccgatcacagaaagtaacttagctagctgttgcccagccaatttgcccaagggagaggttgctcctgggttgcaggacgcatccatggatggagcatgggttttgggctgtggggggacaatgaggtggttcctgaaatccctagttactagcagacaagtgcatcagacaagtgcatttcaccgttctgagcttcagtctcttatccaagcagaaacatggccagaatgcaatgtcctaatacatgtaattcattacgtgtgttgtcatgtaatgtaacacacctattggcagtctctgacacaatacagatattgaccccatggtcttgccccaacttaaataaaaataaaaacgaatgcaaaagaggaatcttctttgcactcgtgtgatgtctgttaattcttggctttcttccttcataaggttaatcatctccctgtcacccctcccgcttgtcccccagcctctgtgtgtcaccttctctctgagctcaccctctctaggaagccttccttgctggaatgcccattccctgatataaggattccacccaccacgccccttgcggttccttgccggtgtcctgtcctgggcagacataagccctgtgggttccagtttctcattaggaacctggatgatggagcagggatcatgctcattaagtccgcagaactcatcagctgcttagcagggggccaaggagggctgagcctatgacgggtgaataagtctggttggcctctgggagtacgggatcagaattccaagtgactggggtcagtagcaggccaccaagagccatcccacctcagaaagacagaagccatcactgcaaatggcaagggcatgaggcagtttgaaactggcaaaactggacctttcatggaatccagggcttgagctttaatgctttacacttttgttttttcattccatacgcttttgctttagcttcctggcaaaattcagacaaacctagaagggataataacttacattcaacctctgcttgctctgtcctttctcacacgtgtttagagaaactggaggagcccgggaactgctttctcctctctaagagtcttggtggtttcttgtgtggaaatgaatgggaagttcaccctggttctgcaaaatgggtgcgaaatgtaaaatgtatataccttctatcctactctttatgttccacaaattttggagggaaactgattaactctctagctaccatgttccaggtgcctgcacctgcttgctcttggttaacctgcacccacgttcccccgcctgtctctgaagtattcacaggtggaggctcagatgcacacagtgattgagtgccctagctggggttggaaactctgtccatgaactccaaagcccacgctctcttacaccctcccaaaagctgaggcttcctcactgtcttttgcattatgtcatgggtggaaacatgcaccttccctgaccttttggcttggaacatggaagttcattgactttgttgcctagcagggcctggagctgggtttcttgcctgatcaatgtatatcattttgccaagagacagagtctgtgctggagagattgattccctggttatttatcttcctctgcccagtgtaaattggtcagcctgatcctattcgcatgataaaaatcataatgtctcaaattacttactcaataaaatgtgggtttgtctattattagtgattattagggttataatgcagcatggaaatttggagcaaattaactatacatgcaagctgttgggctcaagtgcagttaatcatacgcatacagtgccagtgggcagaaggttttgcaagaatagcttcaggaagactttgtgggaagacagatgaatactcagggtttttttttttttttcttctaacttgtcctccttgatcaggatttctcaaatgcacatttgtctaatatactgttgaaccatgcaagtaccaaaacaaaacaagaaacccagaattatagctcaaatttaattaaaatagcttttattgcttctattcatgtgtccctggattttaagtgatgcgtcagaatttcatgatgagcaaatgcctatggatgccctcatttctcatccttcttgactgtctgctaagattcactcttggtcttgtctttgagcttttctgttcagtgatgtaatgggacaggctctcctgtcatcaagagttcccatcatacctgggcactgccatttcctctgtggtagatgcttcctggacacgtgggcaggtgagaggtgctgactttgcctacttgcagctgaagagaagagagatgtagctttgaatggccacatgagtgtttttttaaatgaaaaaaaaatctatgtataacttgtttcctgtgagggtgccaggaaactttacaatgaacttcgtgaattaaacctctaccagatgaatagaggtggtggcatggtagcagaaattaggattaaaaaaatggtttttgatttatgaaaaatttttctgcaggaaattttgatttgttctttgtggattctgaggataaaattaagaccaacattgaggatgagagacagaactgaactcaacttaaaatagcttcagggaggaaaagcaagtgcattagataagtaagtgggaagtccaggggtagacgtgagttcaggcatagctggatccaggatccgacagcttgcatgtgtagttaatttgttccaaatttccatcctgcattataaccctaatgtttgctaataacacacaaacccacattttattaagtaagtaatttgagacatgatgatttttgtcatgtaaataggatcaggctgaccagtatagactgggcagaggaagattcataaccagggaattaatctctggatccaggctgaaatgatattatcagacacctttctttctctggtcctcagttttgatctcttctctgctagctttattctaagacaggcttagatgggatgtagagagcaaactctggaagtggagtacctctggcctccaaggccagtagttgtagcaaaagtccagggctgccgctcattcactctgctcggacctttctggtcacttgtcttctgtggtttggtccttgtggccagggacaatgaaactctcattgattaggcctgagttatgtgctctctcctagagccaggaagaggcttcggccctgcccagacccggtggcctgagagtcacagtgaggcgcagctcccaaagggagactgaaatataagcaaaagaaaaggaacacgtactgggaatcccaaacagcaaatgttcactgtgttcagggaggagtcttcaggcccacagtgtaggcattcaacaaacgctcttcagggagaaggaaagttaccatcaaaatccgtcgttgaaagtattgaagttccagctggcggtctgatacagcttagatgttgtccctgcccaaagctcatgtcaaaaggtaatctgcagcgttggaggtggggcatggtgggaggtgattgggtcatgggggtggatttctcatgaatggtttaccaccatcctcttggtactgtcctcacgatagtgagtgagttgttgggggagctggtcatttaaaaatgtgtggcacagccccccaccctgtctcttgctcctgccctggccacatgacgtgcctgctccgccttctccttctgccatgattgtaagcttcttgagacttcccccagaagccaggcagctgccagtatcatgtttcctgtacagcctgtggaactatgagccaattaaacctcttttctttataaattacccagtctcaggtaattctttatagcaatgcaagaatggcctaatacatggtctctgagcaggattattgtagaggggactgatgttgaagaatggaaaagaaggcagtgtcagagaatgctgaagagtgtggatcttaaagtccaacctcaaggcccagcgctgccacttaacagctctgtgaccctgtaaagtcactcagcctcattgagtcccccatcctcccctgtgtagaatgaggctaatgctagtgctcatttcatagagttgctacaataatcaatgagataatgtgcataaagatttacatacataataactgctcaataaagggtagatgttaaaattagcatcagcgagctctagaagatgctaagttctctggaaagatcagctctgctcctgtcaatctctccaaatgttagattttgcctcaaattttaggcattcgttcattcatttattctttcgtaaattctatcgcattaacctttacaagtgttaaattaaatcttttccccaaattatgcattagaaccaagttcttatgtggtggatgtacctcatttcagcaagagctttctaagggtacagaattaaatatgcagcctctgggattcagtgatagctcatgggacatttgacctacatggaaatgcaggctggagttgcattttaattggcaaggatcagcccagttgtccagcttgtagcttggagtgtggcctggctcccactccagagagatgtacatcatgatctgcgtgggtgagaggatactctcaggaaatgggcaaagttgccagctgacctctccagaaagagagactatgttgttagtttcccttacttggatgagaaatttctccattcctagtctcattttcccaatagaacacggaggcagaatttaaagcctcaaaacaatctgatgcacatcagctatcaatgaaaaggaccagcttggaggcagaggcacctgagttttgcatcttggctcaatcacttactaactgcattgtgggttaacacagtgtgtgtgtgtgcacttactaactgtgcaactgtgggcaagtgatgtaatctctctggagctcgtctttccttttttcttttcctttttttttttttttttttttttttttttttttttttttgagatggagtctcactctgttgcccaggctggagtgcagtggcacaatctcagctcactgcaacctctgcctcccgggttcaagtgattctcctgcctcagcctcccaagtagctgggactacaggtgcacaccaccatggctggctaatttttgtatttttagtagagacgggctttcaccatgttggccaggctggcctcgagctcctgacctcagatgatctgtctgccttgccctcccaaagtgctagaattacaggcataagccactgcacccggccacagttttcttttctatattgtagggataataatcctcccttgcaggactgtgctcagcacatgttcattgctcaagagaagtagccactgttattattattgtcagtatgtatccaagtgtttagttcattttctctgcatttgtctaactcccttttttcccttgaactgtaaagctctcagcccagggatatagtagcaccagcacatagtagatgatcaagaaaaattagtcattctctctggttcttcctttcctgtatcctgttgtctttatcagttcaggctgctgtgacaaaagtatcacagactggatggccttaaccacaattgttttacatggttctggagactgggaagtctaagattaaggcagtggaaggttcactgtctggtgaaggctgggctcctgattcatagatgtctgcccttcttgtgcatcttcacatggtgggaagagggtgagagagctcaccggggagtgtttctcccagttcctccccagtacacagaaaaacaaagctttctgtctcaccaggaggactccacggtgagcatagcttggctcagcccagcaggagattttgaaccgactctggtagattcttcctgcagccattcagctcccacctctttctctcaaaaagaaatccagggctgggtgtgtgtgggcaacttcaccctgctctctttgtcccccaggcctgcactacaacaaatgtctctttgtgtccaactcttcttccatttctagtccttcttttctcttcttctcgtacttcccatattcctaatacgattggttactcaaattcttaaacaactcacaactcattatctcccttccatgtaaaagtaacccccagcctgagctacctgaccccgtggtttaaacaataaagcaactgaccttttatcagaaatttgcaaagccatttaatttacatatgtccttggcatccacaaatattgcttctcctttcaaccagcatgccacccttccagccattcacatatgtattcattcattcattcatttattctttcattcagtcaataaatatttattgagtagtaagcacatgcaaggcattgagggtggggagggaaagagacacaaattgtccttaccctcatggattcaccatgtatttaaaggccacaaatacttgtgtgagaagcaagtcttaatagtctgaagtgttttcttagattcccttgagccgcaatgctgaaaagcttatggtggttttgctaatgaatttgacaaggccagaaatagaccagatgaagattgatccattggttaattgattaattgattgatcgactgaggaatgtcagcctggtctaccaaggtttatgaaagcctggcatatagaaatgatgtcgttaatgcacaaatacctgcatcctgtcttgaactccctctaggggccaccatgtgtatcagtgtcctgtggctgctgtaacagattactacaaattttgtggcataaaataacacaaatcgattcccttacagttctggatgtcagaactgggtgactttctcctgagactgtcctgatttttttttttttttttttttttttttttgcttgtcagtttgttttgggtgatgcagatggaaggtaacgtcacagggcagctgtattccaggtacttggtgactcttggttgcgatctgatgactggctcacagtaggaccatgacgtgagcagatttgtagtcctgcatgaatgaaggaaagaaagaaatctgacaactcattgattcagattcacagactctgcattttgaaccagaatacacccgagcaattacctagcacaaaatctcctgtctgcagaggagttgcaggaaggagaattcactatatcctctcctgaaaatatcccttgtggtcaaggtggctatagactggcatccctctgctccctaagatgccagggactcacgtcttctaggatatcaggggaagatacagggcaatgggcctcagatcacagacacggaaaatcattttctatttcatggagcatggagaagcttccttcaaaaagctagccttcgactttctattttttgaactgaagggcaggccaggagggagctgacctgtgtagagcttggaggttgtgttttcagctgagaaaagtgatcctgaacctctccatccttgcaaagctcagatggaagcccaggggccccagccctccagccccacacacatgccggtgcacctggactgccactctacctgtttacaaattacccccattttctgcttggttcagcagcaactgattaccgtcccccgtgatgtaattagggcttcagagttcacgtgtgtctattatgagctctcctgtgctttgtcttggtgcttcgtttctgtagcagtaatcatatatatatataaaaatttggtatcaattgtttggctaaattatgcacagtgggccatcctaacctgccattaacataacgtatgctaaagaatgtgttgtgtttttttgttttctctgataattatactctaaagcatcaattgcttatttgagtaaattaaactttgagttgttcttatttcttcaaactttcaaattgtcttgcctgcagcagatgcagacccagcactccggctgctgccagtggaggcaggagcctcgttaccacctttctgagaaattcaagtgccacacagtggtcaccagcattgtagctgccctgatgttccgggctcagctgcaatatagcacatctctaccaccatccccagagtgacctccagaactgtaagggacccccgcctttggtacagagatgggagttaaacacaggtgtccactggagtcatgattcctctattccctggacaaatatgcaatgagaatccctgagggacaggcactgtgctagatacccgagatacaaaagcgacaaggtttctatcctctgacagtttatactttagtgcagtggtcagcagactgtttctgcaaacagctagatagcaaatattttagactttgtgacccatacagtcaccatcacaactattcagttctgccagtgtaactcaaaagcagccatggctgttacataatgagtggctgtggctgtgtgccaattaaactttatttacaaaaacaagaggagggccagattttgcctttgtcaaggaagtaagcataatagtgcaagcagcacgtgcccgctctttcacactggggcaaacacaggggatttattcggcacaattgagtaatgtggatgaggctgctcagggctggcagttgtaggacgcaaaaccttgaggggcatcgatattctggtacagctgtcacccatttgcagcacagctgggacactccacagagaatgatcaggaaggccaagcccagatggcattgttgaggggctttctcttaagactgcatctgagtggcagggcgcagtagctgacccttgtaatcccagcactttgggaggccgaggtgggtggatcacgaggtcaggagttcaagaccagcctggccatgatggcgaaaccccgtctctactaaaaatacaaaaattagcctggcgtggtggccggcgcctgtaatcccagccacttgggaggctgaggcagagaattgcttgaacctgggaggtggaggttgcagtgagctgagatcatcccaccgcacaccagcctggccgacagagtgagactctgtctcaaaaaaaaaaaaaaaaaaagttacttctgagttaaaatatgaagagtgagcagtacccagccatgcagaaggacatggagtggtaaaagcatgtggttccattaagggaaagactccagggcaagaaaaaaacatgtcatgcttgtacctgagggaaggccagtgtgattgcagagtatggggcaccctggaggtctggaatgggaggagtttaaacaggtcattagagcttcaagatgaagcataggccagtgacttggttgctgctgctgcgtaaccgtgtggcaactgagtggctcacggcaatcagtatttacttctcacgtgtgtgtggggttcagcagaactaggctgggcttggctgccctgccctactggtcctgctggttttggtggggcttccccctgtgtctgtgggtcagcttgttttgctcctgcatctttgcatcagctgggctttctgccctaggctggacatgggtggggcactttagctggggtggttctcctccacatgtctctcatcttcctgggaccagcagggctagaccagacatgactttcttatggcaagggcagaaatgcaagacagcaactcaaaacacataaggactttcaagtctagacccagaactggcatacccattcctctgtcacacactgatgccccaaataaatcacatggctgagctcacggttagagagggaggatactgcagtcccaaagcccggggcatggatccagagaggagggtgaagaatgggcccctgacccaagactgcacttgtatttgagttgcataagaagctgctgaggaattttaagaacaggagtgacatgacttccgttacaattgaaaaaatcaatctggcgaaatgaatggggctacataggttgggggaaggaggtaagagaggaagtgaggagaatagggtgggtcgaacctgttgaaggcccagagcttgcttctcttctgccgcctttaggaaacgagatgaattgttaaacttcttgcactgagctttaccaggtgagctgacagttatcctctgcattcatcaatataagccccataaaaggcaaagtggttgaggagaaacgagaaattacagcccagattagcagccttgagtgctccttgtgaacacaagacactgacccaaatcacacgtcacggctcttcgcccattaacgcttatagcaggattattcccaaggaagctgtagccattatatttgctgccatcacaacagtaaaataaacaggtgtgactgcagccctactcctcgggttgtttcatgctgatcagttgttaatatatgtgtgacttgaagttggagcctgttgggagaaaaagttgtctttagaggagtaaagtgttgccttgctgtgggaaggggaaactttttcttgggaagtggactcaccaataatttttgcatcatgcgcaggagaccctactaaaacctaagtgtgcaatgctttaaatcagtaagtttgtttttcattaacataaaatccaaaacaggtgctgtgatcagcaagccgctgtcctccaagtggtaattcaggaacccaggctccttccattctgtggcttcaccttgaccaacgaagaccttttgaggttgccacattctccaggccactaacacttatgtcattggctacaactcagtcacatgaccatggctgcctgcaagggaggctgggaaatatagtttgctgtgtgctgggtgggtgggagggagcgtcaacattagtgaacagccaggcagtcgctgcctcaaatttctttagtgttatcctttcatgccagcaattgaatttgatttgcactgtttcacttctctacaagggtgtaaaaagtagaggttcctcttgaaagaatttcctccccatctaattaggaataaatagtaacttctcttagaagcaaagttaattcaaagacctgtgctaacattcttaaatatctgctagctgtaatgaagaaatcaatgtactttatgttcttagctcccacagtttagcctaaatatttgccctggcatgcttatactggtccaagcaagcattaggtcatagcctgttcctcttccttatttgaaggtgtttttacctttctcagcattccacaagttacttcgtccttcctttgttctcctctgcctttgcctcttttttctttttttattttaattttttttttttaattatactttaagttttagggtacatgtgcacgttgtgcaggttagttacatatgtatacatgtgccatgctggtgcgctgcacccactaactcgtcatctagcattaggtatatctcccaatgctatccctcccccttccccccaccccaccacagtccccagagtgtgatattccccttcctgtgtccatgtgatctcattgttcagttgtcacctatgagtgagaatatgcgttgtttggtgttttgttcttgcgatagtttactgacagtgatgatttccaatttcatccatgtccctacaaaggacatgaactcatccttttttatggctgcatagtattccatggtgtatatgtgccagccatcccgttactgggtgtatacccaaaggactataaatctttctgctataaagacacatgcacacatatgtttattgcggcattattcacaatagcaaagacttggaaccaacccaaatgtccaacagtggtagactggattaagaaaatgtggcctttgcctcttttaaaaagttctaagttgctagccagtcggaacaaatacagaatgtgaggtccctttccagccaatggaaaccggacacagcagtagagtacacgtgtcaggttataaatgagcctgtctcctttgtccggtgttctctcatggcaaaactgctggcgagtgtaccctttctgcagaaagtaaaaatggccttgctgaggaaattaaattcctgttcgagtgctatttctttatggcactgaggagcaagcatttctaacaatcatattgcttaagaagtggatggcaagaagataattactaatatgtctgcaatcgatctgaaattgacacagttgatctcactgattcatggggaccctgggagtatgtttgtgtatttgggggttgggatgggggggtgggtggagggtcagagaggtggcaaaagcaggtgggaacagggttacagagcaaagtaattagatgccctttagatgctcttagttaaagaccatgcaaaaaggatgaaatcttttgatcatgttcttcacaatattagaggtaaaacatgaactcaacgcttttaggaagaaacaactggattgcgttttctattttattgacagaaactagatggggaggccagggtgtgttttattattgcacacatacgtaattacaaagtctttgcttttttcccctacataaatttattttgagatttaatttccaccaattagaacccgaatgaagccgttttaatgtgattcctgcatcccagcaacgtggccctgcttcttagtgcgcacgtaaagaaacaatcctggagtgaattttaagtacctaaagttgtgttagactgcaaatgaatatccaattcaatttgtaggaaactttagattaattaggtttataatttgcacagtaaggtaatgtaaatgtgttgctacggcttgactttttgcttaatcctctgagtggatatttaatctttttaatattagaattaaagcaacttggaagatatgaatattaatctaattatattccgatcactttaatttctttaatgttttaaataacaaaacaactttacaaattggtttaggttggggaacgcttttagaggattttgcatctcatcagtaagtgcaatttagaggatgcaggcttgggaagctgtaccttaagtttatagttatgcaaatgaaaaccattaatcctggagcctctgacttgcaaggtgtgcttcagaaatttgcagcttctatttaggtaggaagagtttgccagcccgaaaactccagtaagcaaacagctttatagtaccccagccatagaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctgtataagatctttaatgttttaggctgtcaatgttggctgtggttaggctgacataattatgagctgcatgtaccaatatatagctctttacccacaaaagcatgctgcaacggggaatctttcagagataataaaaggattcatcaagtgtctatacgatagctacttaaatcgctattgttttagttaggcccgcaaaacatatcccccagctatcccggtttcttatctttcttacttgatatttcaggaatttcaagcttttgtacagcttgttcagttgcatcctagaggaggaaaatgcttttggcgtgatttccatttcaagatgacaacagggagaagtctttccaaaatgcgcgtgttgcaatttcagatttaatcaggggaatacattaatttctggaactaattacagattttaaaagagtgatgggtctggtacagtggctcacacctgtaatctccacacttggggcggtcaaggtgggaagatcccttgagtccaggagttcaggaccatcctgggcaacatagtgagaccttgtctctatgaaaaaatgaaaaataattagccaggcgtggtgtcgtgtgtctgtaagtcctagctactcaggaaggtgaggcgagaggattgtttgagcccaggaggtggaggctgctgtgaactgtgatcacaccaccgcactccagcctggatgaaagagtatgacctttgtctcaaaacaaacaaagaaaaatcataaaagggaggcagaaaattaactgaagaaattgtgttataaaaggcagtgttttaagttctagaattaaaagcaattgcagcaaataccaagtgagattttctgtattttgagagtttgtgtgtgcaatggttttccactgactaatcaggctgataaaacaacctgaaaatggctttcccatggagtttatatatttcgtcagagacctaaaatggtataaatgttcaataatagccagtgaatataaaactaaataatccatatgagacaaaacaggtagaagaaaaaaacattcctcctcagatatgcaccttttaattgaataaagcaaacagtaacagtgattaccaggacacttgctgttttctgttattttggtttatattgcttaattagccagcctttctaattaacattacattttgctgagttcacattgtgataaagatgaatatcaattcttttctactcatctcattgagagatagagttgaattcatcttcccttgtatctaggctgcacttattcgtttgcttgaccaatggaatgtggctgagtggccgtgtaaaatgcctgactaccctgagactgccatgttgaaggaagcccagctagccatgtggagaggccttgtggagcgggaaatggccaacctccatccattggaagtcatcccatttgaggccctagatactgaaaatcagaaagaagttacttcccattccccacctcaaggccctgtccaaactgaagattcatgggcagaataaacaattgctattttttaaaggtgtatgtttggggttgtttcctacagagcaatgaataaccagagcaaacacccaagggcaataaattatgaatagtgaatttaatttttctatgtgacctatggaatcagcctattttatggcagtacaaagtatatgtagcaaccaaacagtttcttctttcctaaaactcaaagtgagtcagacttcttaggcttgtagatgttgaggactaagctttgctctttatcttctctttatggatttccctttggaagcagggataagaagagggaaggtctcccagatgtaaatttctcataaatatttgagctccatttcagtaattctttcattctctgatctgttgcctaatcttctatttagcaagtactttccatgaaatagaaggctttaattgatagaattactaatttgaatagcttagcacagctcagcttgtaaaaaaaaaggaaaaccactatccccattaaattctcatcttgtaaaaccagccatcagcacctccctgtctttttactaaagtttcccttctttggtctttagtgctaagtaataggctgtcactagaccaaaaaaaaaaaaaaaaaaattcagcatttcttttcattggaggttaccccagaacacttaaactttggagaggaaaatagaacccctgaagaaaagtgaattctcatgacaatttgtacattctttgaagaatgactgtaatacatggaggagttaccttggacccatgtgcagagtagtgtcgtgaatgaggcctgtgccttgtcctgtggtttaaggataggtaaatgtatctggggcagagggttgcctgggacaaaggcattataagcttattcatttaacttgagtacagggtttctcaagctttggcactgccaacatgtggggttggataattttttgttgggatctgccctgtgcattgtaggatgtttagcagcatccctggcctctacccactagatgccagtagcatcccttccccctcttgtcacaaacacaaatgtctccaaacattgccaatccccctccattaagggtcatgtctcttggctgggataagtcttctctaccgtatccctttaactcaagaagtttttcttgctaagtttatgtgatcttgaaaatacggtgagattgaacttgattttctttaaaggacaaatatctgcttcttccaaattgtcataggaatagttcaaagctaaagagcctttcaggcaggctgggcacttcaaacctacaaaacatagtgctaaaattaaggagtgtatagtcgtgtgtttatagggacaggatatttattatctatcacttttgaaaatgtcattggcattatcgttcacttttacaaatacgaaggaaaaatatgaaggagttctagaaaacaccagaagtgattttgccgccatgggcctgaattgaagagcttaacccactaatctgttatgactgcttggggagtgctagcgcaggttctctaacacactgagagtcgtttggagggtagtgtgaagtggcgttatagttctccttttaatggttgagacaagaattgcctggacctcttttaggatacatcaccagtcttccaatggcaaacttatgtttattccagctgattctccccagcatgggggcatgaattgcagtggaaatcagtggactagaatttggatgcaattgcccccaaattatcgaagagaaaagaagaccactgtaattcaccggccatagcatttttaccaactgtttttgctaagcattagtttcttgtgataggttcaattctcaggctccttctcattagagtctttctgtaaagaccattattatttctgttatatttcctgtggctgagctgagccgcacttggagatttgatccattttaactctctcattgccttcagagagttggtgattttggggggggcaccagtgtgagtcctttgatccttgaatgacaatttggatttgtctcaaggtcctgataaatgggaactggaggaactggcctactatggtattacaggctagcacatggtttgcattctgagggagctcagaataggcaaggtagaagacataggtggtcaagaatttagaaagacccggactcgaatcccagctctgatccatctcagctctgccatattgccaagttccgctgagactccatttactcacctgttgtatcatctgaattatttccatatccataatgtgcaaggatatccttccatgttattagaaatacagatacaccatcattatcagtggccaaatcattcaaatcgctgtttgcttcttctcgggctcttattcaagctcacgatgctattctcatagtgattgcgaatctcactgcataaaggtgattttgaaaacatcacttttcctccacactaatgtgtgagcttagccagagtaggagatatatcttacttaaaaaaaaaaaaaacaaacaaacaaaaaaaaaaaactccttcttcatttgttatagttccaggatagagtgtgtacctgtatagagagagtcaggcagatacaggtgtgccctccttccaagatgtgtgatggtgggcaactttctttgcatctctgagcctctattttctctatataaaatgagagagaaaaaaataattcctagatctagagttggtgtgaggctaaaataagctgcttttagtatcacatttggcaagtagtaaactctggataaatatacttttgaattgtgtgattattgttgttaccatttattgaaagggaatgatgaatgtagtgagagaaggaaggaagagagagagggaagaaggggaaaaagagggatggaaaggaggaaggaaggaaaggagggaggaggcaagtatattagtcatgatatagggaattgaaaagacattcacgttttgtggtgaatgaaaataacttgacctttatgaagctggcctaatccctggaaggaaaaaatttccttggatatgtgatttatataatcaatcaactagtccttattttggtagagctaaacttctgtctttgggtttactcaccgtatctgtgtgcatcctggcaatgtttacgatatacttctactaaaatattattttattctatactaacaaagggatttgttgtgtgtgtaaaattcaaatttcaatgaagattgtgtatttttatttgctaactctggaaaatgtgtttacagaagaaccagagaaggacttactcctctccgtacactttggacatgtcaaaatctagaaatagagatcagtaaaggtaacacatagcaccttaaatctgatttaaaaggaaaacaatgactattatacagatttatggcttcttgtcaataatactctgatttctggagattgttatcagtcataagctttataggaaatatctccttttgaaaatgacattttaaattaatgtgaaattgtgttttaatttaattcacagggagtcataaacaggtgggagaattatggaacaataattgtgtttgcaagaaatggatttcatcctaaaactccatgaatatgctattacagtttgttgtcatcctgaaatgctctgtttaaccataaaatacagcgtaaaagacaccctcatgttgaagtccttaatctagtgtgtaattgcttaagtgagcacattaactatatcgtcaactacctgttctcaaacactttaacaatcagctcaccaatatgggtgtgatcttgacattgagatgtagagcttgacacctgcatataaagtagaaactcaacagtgtttgagaatttgccattgcatctcagtcttttttatttatatgttttttctttttttgagatggagtcttgccctgttgccctggctggagtgcaatggcgcgatctcggctcactgcagcctccgccttccgggttcaagtgatgctcctgcctcagcctgcctcccaagtagctgggattataggcgcatgccaccatgcccggctaattttttgtatttttagtagagatggggtttcactatgttggccaggcatctcaatcgttttactaagaaatttggaggccttgagaaatgggtaaacttgaaacatttaaaaaagttgttctgctaattatcctaccacgtgtgtcagagacaacattaccctcttattacttaaaagtaatttggactggttcgcacacacaaaaatagctttattaacaacttgagtaatttatcaagttcagattctttttttcctccagaaatgctgcttttggtacactgagaggtcattcatttaaagtttgtccttggcaattccttattgaatagattccattttattttatttacattttgtacaaagctgataaataactgaaaccaaattagctcaaactggttatatttctgggtacaaaccaggtgtatagttaatccattgttgtttctgtgtcaaccaccattgtcctcacctatacttgggcagtgggggtggggaggagaacataaaaacccaccaagcctcatttttcttgctaatttatttccttgaacttggtgagattctatctgcagtgtttccaaaaatagttttggaaattgcaaaaatactacaatgctgttgtgccggccacactgtgagtgctgactgtcatgcattttatagcccatgtccctctccagtgaggcttttggccactggccgttaattggtaaggttcttgaaaactgaagtgatggtatcagcatggatgcccgtgctttctgatgccactgaagatggatagaagcttcaagttatgctttgtgcagactgaatttttccaatttgtgcttagtagcatcttattatattagaccagcactgactggtgatgaatagcaagattgctcccttctaagggcttggcaaaccaagaagaatgcagtgacatatgtcttatgtcttcaaaagcaactggacacttgaagagtattttctagtctcattttgtaaacccaattacgagcggagctacaatttttatctttgtttaatgtaaccaatgaggccattgtcactgtatggagaatagctttagtccatattctctgttttttaagactctcagtctccttgcaggtgcctttggagagttaggtgtttgctgtgatttgagggatagtggccaataattttattgaaatgaatattggttaattaaagcttattgtatgccatgggccattctaagaacttccatccacccaaaagcactatgaaatagatgttgttatttcactgatggaaaaacaagcacagagaggctaaggaatatgctgaagcttgcacagctagtaaatggcagaacattcagactggaattcagacttatacactcacattcataccacacagcctctcgaagggacgtgccccttgaacgcaagagaggtacattgggtggccatggtgctcacagtctctcaatcctttatgttgagggagaaatgataaccagatctcattttgtgtgccaacccgaaagcctgacttgactgcctaaaatgttaggaaggactctaaagccctatctggattccaaatttatggttggtgcagactggatttttacaatttgtgcttagtagtatcttattatattagcccggcactgactggtgatgaattacaagattactcccgtctaagggcttggcaaaccaagaagaatgcagttccacgatccacttggaatgtgtgcagtgagtgtgggaggactggtataagtagcaaagcacttggcactctgggtgtaaagcattcagatctcttgcaaaatgcaaattttacctgcggggatacccattcaacaattagaagctgctgatttctggacgagagttagtttatttagaaagtaacactcagagacactgggacagagaacagatccattttaaggctgtgtgagcactgatccatgacagtattggttcaggggcaaagaatgggaggaaagaaaaagacaagttatagctgcactgaaaacaaactgggcatgtcctaattttgctcagggctacttctcttagagtcgttaaggttttgagcatattaacagcaatactgatcatagctaatatgcctctatgtcaggctctgtactgggttctttgagtatactcaccacctcctgacaaggttttggcagccttacttggtagacactatgattcccattacatacatggaatgtacagtaactgaggatcactgtgatattgggaaagtgggacttcagacgctagcctccccttgtagtgcctgcattcttttcacagcccctccccaccttagaatcattttcttcaagggagagtatggtttgtgatgcccttatcagcaaaacttcagctagaagatgcaagggtgaaatacacctccccaccccacgtgatctcatagcacagaatgactggccaccccagactgaaggttagggagactgggggccccagactcaaggttggggagactggggagagggaaagcgaggaagaagcgtaagtgtatcttacagtttaaaaccataatgggacatatcattttcttagttctccatttattaataaaatgcccaataccttctggcatgtgctttgaactgcttttaattatcttcagttggatggagaaaaggtaatggggacctcataatagtcgtggagggacaactgggatttatttccatagggaaggcagagactgtttgccagggaaccaaggcctttcaaagttgaggacacttcccggtgccgtgcggtgtaaatcacagtgcaaactatgcgattatcccctgcagaggaatcgagtgtgactttatgggattcttcaccaagcacttaggaataatctgatataaaacagcaggggtggagagtaatgacaacttcaaattagtttaatgaatgtttacatttaaaaaaaaaaggcttttctgcaaacctgaaaataagaagtgacagcttcctttcctatttcccttgcaagaggtacctcctggttttcagcctgaggaggaaggtggctttatttaactccttcagccccggaacatcacagggcccttctttgtgcattctgggttctaacagccccttgaacagtgcttgagagtatttccattataaatgtcgaatcggcattgaaggaacatctgttttaagtcaacttagactcaatccaggaaaaaaaataaatttctggctgtccacctgctcaaaaggtcaattacccacccaaatcagccagagatggctgatgggctacagatgccgaggatatttttagcaggattttggcaggtaccctgcttgttgaatgcagcaaagaagagggaggttgataaaccattatactgtttgaaagttggtgccgcgccaaatctcccaccaaatctggatggtgcttttgagctatttccccacttctgctgaagaaggattcatttcagtagaaggagtgggataggaaatgttcacattgcttgcagtatgtgaaatagacctcgaggtattttggataaaaaagcaacattcgtgttttagatatggttacccagcccaagccgcctctgctctttatagccgtgtttttgaagtgttcttattttttgttccgaaatcggaatatttcctggcgtgcgtatcttggccccatcacatcacaacaggctgaatgctgtccacaggttgccagtctggatatggaatattagtcaaaacgatataaactaacttggtctctgctataggagggacaaaataactacaaaacaaaagcaagaaataaaacaaaaccaaacaaaagcctgcagtgtttgggcccctttcagggatatctggaaaaccaaatggagaattccaggagcggatttggaaacaaggttgggtctactttggcctttaagccatcactagaaacactgactcttgcgcgctagagtgatgtttttccttctcttttggattgacgtgccagcacctcaagaaacctctgtgaaaaatccacaggtcttcaagaaccagaagaaaacagaataaaaatagctcaaaataaaaatgaaaatgaaaatagagcaaacatccatttctgtgggacctaaagagttgggaaacctaaacaaccagatgatgatagctgttgctgctcttcctgaaatcaattttaaagtaggaattgtcaaagataatgagactagtatggagcaaaaactggcaattttcagttaaccagaatgttgcatgaattagaaccccagattttcctggagatgactctagccaggccatttgaggacaagttgccaaatatttgtattttagaagcctcagaagtgtgcacaattttctagttctcaacaaggcactacagcaacatgtctagtgtttatgtaaatgatctttataaatcctctagctgatagagagttttcttccatcacaggcaaaatgtgggtttagatgcaatttgtaatattgttgtacaagagtggggtcctttcactgacatatacgaagtgttgtaatacaaggcaaagaaaatacaaacccatccttagtcatttagaaagacaacctggttgagaatttaagatgatggtttagggcatagcttgtggaattcgatgggttgcactgtaagtttcagtttccttatctgtaaaagtaggaataatatctagacctaaaggttattttgaagattaaatgagataatgcgtgaaaagtgctgactcagcacctgcagaacccatgcgtcgtcatcatcacgtttgttgagggatttgaggcgtgtctaggaacgcagatgtggagacacctggagcatcttcaggagctgtttctgcggattctcatgtggcttatcaagcacaggaaatagttttcctggaaagacatggagcaaagcagttatttagccgtccatccggcactgccaacctcttcgtgttcctgcaaggattaaatgagagatggtgacagtagagagtcagccctgagggaggagtgtacaattcatgggctactattccatgtgtgtgggtcaggagacgcttaaggcattcacagcactgggtgtgaggaaggatgcaaataagcttaacttatttatgaattatctgccctggaatggcattctaatgttgtgttggaagagagacaagaatgtgctgggaggatactcagtttataacggacgttctgatggccagtgcaaatggcgccaggaatctgtgtttatagagatggagcatggatgcccctgagcacctgtgtgtgtgcgaagggtgaatgggttgctgggagttcgtcggttgtttagggaagcacttacgtgtatgcctgtgtgtgtctctaggactcactctccacttcccaccttacttattattagtgttcttgtttctcttcgctatggggaaatgcagataaaccgtaaaaacttgatagagtgaacaaaggcttcggaagcttccttagttcttataattgctcaatgggttcttcttgcctgctgcacaggtaaaacccagttcactgagatgacattatggcaggaaagaaagagtttaattaacacaagtccagccaagcaaaaggacaggagtttattattacccaaatcagcctccccgaaaatttggaggctagtgttcttccaggatagtttagcaggaagggagctagggaatggaaaatgctgattggttggggatgaaatcattgaagtgtggaaaatggtcctcgtgcactgggtcagcctcagttccagttgaatcacaagtcccaggcctaggtggggtcagtgggtcatcaaaatgcaaaagtctgaaaaccattccaaaaaaaccagtcttaggttctacaatagtgatgttatctacaggaataattggggaagttccaaatcttgtgacctcctatgcctacatcttagctgaattcagacccctctcctaatcctaaccttgtggccttttaggagctttacaaaggtggtttcatttcgggaaaggctgttatcattcttgctttaagattaaagtataaactaaattcttcccagtgttactttgccctatgcccagggatgagtgaggactgccagcccgtggggctagaagcaagatggagtcagctatgctgtcatattcctcttatggtcacaatttcacaaaggtggcttcattctcatgaccattgctcccaggcattgttcttgaataccttagaaagtttcattagctcatgtctctcctctttgtaccaccttccaacatttccctactgccttggacattaaagtccaaatccagtctgttcatcatgatctgtggagcctttgataatcgcagcctccagcttctccttcacacctgtctcctgtctcctgctttttctttttgtgcactgcccaagaaccttttcatctactaatctttgagtttgccgtcctctcttcctaaatcactcccctccctccactgttccacgtgggacgttccttccagagaggcctcccttaagcccaccttccatacctcctctggttatcctcagtcatgaggccctgcttcctcccgcacactgagcacaggcagtacctgctttactcatgtacttgtttattatctgtgtcacccagtgggacatagtagactccatcagggctgggaaggaatctgccttcgtcaccattttgacatcattatcaagtgcgcaattaggctcacagttgagctcaacataggatctgtggaaggaaagaaggacagaaggaaggaagggggaagggaagaagggaggaagggagggaaggaaggagggaataatttccaggaagcctcattggatttctttcccccttatttctgaaagctcacctctttacagctggcaaggccagcagaactgaacaatagagccggattaagcaagcattcaggtgcccacttaattcaatcggcgaatttgcatttctcaggctctgtgccatgagagcctgccgcctcaagggaccacctgccttctaccagaaggactttgctccttggagaatttccctctggcaatggtccaggtcaaacgaggtaccatacaaatgtggcttgtcaccattttccagtttaactttctcaagccttggctgcctcgatttcattccagactacagtagcagctgaaaaggtagctaccattgcagtcgaagacactggcagatgggactggcttgttggcagagatggcagagatggcagagatatgaactatctctgaaagggcattctgcatgccacagttaagtgctctgttgaaggacggctctggaagggagcatccgcgaaatgaataagaaggtggttattagtgaggtctccctgaaaggagcatagctggatgcaatccttggaggccctgtctagggcctgtctggggctccagctttcatagggccggccatcccctttgctctgggtgagatctgtctttgcttctggtgattctgatattcactatcgagaacgattgctttaaaacacatcagatcaaagttttctaaaatcagagtaaaagctaaaacctttgcaaggtcctgcatgacttgagtccctgttcctcccttgacatcaaaatggctgttgtctgctctcgctctctctctttctctctctctgcttcagctgtcctgacctccttgacctttcttaaaaactttatgaaaactccacgtttgggcttccctccacctgagatgctcttctcggctcctgtgagggctacccctttaccctttatagtgtctgcccggacatctcctcactagagaccttccctgaccactgccacatggaatagtactaatacttcatgctcatcctctgcctgccctgggtttttaatttgtgcgtgtgggtggggtggggggcgggggggggcacttatcaccacctgcatattatgcttttgtgcatttcaggttggtctttcccgcaagaaggtaaactcatctgcagctgtattcgctgtgcctatggtagtgcctggcaaatgcacagaagtgggtattactgaggactttgtggttcgaatggaatgagtgtgctgctgacagtgttgcgagtcatctgcaaatgaaaagtccttccttctcttcccttctggaaccttccaaagaggctagcctcctgagagggcgtctcctgggaatgcctgtgatccaggcaaggcacctaaatcagccaataaataattagttttgagaaaaaagcctgcacaaaagcagaactcacagattttctcattgatcttcctgcctttgccttggccatggtcagtctttggggctattagctgcatgtacaagtgcacaggggatgggaggggggctccggaagatccctaacccattgtggacacaccatttatgttagtggaatctggtaagagtgattgaggagagagcattgggtgaatgaccctgtaatccttataaaaatagtagcaacggtaactaatgatgtttatgaactgcctaagaatgccatgactgtgtcaagcacttcccataactagctcatgtaaagcctgtaaccatcttgggggtgaggacaattatgtcccattgtgttatgtgtctgtgtttgcaggagttgttcagtggtaaggtgcagtcaggacttaaacccgtgttcctgagagtagctctgtgctgcctgacacactccttcctcctgaatgcacaatcatatgttcacgtgccacatggttttcagaaagcactgcacgtgtaggaagctcaagacagagacgtggctggtcacggtggctcatgcctgtaatctcaacgctttgggaggctgaagcaggaggatcacttgagcctaggagttcgagacctgggcaacatggtgagacccccatctctacaaacaacaacaacaaaaaaaaaaattagccaggcgtgggggtgcatgcctgtgctcccagccactcaggaggctgaggtgggaggatggctcgagcccaggaggccaaggctgcagtgagatatgacctcaccactgccctgcagcctgagctatagagccagaacttgtctcaaaaaaacccaataataataataataataataataataataataataataataaagaaagcgagagaggaggtagggaatgaatgccgaaagtggttccttgggtctgatgcccacgcttaaccgattcccagccaaacatttcacagttgtcttacgcacaggcgtaagatatgcatctatcttggtgtgcacctgagaagtagttatgtctaagtttccgacttgacttggtagagtcatttgatcagtaaagcgcagagcagatgaactacctggaaagaaagtgccggaactccccacgtgtgacatctcacttcggggaaaggtgggccctgcgctgcgcttggcgaaggtaaatgcacctgggtatcctcttgacctggaatggtggaaaataaagaaaacttcagcatgtagcaagtagttgtgagtacgattaatgctgtttagagttgccagttctcttacgcactcagcgaaggccgtgtggcttcgcattaatcaccaccaagccaacatgagcttccagcaaaagagcccagtgattgggaacaaattcaaaacagctttatttcattgacagacaggacctttttgttaaactgtggtttaaagacctttacatctctgtcttgttcacacgttactgtagtcatttacgtaaacttaggaactaagaaccgacttatttatcacaacctattggcaggaaaagggtcacataaaaaagaatctttattggtaggtttttttttttttttaaagctaataaacagtgctagtggaaagtatgctgttatcaaccattattgaagtaagtgggtttctggactgaaaaaaaataaagaaaacatctaaatgtcagtgtgcaaatagaaagtagcagtcaattaaatgaggcagtgtgtggtcaccatagatggccaatgtctgtgttattagggaaagaagagaagccgggaaggaggaggaggtttctggggttaacctgtgttttgctaactggtgttagttagtctcagataagagctctatgtaaaccaactttggcccaaattgactcattgaaaaacaccttgtttcaaattttttccccctctatgaccaaaaagttacccaaacctttgtgtcacatatttaaggatgttcaaggcaaccaattagtattcaagcatttagaattattttgaaacatcttctgtgaaaaacaatttatttcctattccaaaataaatgcagaatattcctaatatagtttgatagttcctcctcaagacttatcattcaaagattgggcaaattgacttgaaagagaaaagttaagctatttccctaataccaaggcaatgcaggtcagctgcagtgcctaatgtttataaaacttgtaaatgttgaaacccacacttggtctgagagaacatcatgctccagtttgttcttaggaatgtgtttctgatgtgtgtgtgtgtgtgtgtgtgtgtgtgtgtgtgtgtgttttccagaaaccaactgggaagggccctaagctgagattactgttgagaagtaaattgtgcttttaaagtgtcctccagcaaaatggtctcctggctgtctttggaaatgacgtatcagtccagatgccctttttcttgatggattgctaggatttttactcaccaccgatggaaaattctcatagtctggaagggtggagcgtctgccttctatcatgattgtacacagatgagcaaagctccttggcaatgagtgaggcagacgggcagtcaggttcggactggtgcagcaggtaggctgctgctagggaggaaggaagaggcacagaagttcagggcgtgagagggtatgcgagagatgtcaacaatccaggagctggcttgcttcttcctttagtcagtggtgcaagcttcaagtggataattcaaatgaatcaatggaaaggcctcttttaacatttgatttgtttcttcaaagaacacagatgaagtttttctcatctctttagattagtgattctatattggtgagggagtggaagagaaatgtgggtgtgttgactatattctccacagaaactttttgaagtagcatcgtcactcagcacagaacattttgacaatacacttccagggcaggtggtttcttactatgtccctccctacccccacatactttgggactcagaatgtagggagtgtactctcgagggatgcagcccatacgtgaatgcatggaggcagcatataaggttgcaaagcactgaccttctctttttatgattcccatttattccatagactgtgaagtctgcctgtacatttccaggctagcagtttttaatcaaatgtatgatcactttcttctgatgaacacagttaaggggctttgttgttcaggtgagtctcacattgtactcctctcctaagagcatttattattacttgctacatacatttttgacaacctgacaatgacttttttgtcttaatttggagaaaacatactctgagcttttgaagttggtgtacttgttaaaggaagccagaaaagcttttcaaccatttgagagggtgtgaaatacagaaggggttgtgcgtttcttcccccctcatctcttagagccctgttacccaagagagttcaccaattacccaaaccaagtttcattttgttttctctctagtttgaaaactgtttttattgcttcaactctccttgtctaggagagctgtttcaggtttttagagtcctaagaaaggcttcactggctctctgccagcctcctgtcccattacacgctcaggcttgtagtcagttactctctgctggttttgctaaaccactcttgggtctttcttggcctcctgccccgcattccccttcacgttgtaaacgtagctttttaagttggtcccttgattgcttcaagtaattgatctgttggcctaaaaatgagtggctctgattcagaggtaggagttaaaccagattctgcctagggacaagtgtgttgggagctctgcttctctggagacaatggtcagcagtgttgcaaccaactccatgtctggtgcaccagatggtctcattgggtggtagggtggccaaaccttgtgtgagctggctcacttgttcattcattcattcgtttactcgttcttttttgtattagcttaaaaatgcttatacgccggccatggtggctcatgcctgtaatcctagcactttggaaggcagaggcgggaggattgcttgagtctaggagtttgagaccagcttggccaaaacagtgagactccatctctacaaaaaaagaaaaataaattagttaggcatggtagagtgtgcctgtagtcctagctactcaggaagctgagatgggaggattgcttgagcctagggggttgaggctgcagtgagctatgatcataccactgcaatctagcctgagtaacagaatgagactgtccccccaaccccccaaaaacagaaaacagtattcctatcatatgcattctcaactctgcagaggtcctgggtcacatttcctgcaaagttgcactgcctcccataggcatgagacctccacatggacagaatttcatgagtgttcaccttggtgttgctactttgcaacatagacttgaagattcagagaggagatgtggtaagagtttatttctggacagagaaaagctacaccattcatctagatctcattaatctgtattcattttgacatgcttttctgcagttgacgtttttatttattaagcgctttacaagatattcagtatcattatcgaagctataattattaatgatcaaagttagcagtacttgttttagctgtcatcttcatcatcaccatcaccatcaccatcgtcatcatcagggccacaacagcctcttcttttctcttaaatcttccagcaattcttcaactttgcctgtatatttatcatacaacataatcctagtatttagtaaatgcttggtctttgatttcttattttcaaatgcatgtctttagaaccagaatgtgtgtagctgttttctggcctgaatttgggctgagatgatgagaagtttagttgccactttcagctaagtggaagtgttttccccatttggactccgggtcattgacaaacgtcatcactgtttttagttgaaatgtgcttccatgtggctgttcatcagcacacccatatctagacgtgtgctagcctcagtgagagttgcagaatctgtgtattcatttcctttatctagaaatcctcattatggtacataaaagagctttctatcgcttttttacattatagtagttattcgttattattattattattattattattattattattattattactgagacaccgttttactctctctttgcccaggctggagtgaaatggcacgatcgcagctcactgcgacctccacctcttgggttcaagtggttcttctgcctcagcttcctgagtagctgggattacaggtgcacgccgccatgcccggctactttttgtatttttagtggagacagggtttcaccatgttggccaggctggtctcaaactcctgacctcaggtgatccacccaactcggcctcccaaagtgctggggtttcaagcatgagccaccgcgcctggctttgttattatagagttatatggatttatcattttaggtggagatttgagtttatgtctcctacagacagccgtagactttgtttcattttaagatcagtgttgcagacactgctgagtgtcttcaaatgtctgttctccctttattacctactaataaaatacctaattttcaacagcctgggaagagactatatttccctgcttgcctttgcagctagagtgatcctttgatgaagttctagtaaatgggacgttagcagaactgtcgtatctcagggcttccgtagggtttataactgatccactgagagataagttgagagcttgagagtcaacctttagaaaagttcgtaactatttgtcaaaattaagcttatgtctgttccaggtagtaattttaaaatgggcttatattttgtatgtcctttttaatttcctttttctagcaattctcaatgtttttttaaaatctcttctggaggagggtacccttcacaaagttatttgccaaaggtctgaggaaaaaaaaagcctttcaccatggttagttcgagaagcacagcaatacagtacttctgctacgagtgtatacaggctgaggatgggtgctttgtggcccttttcttttaccggctgactagaatgttgacgttaaagcagttagagttcgagcaggcaactccgaccccaagttggagctgtgtgttgaagatagaagagcaaatatgtggaaggaacctggatttctatttttttaaaaaatataataaatcatccagccccaaatgtcaggaacctgggtttctaatgatggttggctgtcacccccatttcccacactttaaatgagagaagtaaacatctgacttcctaaaaccaccgttgtcactcaaagccgaatctcatcctgactgaaatgtcactagtcctttttttttttttttttttttttttttttttttggtcatattttctccatttggagaggctggctgacccatcaatgggcagtgtgggggaatggagagacctgggattttggggacaacagtgaccatgaggggatctctacactcctacttggaaatggagtagcattctacacttaagtatctccctttataagctaggaatactaagaacctaagagtctccatgaggattagatgaggtaatgtttgtaaagaatctgagatatagtaagttgatcagcatatgttatttatcctcttcttccctctacaaagataactaagctgagatagcctaactcccccagctcagaaaatagcaagttatttgcaaaatcaaatgctgatgtaaccatttccattctgaactcagaaaatggagataaatctcttgcaaggcttttgattttagtttttagatacagaacctttaaaaaaaaagaaaaataaacgttttgccaaagtgtagtatatacaacagatgtgagggaaggacattgttttaagtgggaaacgtcagctctctcaacttctacacattcgactattccctactcctcagtgaccccaaagaccccagagaaactcagtatgaaaaatcactatggaagtgcaatagttattactttgtttggaattcactacaacactgtttctcaaaatataattcctgagtcacttggaagattacaaccaactgaattagaatctctggaaggcatcctaagagtctgcatttgtatgaagcttcccaggtggttctgctcagccctaagtttgaaaactactggcagaatagtagcagagttacttattctacattcgttttttaacccattgtaaaaatcatacatgtatgttcaagacaccggcagatcacaggaagggaaaaaaaatcacttatgcttccaccaccttaacctagaaacctttaggacttttcagtacttcctttctgtctttttcccctatacctaagtttttatttacaatatagttgtagccatatgattgttgctttcattgttgcttacatgtgttaaataattttgtctctgtataataacaacctctggcgatttttcctttctctctctctctttttttttttcttttgtttagacggagtcttgctctgtcacccaggctggagtttagtggcatgatcttggctcactgcaccctccgccttctgggatcaagtgattctcctgccttagcctcctgagtagctgggactataggtgtacatcaccacacctggctactttttgtatttttagtagagatggggtctcatctggtgatttttcaagtaaggtaatggaagcaagagaggtttacatacatggtgtacatatacctcggcagcctgtttccttcccttataactatctcaaaaaaacatattaagttatttttcagaattatgttttttcctgttgcttttgactgtaaagggcagacttaaatttagttaacatctgctctaacgttggatcatgtgtggagtccccagttttcaacattaaaaataaagtatttgttgaagtggggtttttttcttcttacagtatatgtagaaccattttcttgaaaatgtttcttagaaatttgttacttagaagatttgagccaatgatacattgccgagatttgtaagagtaagaccagcctacgctgagtattattttctcaaaggaatattatgaggcacatcccatcttcatatcagggaacaaactgtcacattttagtgaaatctgtgggttatgtgtgaccacacacagtgtcgtgtttgctccctttacagaaatctaagtaaaagaatcactttttcctagtatctggatgacttgatttcttactatcttgggccttcttggaaaccctgaaatgtagccttttcatcttaattcacaaagtgttcattctcacccttttccttcatgagaattttctgaagctattgtgaatctatggaagactcaaggtagtatctttttcacagcattcaaaaaaatgctgctggctccttggcttgtccggtgcatcctccgtgccagcccccgctgtcctagaaccatctaagctaactctccgatgagctctggcctctggacctcagcctatccaggccccttcatgacccagtcacagtgattctatctgtacctaccacagctaggtaggcggtatgggaagaccacaaacttgagagtcagacggatcgaacttcgtctttagccccccacttaggtgttatgtgactgtggtcgggttattggtaacatcttcttgctcagcttcctgacctgcagaatgggaataagaatacctagcacatagggttataatgaagatgaaactgcttaacgcatgtgaataacaacaatggctaacatgtatcagacgcttgtcttagtgtttattgttttatgcgtattgtcctgtttcatcctcatgcttaccctgagagaaaggtggtattattattcttattttgcaggtgaggcttaaagaggtcaattattaggttgaactgtatgaaatgactgtttttatagggaaaaacagtagccgatcatcaattccctaaggttccacgtaataatttgtccaggtctcatagcaaaaaggtggccggatgaggatttgaacccactgctctccaacccctaagcccgtgctttgtagaattaatcggagctctaaagtacttgaccctgggcctgacaccaatcaggagcttaaaacccattagtttcttttttgttttatttttgcccactattaaaatgtgccaaagtaataagatcaaacagggcccctgcgttttgacaaacatccgaattctgaatttcagcgtggaacagggcatggaaagcaaacacaatggggaaaattgccgtggccggtcccgacaatgtgtggattaaaaaaccacatgcatgcacagagacctgatgtgaatggtatttctgagtggaagctaagtaggagctgaaaatggccttttaaaatacagaacataaggatgcaattcacagagatggtctaaactgtaaacatgcagctgtggggtttgtgaggctcattgcttacataccgacagcatacaaattgtcaagtacttaaagttccattgttgctgaaagggcctccacccaatgtccttaaatggtccccccttttttttttttttcaaaccacaggatttacatctctcgtagcatctaatgaaataccagcaagaattgtgtgttggtgtaagaaataataatctttccaaatccttttgttttgttatcatttgctaatagagatctttgaaagaaaattcaaagattgaagtttgtattctcctaaactcctgcaaagaagtcctgtgcaaggatcgttcactagtgttctgcatcgttcttcttactcaactctcccgagaggcattgtggacgcctgtggggttggtttttggcacccatccctgaccccttcttctccaggaaactctgttcctacctgctcctcttgtggctaccttgggaggtgccatttttatcaaggttagtgtgtggttaagcaccttcccacaagctcaggggaaaaaaaggtcccctccccagattttttttagaactggaagtttccatttcctggcactggtgaaagctctaggacataaaacttgggagccgatggccttcaggctgcccataatgtgaagagaggtcatttcagacattcagataaagtctgtggctccagtatttttctaggtcttgctccctccctgaccttttcacagtttggtgacacaactcttccttgaattccataggttgacaaattcccctgagtttgggttagggttttgttacttgcaaggcaggcatcacagggctgctcctggccatgcatagctttggaatcacttctctgattctcatggctcgggaaggagaaagtgtcctgtgtgtggagatggcagggtggctggagttgagaggagagtcccttgaatgccacgcaacatttctctctgtaggtgtcctctgcacactgtccaaactccatttttaaccttgactgcatagtaccgtgtacattcattaagcatccctcgccataggagaatctgagttcctgggagcatttaacacagttcctggccttgagtaaaaacttcataagcacttgttgaattgaactgaatttgttgtctgtgtttaaaggacttgatggataaagggagatttaacagtttatagccagattggactcaaccatgatgatttctggtccatcttttagaatgtcttcacttctcttggcctttatttctccaagtggtgataatgagacctatccctaacggttaaagtgacatggtccatttaaagtgcttaaaccaattgccaggcacataataggtgctcaataaatacttcctttatttccctgttaggcctctcccaaccagagatcaaagatgattggccctgaagttatttttccccccaaatttgatagaaatcagtagagatgctaaaatataatacatttgacctgcattgatcaaggtaggctaactgctataacaactttacaattagtgccttaacataatataaaatgacttcttgttcatgtaacatccaaggtagctgtacctagttgcaatgctctcttccaagtagatatttagggacacgggctccttctatcttctgtcaccaccacctttatttttagcatccgcggtcttagcaacagtagaaggaaagaatggagataagacagtgggtatttaatcaccttagcccataagtgactcacgtcacttctgactaccatatccaatttttgcctctctttttttcttgggttccccccgacaaaaaaaaatatgacagaagtgtcacccatccagccagccagccatcaatccggtatccattcatccatccatccatctaggcatcccaggtgactcattcctgtgaccttgggagacagtctttcttcctagaggttgtttgccccaaccccctgttacattcttgaaccatatgtttcccattgtttgcacttcccctagtcacctggtgctttaatttttgcctgtaaccttctgaaactttccttaaatgttcggctttgacctgtcattcactaagtctttcaccatccttcactcatcttacctccttcttctgtggcatttcataaatttaatgattgtaattgtgattacaacataattgtttatgtctaccccaggctttgcaacagggaactatatcattattttgcagacacaacaaattctgcaagcatgtatctttggaataaaggagagagggttggacacaaatgtgattacaacatatgcttctctgggcatagctttgccccattgcacgaatatagaaaatttggcaggctgaaaataagcggaaagatcctcaagctgttccttccaccccctgggatgctgattaagatttcagattttatttattctacgggtatttgttgaatatttatttcttacgataccacgcactgctttaggcactgggaatatagcaggatatacaaaacagaaaaatcatggccctcatggattattggttgtgagtaataggaacctttcaatctaacttaggaaaaaaggttagggagccaaggaggaagagtgggtgtgatgatgcatcaggataccagagaatcccgtggaatcccacagtgacacagccaagccttgggaggggtgacactagcgatagagacagaaacccacacaggagtccttttctctgtctctcatctctgcttttctctgtacatctggttcaattattctcttgccacgaatcagctatttgtattcctctgtgcacgtcgcagaagatcaggaatttgcacattatagtcacaaccatacctagaaccaaattgcctaacactgaatcccaaatccaaattcctgggagatagaattcaattcttctcttgccacaaatcagctgtttatactcctctttgcacgttgcagaagatcaggaatttgcacattatagccacaaccatacccagaaccagattgtctaacactgaatctcgaatccaaattcctggatttggatggactcaatctggacccagtatctacatttggtccagtcatctgtatccggcatcggggtcttgttgaaaaaccatggcttagccgggtacagtggctcatacctgtaatcccagccacttgggaggctgaagtgggaggatcgcttgaagccaggagtttgagaccagcccgggcaacacagggaggcaacatctctaaaagaattttttaaggaataaaaaggaaaagcatggcttttattctaagagcaaaggcattttgtatatttggcaggtatcccaacagatgcatcacccagtctcttaaattaagataataatttatttggcaagtgaattcttctagtgtagttagatagtgatgaaaagatttttatacctccaaacacacacacgcacatgcacacccaccaggctcttctttacttctcactcatagatttgaaaacaactattatattatagaagttttttggtatagctgccaggggtcattgtttccatcccctgtgtggagataagaaaatcgagatccagtggagtgtggggtgctgagagaacaagtctatgttttcttgagacaaagtcttgatctgttgcccaggctcgagtgcagtggcagcatcttggctcactgcaacttctgcctcccgtgttcaagtgattctcctgtctcagcctcctagggagctgggattacaggtgtgcaccactatgcccagctaatttttatattttcagtagagatggggttttgccgtgttggccaggctggtcttgaattcttgacctcaggtgatccatccactttggcctcccaaagcgctgggattacaggcatgagcctaactatcctcattaagccatctgctttctgcagtcattttcatggcgatgtgttataacaggacagaccttgtactttggaatcaaacattctcaactctgctatctgctctttgtggggccctgaacaaaaatctttactctctttgagccttcgcttcctcattggtcaagacttttctcactgcattatatttgagtgagacccgtatcaatggattgaaattctcagaaacccaagaccaggaatagcccagtgacaggaatttagaccatgccaagtgtgaaccatggcttgcgggggctcctgtctcacgctggatgctcctgcctggctgcctctggtctccagcagaagacctgtcgtgcttgagtgacaaagcagattgcttcctcccacctctgtgggttaggacccctttttctatcctagtttcactctgatgggcgagttcactcacagtgaaaccgtagcaaaacctcaaggtttggcttaactgcaaaggggtggttgatatcagattcatacgccagaaccagaagaccactcgtgagaaattctgtaagcacaggagtgtggtttatgtcaaaatcaatctgatggagtgaagccattccttgccaagcgaaaatacagcatcatcaactacatccttgagcctagaacctcttcactcagcaccagctagtgggtaaagcccgggagaggttgtaacaaatctgattccctgacactcacctgaaacaagattcagcaaaattaaaagcaatattaatatatgtcgccttgggaaacagaggcagaggagaacaggaaagagtcagatggactttgatttgagacccgtttctgcttcttcccagggtgtgacctcagcggagttccagagcatccatctcctttgtaagacacagataataccaactgcatggatttgttatgagagttacatcaggggagggtcatgaggtcaccttcccatggccaggagaagcaggtactcaggaatggctacttctctggccactttatagacctatggagatgttgaaagtagcccaaaggaactgtgtgcctcgcatcttggtccatcttcatgggttgatcattgtggttcatatcactgtttcatgaaacacagcccgccagaaagtcgcgagtgttttgatttcatcctatacctatagttacaggccatttaagatccacagtctgctcttttagcttctgccagcacatttggacatctgtgcagttcccagggcaggtgaagagttgttcatgtgatgcaaacttttgagaagggacgtgtagggaagatgggagggaggtgatatttattgagtattttctttttgctttcagctttataccttgtgtgtgcttacagaggtcatgaattgtccgctgttgtatgtgtaatccgtggcagatgtgcataataagttcaggaggggctcggttttgggaggccggggatactagaagataaccctaaaatgtggaaatctacatcagagagtggtgtgagtggttcccaaaatgcctacctggcactcctaccaaagacacagcagagaacttggggcctcttgtttcagccattttcatcttcactgtaaatctagacaagataatgaatgaagaacctgacacatttaaggaactccatagttgggagcccagtgtgagtcattatggcgagtccctaacactgcggttcccctacttgagggcgcaggtaggggcactttgctgcctcctttgacaataagcattgccattgccatgtgatttgctttgcctaatgaaatgtgagtgacacttccagatggaaatattaagagccagtgtgtggttcaccctgaccccttcctatgccccagcaattaaggaagcaatgttcagatgaaacccatgtcttcctcctgggtccctgagtgaccacagtcaacagagcttccctgttggccattactaatgtcaagaacaaagctgtgtaaagtcactaagattttggaggtatcggctgttgcagtagaacctagcctatctcacctgacacaaacgttttctttctcacaaaacctcacaccagtgttgttttattcatctgcttatgcacgcgtatggctgcaacatccttccaaaatgcattacaggctctaatgcacgataagacagttaggttcgaaggaaaacaaagacaattgcacggcacagagggaatatactgctacggtaaaccgatcactaacacccggccctgaatttgcttcaaagttttcactaaggcacaaagggagccgtgtggagctccggagttcccatctgaggtcttgtctaactccttggcaacttttatgtatttgtataggagactcttttgccagatggttgaaatgttcatcctcctattttgttttaatgcaaactgacatttcttcatcttcctgcggtgggtttcttttatgaggtcgtgctttgcattttcatagaaagaatttctgactcccgatcggagcccacccttgtagtttctgtgggggctgttttggttaaccactcgcatcagttttaagtctccacaggcagaaccagaccatcgtgaacttcttgatttacatggtggtggagagtggctgagaaaccagggagaaacaggaaggagctgattgaggagaccaaaggagggtggggccgcagctctcaggcactcttggtgttcagaaggccagcttgaagaaagatgtgcatatttgcaaatgcatttcttgttcctagtgaagaggtgaggaaggacactgactgtgctagagctgtacaaagagaagtagaactctaaatagagaaaatatgtaaagatcaataaatcacaccaaaaataagtcataagaacaacaaataataccaggaataaataatgtaaaatataaataattcctaaaatggtgataacagcttatgacaagtaatttcttttttttgagatggagtctcgctctgttgcccagggtagagtgcagtggtacagtctcggctcactgcaacctctgcaacccaggttcagtcgattctcctgcctcctgagtagctgggactacaggtgcatgccaccacgcccggctactttttgtattttcagtaaagatggggtttcaccatattggtcagactggtcttggactcctggcctcgtgatgcacccgcatcggcctcccaaagtgctgggattacaggcatgagccaccgcacctggaggacaagtaatttctaagtattatttcttttaatcctcacagtgactccttgttagggtttgctgcattttatacaaagaagaaaggagtctgtggaagtgacataaagtaggacatgtattcatttactgattcaacctttcatttgtacatatatgtatattttacagacacggtcaccctgtctaggtattaacagttattacaaagatgatataattttgcaatcaaaatacagacacagttgtctgtctcccaggctggagtgcagtggcacaattatagctcaccacagccttgaactactaggcttaagcaatcctcccgcctcagcctcccaaagtgctgggattacaggcatgagtcgccacactcaattatacacttaaatatacatatatatatacaatatacatatgtaaatatatctgcatatacatgtttagggacaaaaacacgggagtaccatttctgtctttgtctctctctctctttctctcacttgactctgttgggagctatattagttgttttctctttccaaaccaccttctggaggtctcttagattttcccaatgatgaaggagctactgtctaggttattacagtagtaatagtggccaagaaaatgatatgaggttgaagtggacagatgatgcttttcactcttctgggaggttcccactgggtggtctgctttgctgagctttgaaaaagagcttttcttcttcccagttcactgggccgatgtgggcacagcctcaggttttggtttttttctcctttgctccttcaccacctagaaaactaatttcctataaagaaaatttctctggaaatgcaactttctcaataggttgagtctactcaaagactgacaggtaaaagtggtccacatagaaaaacctgtttctctattttgttttcaaaattatatcatctttataataactgttagtacctagaaaaatgcatacattttattccttaccaaaaccagttaccctatagtcaaaaggcattcagaagtattagcagaaatgtagtcagtagccaggcatagtggctcacacctgtaatcccagcacttgcggaagctgagactggaggatcacttgaggccaggagttcaagtccagcctgggcaacacagtgagacctcatcactacaaaaaataaaaacaaaaaaattagccaggcttggtggtacatgcctgtagtcccagctactcacctgtagtcccagctacttgggaggctgaggcaggaggatcgcttgcatccaggaggttgaggctgcagtgagccatgactgtggcactgcacttcaacgtgggcaacagtgtgagaccccatctccaaaaaaaagagcagtatagtcagtaagaaagaaaacaaactaacagtcaatattgtggctgctctcaatgttctttaaacggatcacattgccacttttttctctttgtaaaaatgaaaattcccagcacatattacatgctcaataaatgttaattgagcattttctgtctgagaagttcaggcaacttttcatccttccaattgttaagttctagtttcttattacaaattattactgttattattttaatttgattgatatgcaaaagtcaaatttgtgcaaagaaaatgcaagctttgagatgagaaagcgtgtcttctggtatgtttcttgatacattttgagggtattgagctctaatttacttaagatgaccttttgaaaatagattaacttatcaaaacttgtggtggaagcaagactttgtcagtacagtactatccaaattctaaagtaatgaatgcttctctccctctggagttagagacctgactctggggtgtggataaagaatttgtgtcctggccaggtgcagtggctcatgcctgtaattccaacactttgggaggccaaggtgggaaaatcactagagtccaggagtttgagacctgcttgggcaacatagggagactctgtctctacaaaaaataaaaagaaattagccaggcatggtgctgcatgcctgtagtcctagctatgtaggaggctaaggcaggaggactgcttcacgctgggaggtgaaggatgcagtgaactgtgattgtgccactgcgctccagcctgggtgacagagtgagaccctgtcccaaaacaaaataaaacaaagagtttatgtgttcagtaagagctgcagtcacatctctagtacagactctgcagagcactaggaagccccgtgtctgaatgggatatggtgagagaggcagcctagggaatggagatacctgggggtccccatctgctcctgatggacagctcagatgaccccaagaccctctaccaggcactgatggagtaaggatggagatgggaattgcattttagaggtaagaagccaagtggcatgatgaggagagtattcatgaaatttatggaacagtctgggggaaatgccatgatttcaagcccttcacctaaatcttcaaaagtggcatggatcagtgcctctcttccccagccaggagcgtgtgaagcatggggacctccggaatgttctcagaaaatgcttggttcttcctgtgttgagcagggaagaagctgaagctagcatgggcaggggagaagaaagccagttacatatcaaagaatgcttatctccgtagacaccactgtgtttgagagtcacattgggtggtttgtaggcagcttttcattttcacagccagtcaggcaaggcttggaataacttgtctaagaatcctcatcttaaccctgtgctagaacaacaagcttggaaggagccagccaacaggagaaagccagagcaagactctgtgctggacaagaagtcctgagcactggggagttgacttcatattggaggcagagaagaattacctgccgatggctgttggcccatggcaacaccctagatcgttgcatttgtggtcctgctgaaagaggagacttaagttatagagttattggtacttgcaacactttctctggaatttggccatttctctgctcttttagtttagtacgttctcttggttgcgaggaaatcactgaagccacctcacgtaatgtgagcatgtatgctcaaggggaccaggaaatgctgaaagttcaggcctcggaaaggacaggatgtggaaggatgttctggactcaaggaggcctagggacccttggcaggaggcattcatgggtctgtagtccaaggctccactaccatctccttggcttctctcttccattctagcttcttctgcttattcatcacttttgcttcctatgaaattggtgcatcctggtcttggcctctttgagccctctgtatagtgtgagctcatctggtactcttgactctctcaggctcctgaaggagaaccatcagatagaagcatctcatctccccaggccatgccactgggcctcagccaggcttgaactagctaggctcagtccacggggtggccttcaagcagcctagacttggatccctaagcacagcctgtggatgggacgttttaaggtaaagggaggacgcagagcattgcagcccgttggttgttttctccagcacagccatgcaaaatccatgtagcggcaggaattttgcagctggagttgctcccctgagactctgatcagataaagacagggtttgctgaacaccgtaggtctggccctgagccgtgggcagcctgatgagcacaggtgaatggtgcaagggataacctcacagtcatcagcaagtcttatctgggccgctgcaaatatgacggagtcagaaaaatgacaacataaagaaatgcgatgttttctatgggggtttctttttgaaactaaaagaggttttctagactcactccatggagaccactttactttccatttttctcagatgataacatctgcaggggggctccttctgtgggtacatcatttgtcaaatatgtggtccatattgagaaccgcataatacttattaattaccacagttgctacttaccgtgggctgctaagactgctttagatatactgcagatattcaaagagaattcatcgtccacccaacggcaaagtccatagaagcccaggatgcattctgaccctcatcctttaaagcttactgaacatattgatcacctcttttccaaaggatacttcctattggagtgtacttttaaaatctattttttttgtcttaatgtttagtgtaatgagggagtataggatgaactcaatgtaccttgaacatagctgttgtcaggaatgaagccaatttcattttgcctgaattagggccctttggtgtcttttctgtatgcagttaatacagttcgtgtgctgtaccaagggtgcgaatgtgacttttcatcaggaaggccgcatatggtgggcacagggcctagctctgccgttttatagctgcataactggtttcttgaccttttatgagtctctactcatgttttatatggagacattagtcatctcacaagatttttgtaatgattagaatatttgtaaagttcctggcaaaggtttgattataaattagcgtcatcatgaacgttcaaggtggggaccttttttttttttttttgaggcagagtctagctctgtcgcccaggctggaatgcagtggcatgatctcggctcactgcaacctcctcctcctgggttcaagcgattcttctgcctcagcctcccgagtagctgggactacaggcacacgccaccacgcctggctaatttttgtatttttaatacagacagggtttctccatattggtcagggtggtctcgaactcctgacctcatgatctgcccgcctcaaagtcccaacgtgctgggattacaggcatgagccaccacgccctgctaaggtggcaatctttatacataaaaaacaggaatgacttcttcgaattggtgcactagagaaatgttttccagtcgcctaagcgtttaagcatggtaaacagattaccatattagttgcccagaccttgcaaaacttcatagtgtttgtttgtttcccttgggaggctgttctgagaaggaaccttttcattcctcggagttctgatgtgttcattggcccctgttgtcatgctggatatgggggcggttcaaggggggcttgggtgcctgagaaaaagagtgaaaaacccaactgcgaaaacccaagagaaaccgaaagagtgaacactggaaaaaaaaaaaagggggggccggcgagcttcaggacctaagcggttaaggaactggctttgacaggaagtgggcaggaggctgttttcagtatgctcatgggaacccagctggaaagtgctgtggtgagtgtgtgtggaaaaaaggggctttaatcaagctataaatatctgtttctttgaagttttatgaccaacaattaatgttactggaaggcccataaaaagggctgtttcttgacttggtgggtctgagtgggccagggtcgggttaagatgctagcctcgtggggtgccatcctgacagattctactgtgtgcgtgtgtgtgtgtgtgtgtgtgtgtgtgtgtgtgtgtgtgatataatgtgttgcattggtgtctaaagccatgctcagtatatagttatatatttcattcattcatccgttcattcagttatctcacgtttctggagggccctctatgtgcaatacctagtgatacagcagtgaacaaaggaaatccctgccctcagggagctttcattctacttggggaaagagacgtgaaagaaatcaagacatgcaagcaaggataagtgctgtaaagataattcattcctgtttagagggctgaggacaggaagacgatgctgtatggctctagacagggttctgtgatgagtggcctgtggacagattcctgtccgaagaggtgcagggtgcaagggaggaggggacggcaagtatcaaggtcccgagtgaggcacatgctcggcggggcccaggcatgccaccaaggccaggaggagagactgaggaggcttggccatgccctgccttgttggtttttagaaagactctgttttggttattttgtttttctttttttgagacatctggagtgcagcggcatgatctcagctcactgcaacctttgcctcctgggttcaaacaattgtcctgcctcagcctcccaagaagttgggactacaggcattcatgccaccgcacccagctcaaatttttgtattttttgtagataccatgttggccagcctggtctcaacctcctgacctcaggtgatccacccacatcggcctcccaaagtactgggattataggcacaagccaccgctccaggcctagaaagactggattttaccctgattgagcgagggaggctctcgaggttttatttggttctgcccagtgaccagccaccataaccacatccttcccccagactttttcctcttcctataaaacaaaacaaacaatgtgaacaacaaaagcaaaaacaaaaaactaagtagtagttggggcatttttattttaatgctgcttttttttttctcaccttttgctatatgctgatcccagtgcatgaaatttttttgtaatctcattcctgtgttgaagctctttcactgctttcgtgagcacagatgaatttgaaggctgccaggcagtagcaacatataccagcttccccactgggtgttcattctacccaatttttgttcatgtggacttcaggaatctgggatttatgatcttcggatttggctcttggcttgaggcttagcctgtgcagtcatcttggagagagggtttactaagcaaagaacaccccagaacaatctgggggaactgtgccctttgcaagagagcagttttaaagtaccctcgggcaatttagaagctcctactgactcaaggatattcttacctcttcgttaaagcagctcgcctaaggactttgctagataaaagttggttttctcaagagggtttctgcacacacccgaccgcatctttttcttttcttttctttgttttttttttttttttttttgagacggagtctagctctgtcaccaggctggagagcagtggtattatctgggctcactgcaacctccacttcctgggttcaagtgattctcctgcctcagcctcctgagtagctgggaccacaggtgcatgccaccacgcccagctaatttttgtatttttagtagagacggagtttcaccatgttggccaagatggtctcgatctcttgacctcgtgatcttttctcgcctcggcctcccaaagtgctgggattacaggtgtgagccaccgcaccgggcctcacgtttttcttttaaagaaatgtgtaattcagatcagtcttgctttcaggtagtctgaattaggggagtttgcctgtgtgcaagagaaggcttcctacttcattttcttgtgtgcagggagccatttatgactaataggattcattacatgtgtgtttagcccaccgattattaaggctttaacaatattaaaacctaaagagataacagaggggaagcctttgggagctaggaatcaatcgtgctgggtggcttgaaaacagggcagtaaaatggcagccgcctagcctgtggtctttaatattaataaagccagaggcgatatcacttagttgttccaacatgattggttcctcatggatgtgcacccttgctcatcaccatctcaccaccaggctgaccctatacatcttccaggagcccagctctttcccctggaaatggttctctgagtttcagctgcagttcagggaaaaggccagcagccacgttccttgttttgtgtaattggtctttagcctgatctgattcatctggcgaaacccctttttccagtaaaagtcgttggcgaggagtgaattgtgatggaaacagagacagatgtatgtacctttcatggacataatttccccaagactgaacacaaaaatgagggtttttggagatctctctggaattaatgtaaacgttgttgaaaacatattattctatggctccttcataaaccctaggccatcccgaggctgtctcactcaggcccctcagccctcataaccccccagctccataggagtggagtttggatttcaactagataaggcccattttcatggatggacatgtgagttttcatctataatatagaatgctattttctagttaggttggagcaaaagtaatcgcggttttcaccattatattcaatagcaaaaaccgcaattacttttgcaccactactttttacctagcagttcaacagctgtaaagaaagatgctgagctgttggttacgtaactgtggtacagccatttcatagacaagtctacatcaatgaaaagaatgacacttctaaaggaaaaaaaatgggcaaaaattatgtgtttacatctatcagaaaaacaaaacaaatgtcacggtgtggttgggaggaggtggggagagaggcagattttggaggcgaaagatacacagaaacactaaatacctgtctattaatactgacagtagttgcgtttaggggatgagactctaaatttgtttatttaaattttctcattttaaaaaatgagtcctttcaattatgagatcaaaaagaaatgttcagtggcttattgtgacccaacatttttctgtttgatttagatagagcttttatttgcctaaaaattgtgcttgcaatatatatgatgatttttttttcttttattaaatgaaaaagagtcatttaacagtcacagtggctcagccaccacccgcagcaggcagtgggcccacttcaccttcccagcaggcctccagtgcccggtgcagggtggcccattggcacccacaacaaacatcacgacattacttttaccgcacacttcctgtcgaggcacaggcagtgcttcagcctttttggtaacttgaatgaacatcaaaaggataatcagatattagttaaacttgttcctcttctccaatcattgatacttttctctcttgcttcccctccccctgcccttcgacacagagtgacaggcctgaagtaaaaagggaaaaggggaaccgagtgactcagcccagagtgggcctcaccgcagcttcctggccactttctcgctctctccttccaagagagaaaggggaggaagcccagagccttctatcacttagtaccgtgtcatataccacttccacaaatgctagggaatgaacgaatacatgtatgaatgaatgaatgtccatggggtcactcagaagtagtggcataatttagccagataaagtgcccacctagcactcatcccacctcctcactcctctatcctgtgaatgcagaaatacaattcctcatttacaaacaactgtgcatgtagggttgcttgcaaaagttcgtcgtgtgccgatatttcattaccacttttgccagcgctctcgtctgcatttcctgaggtttttcttttttttttttttttctttttttctttgatacggggtctcgctctgtctcccaggctggagtgcaatggcacgatctcggctcgctgcaaactccaactggttcaagcaattcccctgccttagcctcccaggtagttgggattacaggcgcccgccaccatgtccagctaatttttttgtatttttagtggagactgggtttcaccatgttggccaaactggtccagaactcctgacctcaggcagtctgcccacctcggcctcccaaagtgctgggatgacgggtgtgagccaccgcaccaggccatttcctcagttttaaaaagcaaataagaaacaacaacaaactgcatcagagtaaccgtttcaaaaacccatctcaggtctgttttttcttttttttttaagttagcattttctagaagttttggtataaaatatgtacaaggatacatatataaacttagtgaccatctgaagataaacctggaatgaggaataacaacctctcatttaaaggagttttaaagagacaagagggaggaaacgagaagagaatgacagtgtttctttcattaaaaggagcccaatatttattgagccaacaggtttacactgtgtctaccccagagtgtcatcagcccaaaccagatcagcgtcgtgggcgatttttttcactttactgctgaggggatttgccaatcgcctggtcagcttctgaattcttcgggcacacaggaggggcgacatggttctggcttatttctaagtccctttgaggtgatttctggtccacaaattgaggcaaaataatcctcacaatttcttggatattctctgccccagccccgttctattgcaaaggaggcttctctaaaaggcttcccaatgccttagaatctacttaagggtatttttgctggagaaagagctgctgtctttgtccacctgtcgttttcctttctaccccaacagggctttctccctctggctgttttatttagcgggagaagacagaagagatggaaaaatggaccctgcatttatagctgttccttcaaggagctcaaactgctttcaggcatttccttattacctcattaatcctcataatggtcccttggcagaattattcttattttcagaatggagaaattgaggcacggacaaaataaatggcaggtggaaggtcagagagccaggcagcagaagaggtgggggcagcaggatggcttctggtttctgccctggtccatcagtcagaatgtcctcttcagatgaggagatgcagggtgaggcgcgggggagctgacattgcataaataataaaacaaatggagccacatttagttatcactcatctagcggaagtcgatcttcttgggacatgagtaggctctaacctggcaggtttttcaacatggaaccattatttgtcacatgtgttctgtgtgccagggactgagttcttctcaacggagtttacatgtgagaggagcaagggacaaacctcacaaataggaatacagacctcagaaagccgacttcacccttgcatactcctccaggttgccctcgcctcccgcctggatcactgctcaattctctctctctcttttttttttttttttttttttaagacagagtcttgctctgttgtttaggcatgatctagctcactgcaacctctgcctcccaggttcaagtgattttcccacctcagcctccctagtagctgggactacaggcatgcgctgccacacccggataattttttttttttttttttttttggtatttttggtaaagatggggtttcaccatgttgtcaaggctggtctaaaactcctgacctcaactgatccgcctgcctcggtctcccaaagtgctgggattacaggcatgagccacagagcctgaccacagtcctttcttttaagggcctcctggcacccagccatgttgggaccctttcagttctttctccacggagaaccagaatctcctttgaaaatatgttagatcacctctttctcctgctccgaactttctgaaggcgtcccctgttactcggagtgcaagccatgctctcgagctggccatggcatcctgcgtcctctcccttcccccattggctctgttcttcctgccagtgctcttccccctgctcactgggttccagctgtgcgggcctccctgctgttcaatggaatgagacccatgcccctcctggttatcccactcagagtgcccttcaacagctacagggctggcccatcctttctctgttaccttcggaggaagccttctctagataccatctttaaaacagcaatcttccttctccatccccagcagcacctctgacccccttcacctgctttatttttctccatattatcattgccatcaatccaagcacaatttccagttacttacccattttgctttctccccgctctttgagaatgctggctccaacagggcaggtatttcacctgttttgtttatgcctgcatccccatcactaggaacctcataggtgcttagcaaatttttgatcttaatacagaaattgactctcacagaataagaagaaggagcttgaagccgaggtttgtgcccagaagatctcactagattctttatactctggggagaagaaaggatcagggtcgggtggggacatctgtgggcatattggggagggggccaggaagaagccaggaagggggcatgctgtcattcgtgggttttgcaactttctgtggcatagaaggcatagaaggatctcttcatttaaaaggtcaggttggattttttttttttaacttcaacaccagttaacttacttgcttccatcataccctgtaggtactcgttatggacaggaatacatgtagggtgaaggctgctctgggtcagtggattcacagagaagtcagaattctcttttataaagagcctgcttttctcaataattgcataatgacgtctttgattcccaggccctcatgcctagctgtttccttaggcatttattcaagatccgagatgccattcgcaatccagcaggatgcatatttgtatctggctccaaaactttttttttttttttttggcccacatcactgcagcccatggcagaagagtctagcaattagcaggaactgaaagtgataatttattgcaaccaacgctgtgatctaatagtcacacattacaaaagcaaaatccatattttgttcgcagtggcaccgcagcgctatcatatgctccacatgctttctaatgtcttttgtttgtattaggaaaaaacataaccctctcctactgagaaccagagagagcccctcaggttctgagaatgacgacattcaacatcgtactccaaagggggttaggtttgtgtgctaggggtgaacgctgtgcaatttaattctgtttccaaaagatctttggaggataaaggatactttctgtcttttatttagggaaggcgatcatgttggcacagggcataagagagtagcggggctgagagtgggaactgaggagattcaagccttttgcccgtcgatcgcagttcagatctgttgattttgaccattgcatcttgcctcacatctgaacttcaggtgaagtttcaaaccaccaggcaacatgcattacaggcaaaatgataagtcaggtcctgccgggtgactaaggcagtgtggcaatgcttcaagcctttaaaaccatatcccagtggccccaaagcattaatatgtctggaacattgcctgtccaatatctagagaggcgcctgcagaatttgattcctaggtacatcaagtttttgagctggaagaaacttgagacgctctttagtccagcaaatttcaaacctgtctgctcatcagaatcacctgggagcttgaaaacacacagatgcctgggcctcaccatccagagagacattcatttgattgcagattgaatccagaagctctaagcagaggcacagtcacatttggggactccttttatttagtagaggaggaaactgagtctcagtgtctgagacagacagtggggattgaacacagacacctgactcccagtgggtggtattttctcctagagtgcatttctgcttcttaaccagcagaagaaagcccattaactaacccctcaggggtcaccatgggcaaaggagtgcatattaagaactgtctggaaagaaaagaaggtcattggaatcttcttcaccccttccctggtactgatggttgcatttcaatggatttctccaaaagcaattatcacagtgttcctgtgtgttgagcaaacttcccttgtaatcaccttagcgttttcttttgttaaagagtaagaagaatggtttcatagtgaatttttcctaaaatgtgcagggtgtagaagaaggaattgcacacaatacatgtctactaggcaggtcaacataaatgagtagaggcaggtaataacccagatacactttgttggaaagtggaatgcatagaaatggtcttcatttctgcaaagaaaaatgtacattctcctttttttccttgcaatatgttgccttctctgtatatcttttaaaatttctacttctgatagagtaaagggtatagttttgtccgttttgtgttgctataacaaaatacctgagactgggtaattcataaagaaaagaagtttgtttgattcacagttctcatgcctggaaagttcaagattaagcatctggggagggcctcaggctgctttcactcctggcagaaggcaaagagaagccagtgtgtgcagagatcacatgggcagagaggaagcaagagagaagggaagtgccaggctcttttaaacaaccagctcccgtgggaaatcacagagggagaactcactcactaccatgaggatggcatgaagcccttcatgagggatccgtccccatgacccaaacacctcccggtaggctccatctcctgacatcttcacacaagagatcaaatgtcaacatgagatttggtggggacaggcaaaccagatccaaaccatagtgactatgatatatctttcacatttctctttacaaaaagaaaaacaatgtaaggtcccgtgacaattagccttactgccggggagaccataaggagtggtggagactgtggtaaactgcagcgcgcacactctgttaacagaggaggtcactttccattctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaactttttgcagtgtacaaatctctaatttgagacttctaatgaaaagatatttggttacagtatgagagacaagggactaaaataaggttgtggatcattcagggttaaatcagagcaacagcatgagtaggagatatatagaaacagatttattgcaaggagttggcttatgcaatagtagggttgcctaggcaagtctgaaatccatacagtgggcagtcgagagaggcagacaggaactcttggcatatgctaaagctgctatccacaggcagaatttcttcttctccaggaaaagaaacagttcttctcttaaaatcttccaaatgattgactccgtcacactcagaccatctaagattatctcccttcctaaaaggcagctgaataagggcttcaatcacatctacaaaatactgtcccagcaacaccttgattcatgtttgactggataactggaaactatagcctagccagggtggcaaacaaaatggaccatcccagggtagatgttaaaaaaaagatacccaccaaagataaataagatcaagattagaatgtcttcttttgataggatgtctgatttttctgaatttttgttcctaaaacataagattatttttaaaagcctgagaaacgagacattagtgatccgattcagaaaagaagccctgggtttaagccaatacgagatgggtttgtatctttaagtggcctttattaccacagtaataaacagcaaacgggcccaaatcttacaggcttgtgttggctttgaccaatgaagtagaacaagacctctgaataccccgttagttccaggctgtgctttgatggctctgcacagacagctcttttcctatacaagtcaccagcctcacccgtgtctcttaacaaatgttgttgacaggccgcgttgcaatttttctgcatgttctgacagtttaattcagtacctcctagctaagcactcagcctaagggggtgcttcagcaccttggcgtcaccaggctgcaattaaaataattcagggactggggctgggcttgcagaaataggccttcttccctttggaacatacaatgcattttccagtctccccgtggagcacacgagatccttttagagcagagggcagtggaatgtattaacaagatgtccactggcaagaactagctccatttgtatgttgcacccaacggggttttctccataggggttaggcgtaacgtctttggtaaacttggcacctgtagaaaggtcttgtggtgggcaggggggtgtgaatgggggaatgagaactagggaacccaggacccaggacccaggacgagagttcagcaaagaccatttacagaagctatccttccaaaacggccactcagaaatggtgtcttttattttgcattctgtacaggaaggacaaatggagaaaagtctccagaaattggcctcgtttgaaaggacctcatgcaaagagagatctttggagacatttcagaaaggtttttattcaaacatattcgcagcttgtatgacagtggaatgttttgaaatgagcttgattctgtttacccatccttcttaatccaacaactctgctggtctctctgctgacacaagatcgttcgcaggttatagaaggatttaacacgtcaggtaaggtggaatttggtaaattccccaaatttacaaatagatgaaagttgggtaaattccccaaaattacttgatgacaaagatcatttgggagagattctttcaaaaatgcctactccctattcccatatcccagcctaagggaatgagtttaagtgggtctacagtgggtcctgggaatttgcttcttatctagcatccctggtgaatcttttcattcaagccaatgcaggaagtagtcctctgaaatacatgtccacagaacacgccgtgctttccagaagacgcaacagacagaaactttccaaagggaattacctgggatcatttctcatcctctctctctttctctgtattacttagccttaaaaaaaaaaaaaaaaggactaatacttcctgctttcacatctactttccagatagttttttctagaggtaggaggtacataagagaaacgtgttttatggctgtggttttcaagaagtacagcgttttggagagagtggaaggctttcatgcatgaaacactcagggaggtaggagatccatgagatccaagctaaacaattctggaagagttacctgaagttgacacttaattcaagctgcatcatcttcctcctcccagcagatgaagaccaaaggtggagggtggtgggggtggggggcagggagtaggggggagggggggagggggtgtggggagggtggggcgggggtgggcaggttcagggactgaggccggaagcaaaacaatgtactggagtgcttatagtttttgaggaatcagtgagaaatgtcatctgaatgtctcttctcaatctttctgaaagataacttgcctataaacataaaattaaaagcttgctgtctgcttagttcaggtattgggtcagcgtcttgtgactatggacaagaggtgtttgactctaggactcagctacctcatctgttaaatgggcaaactgggagggtgtttatctgcatgcaacatctccttccatttgaaaacttttatgaatgtatggaatattattgagctggtgtgtgctaatacactgctaggagccattggagatttgaaatgtgagagaatgcctgctgtctgtcgcatttaccaaacatcatgcttttcaagattgttaaaagttgctgaaacccttctttgaaggaaatcatactttgaagctcaatatatagcaaacgggtagaagagttgctaagagtttgaaaatgatctcattaaacaagaaacatatatacagtgcctacctaggaaagagccaggcatataatagccactgcataaagatgtcaagtcttttggacacaatcctaatatctcggaggttctgaagctaaagggtacatgtttaaattttatttgtttcattaaacacctaaagactctttctagctcactcctgccaaaggcagaacttgagagtggcattcttttctggtctttgaagacgacaggtgaagggcagaatgtcctgtgtacttgggcacgcacatgcaaccctggctggtggctcctcctctctgtcctcttcctccctctcttccttctcttccttttcttcctcatcctccttttcctcctcctcttctcctttctcctcatcctcttcttccctcttctttgtgtccttgtttccatttgcttcttgctttgggcaagttctcaccataaccctctggcaaaggcaaatattcacctaagtggttaagtctctgggcatatttgttgatctctgctgagtctctcagcccgttttcatccctcctctgcctctccctagccattagccaaggccttgacctattgactgcagtgttgccgaagcagctggactccgtgtttgaaaggttttctgaagaggcatctattaatttatgtatttaatttctgtatgaagtgactgttctcctcccagcacaggtattaaagtacctttaggggaatccagcagctgaaatcctcagtaaggaaaaatgcttagagtgtcacaaagcaaacgcattagtgggaaatgtttaggggctcaagcacaaccacaaggattcactccttccttggattttgtgcctcttcccctgttcctgaggcccccactgggaacccttagctggagaacacccgtttcattatggaacatggagaaaagggtgattgtcagctccaatttattccatactatctgattcaatctgtagtttgactttgctaaaggaattaatttttaagatcttaacaaatccagtaacatttaaaatgacctatccagtccatgcatattagctattcataaagggttttaaacattattattaatcctagatatgttacttaaactattaagtccgttcaaggcattcagtttctgagtcctcaaggatggtaaggagagctgcaaatgggctcccttctcaagcaaaggcatcttatgccatcatgcacgtttctacacatctgcctgtagatacactctgtaggacaaaccaggtggctctgtccttcaggcaaagagctccttaattgaaaatgatgtgtgaaatttcaagagagaagtctaggaatggggagatttatgtactatagtcagtaaccaatcctgagcaaaggtaggcacagctatgtggtggtgcccttttttgggggggggggggcgggtggtgggggtacttactaaggaccttgcctaagataatcaacaatttttctttttcagccctgggaggctctaaagctggaatcaaaaagattcacaaccccacaaataggtgaactactctaaagcaatggttttcaaaccttgaaatatcctaacattgaaaaaaaatgtggtaacatagggttgcctgtgtcttattttggtctgtaaggacattaataatgttttggtaaaacctcagttatcatctgctattactgttatttcataagacacatcattttccttcaaaattacaatgaaaactcataagcatacatcaaagttgaaagaattttacagcgaaccaccattaacattttgctataatggctttatcatatatccattcatccgtctatcatatttgtaaaacaaataatattttaatgccaaacatatacaaaggatagatcagtaatttccgagaaatattagttgacaacttgacatcaaattatgtacggttaagtattgatacaaaaatacgcacgaatattaagtgttgaggcagatagatgcacatatgtatgtcaccatgtacctttgtgtctccttgcatttaaaaatgcaggtcatgatgtgtaatccccgttcctctgttgatcagtgaacacaaatgctgggccccagcatgagtccttttcagagagtcatttggagacctacagaaaaaaatgccaagaatgcacgctgggaattcattaagagatttcaggacgttgaaatactgtgcgtacttgcaatccccacttgaccaaaggtgtccaaacctcgacagacagcggccagagaaggccccatcatagactctgcgcctggctaattactcaggagcaaagcaggtcgttaggggtcagggggagggtgcacctgtccgccaccccaatttcctcatgatactggaaggcagtctccggtcagcacggggctgggtctagagttttcagtttacaaaagtggaaaatgtgatatgacagactggaaccagcacagggacgcagcccctcacctgctgggggtctttgggtgggtcctgtagccccagagcctctcgatgagctatgaacaggaacagaaccagcaccccgagtggtgacagtgacaaaagggtcctcagtaacagcagtctgctattgttttgaatcattcaaaggaatttttttattttgatagtgaaaacaatttcttttagatgtagaaagggtagaaaatacagataagcgaaaataacaaaagcagaacggtcatcatctcaaaactcagagaaaagggcaccaactccatattcgtacccatgtacgtattcatacccatatctatacaccttcccttatccctgtccctgtctacacccacacccatacctaaaccaatatccacatttatatctatacctatacccatatcaatatctatatttaaatctgtgtatttagatatttctagaaatgcatatatagctatttttgcttttataaaaaaagtcacagaaacaattatattgtacacagtcctatataatctgctttcttttgtttatagaatactgtgaatgtctttttgttttttttttttttgtttgcgagacagggtctcactctgtcactcaggctggagtgcagtagtgcaatcttggctcactgcaacctccatctcctggatgccagcaatcctcccacctcatcctcccaaatacctgagactacaggcagtcaccaccacacccagctaaatttcttttgtgttgctatttttattagaaacggggtttcacctttttacacaagctggccttgaactcctggactcaagcgatctgcccttcttggcctcccgaagtgttggaattataggcatgagccactgcactgggccaggaatatctttctatgacagtaaatattattttacatcattttcagtgataccatagtatcccattatatgcttttcagtaataagttcgaagccaagttcctggatcagcagcatcagaatcacctgggaatttgttagaaatggaaattcttaggccactccccagacctactgcgtctgggggcagggcccagccgtctatatttcagcaagccttccaagagacttcagtgcctgctaaagtttgatgcctactgccttaaataaacttcttcatcccttgtcaaacttcctaggggagcacattttgaatttttgacctgagacctcaaaacttttacctgtgctcactcagttcaggtgaaagaatctttggcattcagaagcttgtgttcacactcacctacttctcatggcatgattcctcttacctctaaattctactgacttaatcaagattgagggattctgggatgaatctggggacactttttggtccctgaaataaaatacgcaaactttggagtatgagtgcgtatttggggaaagtatacctatcagattttcaagaacttcatgaccctaaaatgactctttcttaaaataatttttttttttttttttttttttttttttttttggagaacggtctggttctgtcacccaggttggaatgcagtgtcaggatcatagctccactgtgtgacctcaaactcttgggctcaagcaactctcctgcctcaagcaactctccagcctcagcctccgagtaactgagactacaggttgtgtgccaccatacccagataatttttttttaactttttttcttttttttttttttttttttgagatggagtcttgttcttatgccgaggctggagtgaagtggcaccatctctgctcactacaacatctgccccccgggttcaagcgattctcctgcctcagcctctcgagtagctgggattctgggtgccccccgcaaccatgtcccacgaatttttgtattgttagtagagttggggtttcaccatggtggccaggctggtctcgatctcctgacctcaggtgatgcacccaccttggtctcccaaagtgctgggattacaggcatgggccaccgctcccagcctttaactttttgtagaggcagaatcttactatgttgcccaggttggtcttcaactcctgagctcaagtgatccgcccttctccgcctcccaaagtgctgggatgacaggcacgaatcaccgcgcccagcccaaaatgactttttatttgttatttttgatctcatccttgctgttctgttttgcccaggttggtcttcaactcctgagctcaagtgatccgcccttctcggcctcccaaagtgctgggatgacaggcacgagtcaccgcgcccagcccaaaatgactttttatttgttatttttgttctcatccttgctgttctgtttttcccagttatatcaataacaaagaaaagaaaagaaatctactcagggtctgttgggcatactgcccaagcacagtgtgaaatgactgccttttcactttttatcttttggatagcccaaagaccagcctgacttagcagcctgatttttctttgctggaggcagatcacactctgcagatctccactgaaaccccaccctcacccttcgtaataggcgacatgcacattttcatgtcacatttaaaaatgaaatttttcttgaaaatgttcacatccttcccccagaaattctagatttataaatttctcccaaggaaatcattaggtgctacatgaaagtttatgtatcaggtaatgatcacaaaattataatcacaaattaaaatagccataatgtctaataattcgacattagtgacagagatgatactacagttataggatgaagtgtcataactggggattttggaaaatgattagggacatggtgaagtcgtcatagaataaaattaagtgaaaagagtcaggttgagtgtagaatatatttattcctattcagcatatgtattacaaaatatctgggataaatgagaactgcatgctgacatttacattttctccttgattgtcttatctattatcaggattttctacaatgaacatttgttggtttataattggggggaaacctaaattcataaaataggcactctgttggtggcaaggaagcccactagtccactgtctaagtgttaaatggattttagcttcataattctggctttgactagaccctcttacaagcaagactatatcctctgcaaaagcatcagcggggtcctgcagtgccttcttgacacacacatcagtgtatacccagagctcttgtttctaaatagctgagctgcgtattaagtatggctaaccacacatccatgcatttttctggtgtctacctgaccacccctccaggggagagataaactcaaaggggagaaaaaggtatgggagcgaaagattgcaaggtgcaggtatgtttgcagatgaagggattgtccaggctgagctgtgcagtcctggatgaaccaccatctgggcacttcatatgccattcatacttaagggtgattggctattttcatcatcaagaaaaacattgctttaaaattttccatagttattcgggcatggtggctcaagcctgtaatcctagcactttgagaggctgaggcaggaggattgcttgagcccaggagtttgagaccagcccgggcaacacagtgagaccccacctctacaaaaaataaaaaattagttaggtgtagtggcgtgtgcctgtaatcctagctacttgggaggctgtggcctgaggactgcttgagtcctggaggtcgagactgcagtgagccatgatcatgccgctgcactccagcatacgtgacagagcaagaccttgtctcaaaaaatttaaaaaaaaaagttttttttttttaatcgccataatcttgtgtgaaatacttggtcatctgagcaacattatccttcttctccccatcagcctggcatgagcttggcagatgcaagctcagatcatcacctgtgtgagtgtgttgtctttgtgtccgtgagcatgtgtgtgtgccctgggttcctctcccaggtactccagagctcttgacaataaatgagaacaatatagaggcagggggcacttttcatctcaggccagttccaggactctgtgtaaactgtactaagccgaaacgtattcctttgtcccttttgccgctgtcctcctaatccacatctgggcagtgtgcactgtggctgggagttgacacagatccttgtctcccagacccccagtttctatcgagctactgtaactttaaaaagatttaacaaagactacctccactagctaagctgaaataagaatgtctccggagtttaatggatcaagtagcggtgataggttttatggctcttttttactttagggcatagggaagagagagccgggcaggttggttttaaattcaaggatttatgttgttaatcctccgggctaattataatttatgggatcttggcaaattaatatgcagttgctattcaaaagtggagagcaatgtaaggcaggcataaacaagccttgttcatttttaatttatttccaccaatggagaatattaaataaaatgaacactggggtatttcgctccaagtttggtgttcattatttatctctaaattatgatattcatagaacaactccttgctttttcaccaagaatctagaatctagaattatctgagcgttcgcatcagataactaggaagaaatcagagtcattttctctctaaggcaggctcgatgatacctgcacagaagcagaggtttcccaagcatgcatgttactgcagtacaagatttggcattctgcatgttggggttgtttagaaacagaaactttggagtagtatgtgagcttaaaatgtcagttgcatggaaatgaaagtgccaaccctccaaatcaagagtccagcccgttatgtcgcaagggctttgggaaatctcaatttattgctagcctggtagatattgagcagggtgtgatcctgttattgggctttcagactttcgcttagcaacctcattgcacccaggacccccatttaatcagcgactcctatggctgtttgggggctctctttcaaataattcttctcacccatgaacatctgtcagaaaactttcactgattggcaaccaccaggcaggtaggtttgactcatgtgataattggttgcaccactagaaatgagaatgcccctcctacttccccgccacctcttctcctcttacctttttctccccgacatgcccctgccaacctccccccatcattccagctgggagaggccatcaaatgtagcttggagagctatagaaaccttgagctctgagcccaaggagcaagttggagtcctgcctccagctgtgtagctcagataacagctggagcagagaacatgctgttctctctgctagaatatctgacccaattctgactagtaaagagagttaatagtttgtacctcaagtcattcttgtccctgtgtgaaggaagagaagcagtcatttccctccacctccaacacacactccgtccccactctgtctctcttggctgtttttctcttcattgttgttaaactcacgttcatttctcttgtagtcagggaaatgaagagccactttcaacaattctgaagaagaaatatgggatgttttgcttcgggatggaggctggagcaggagtttctggagtctgccagtacccagtttgaatcccagctctgccttttatcagctgggtgttgggcaagttagctgacttttgtgagttttctcatcattaaaatgagaacactgttattggtctttcgggattgttttgagaaatgagatatcgagacatgcctggcacaaggccttaattcttcttcatggtcaagaaatggcagattttcccccttccattcccacccttgcacatagtaggttctcagcaagtatttgtagatgtaatcgaccagcagagatcatttgtacccttaacacccacagagagtcacagatgctttcactgaaggagggtgtcccaagactcaatggcagggaataaaaatgccaagtcatgtaagtattccacaaagttagaggggaggagtaagtatctcttattcgtgcatctttatggtatgaccaagggctcatgatttgtaagcagttcaggcactgagacccgggacacaggtgacactgtatctgcagattcctttttctcattgtttctctgtcatgtttaatttttggttttgaaaacagcagaaaatccaaccagtgtgttcacaggacttctggctttgcagcaattcctttttctggggtcttttgcctaatcgtttactggtttggagacactgttttctgtattgtttaggactgaaaatgtagacctaactgaaatcaagcactcgagtatcctaattattttaaattcataatgaatagtcatcatggtttcactttttttatgtactcttttgaaagagtacgatgggggaataaaagccagaaagttaaaaaataaaaatagaaaagagctgcaattgtcaagagaccaaaaagtcttgtaaaaagggcagtaggtaattctggaggcaaatcagcatgggtaatgtctaggcaaacaggatagaaaaagatcaggaggtcacagtgacaaaagtatttaggctcatcatattagaatttcatccaaagaacaattgattatgatttatagaccacaccatcccatgagcccagatgtgtgtccactgggcctggcaggggacaaatttatgtaacagactccatcctgaattccagtcctcaagctttgagggtaataaactcaagctttgcaactgggtcaagatcaggcctgtctccttcttgatgatgagttgtctcataggaccctgttaagcaccatccccaaactccattctttttggtgaatatcccaacaaactccccagccatacctcaatgtccagacttgcctgatccccagggctggacacagaacaggctcattctgagaatcttctctctctccctccttcccattttgctcctcctaccaacatgagaagctagggggtctcatctttaaataattaattcttctttctttgtaagtattatacatgccaaacagactcttggtttgtgtctactgacccaacaaaagggctgtccacttgacggacaggcaacagatcatcttgataagtacatgaggcactcagatgtcaagtcaccaaaccttcattctgaatatttttgaggctcatgacagaccaaaagagccagagagttggggaacataatttcctttgctcataccctggaccaagaactgttgccaggaatatccatccatctgggggcttccagcttccccagatgcctgcgtgccttttgacccttctccttcccccaccctgcgagttcttcaacaaatactcttctaaaccaacatccccggcaaacgggagcaagacaccagcttttcactgatgcagatatttctgatcttttcatctcggttttatttctcactctcccactgcataaaagattaagaaagcactcgcatgaatgtttgcacatcatttaaatattcattttcattaatttattcatagtcgtaaagtttattgcctagaatatagagtcgtagaattttagagctggaagacaggagagaaatcatctagtttcgccgcctcgttttacagatgaggaaactgaggtgaagacagctcaggagaccgtccaaggtcagattctgaagtgagccaagtgagacccaaactcaagtcttggacagtctagcctctgtgcagcgcagctcagcacagctgaaaaccacttttgctctctgctggcatagatggctgtgctttggttcattttcttgctcatcttcatgatctagcaagttcttgttgagtgccagcccagtgccaggtgctgaagaacaatggtgaacggcacagtcatggtaccagaactcggtctggtggaacagagagattaagcaatcagaaaaacatatgtgtgtgtaattacacgttgtgataagggttttgtggggaatatacaagctcaatgtggagactagtggtgggagggcagaggcattttcccaggaagtggagaaagggaaggggaagcaaaagccatcccagggtgcgttagggagcaggtactgctgtggatgacgggtgaagaattcacctgggaaacttggggagaccatgtggaacatgccgtctctgagttatgccccatcagggggcaaagaaactggagtacttacccaccagatcctcatctgtcgttggttgaggactgctctcaggacattcacatccaggcacttctggtccacaccttggtacaacatttgcaatattagggacatgctaatacaattattcattgtatatgttaattcaaattaaatggaatgtcctatattttatagggcaaacttaggcttacgcctgggtggaatgagcaatccctgtcgccaaagaaggtccccagcatagcagttggctggagaaggaagggctgaccataagttgcactaaactgctctcagcagggtgacctggaagatcttggagtgtagatgtcaattaaggcaagtcctgagggctcggatggagccaacttttcacccgaggaggggaagagggagggttaaggagggcaaaggagagatttccaggcaaagtgcacattaaacaccagatgcgaagagctagacccccttaatgacaatttgctttctgtaatcttgaaccagggtctctcagtgtgtggaaggaatgtttgaatcggagtagcagggctgagtggcagtcctaaggcccagccacaacgtgttcttgacaagccatgtctatgtctggcgatgtgctcgcatggcacatgatcctgtttgacttcctgacagccccaggtgctggcctaaggccttccaaatgaggaaggaaggctggaagaagttaagtcatttgctagtaagggttagagccaggatttgaacccagatgactacagagttcatgcttttaattgctgcttgttaagtgcatctattatgggttgaattgcatccccccagaagatatgttgaagtcccatcctgttacctgtgaatgtaacctcatttggaagtagggtctttgcagatgtcatcaaattaatgtgagatctggctggattaagatggagcctcaatccagtgactggtgtctttattagagaaaagagagggagatttggagagacacacgtgtgtgcacacatatctacgtatctacatgtatgcacatacctacatgcatgcacatacctacatgcacacacgtgtgcacacacacaagcagaaggccatgtgaagatggaggcagatactggagcgatgctgccataagccagggaacagcaagcattgccatccaccaccaggagctggaagtggcaaggatatgttctgccctagagccttcggagggagcgcagcgccagagacaccttgaattcagactctttgagttcctgaataaagagagaataaacttgtattgtttcaagccacctagtttgtggcactttgttatggcagccccaggaaaggaacacagcatcccctgtcaacaaaccaaggggagctaaagatataccctttagccaagtaaaccagctgccccgagcaggagcacagcttccagatcactcatcaaggggccgtgggtgacagggctggcctgctgctgcctttaatgggcgtagatgttgttgttcatgtttcccagcccattggtgatgacacagaggcaggagccggggctgcagactaaattatatacatctcaagggcagttagacaattagctcgcccacaggaacattgcaataagcacagtatctgctttcccagcaaagccaagtgcaagttcctgcctgctctgatgacctcttgtgcctccagtgtgggaagggaccaggtccctcaatgctgccgcctcccaccctgtgctgccacgtggatttaactccttcgtgttccccatgttcttagtcagtatggttgttgtgccatggattcaaatggggttgcttgatttgatttgccctttacttggctggaattctctctaacaatcaatggaaacacagctcatagggatgcatgtagcctgtctcatatgtgaaaaagaaactttcaatgtatacttcatctcattccaacaagaattggaaacagcaacatcaggacttatatggtgcagggtggtcagtaagtaggaaagaaactcggggcatggaagtgaacaggaagcccagagtgaagccaggacccaaaacccacaggtgctgctcttgttataagccagccacacatttgtctttgagccttttagcagctgccacaaactgggagaaaccatcagttatgcagtttacaatatctctaaactcaaaacaagccagtaattcagaaaaagcccagttcttctcacaaagaaagatctaagtgtgatatgagagtatatgcatggagaatattttctgagctggtgatgagctgcagggggcctctcccagcccccgcactggttgcacttttaaataagagaaaaaaacagtgataggactgacctgcgtgtagaagtttcaagttacaagaaaaacacttcacaggatccaaatccttaaagtcctgaaggaaacagagagcatatacaccagctttcgccacccaattcggatgtgttagaatgaagagtctcttattttttaatgaatttttctctatttaaaagtacagggatacctcagagatattgcagatcccgttccagaccaccacaataaagcaaatatctcaataaggcaagtcacatgaattttggagtttcccagtgcatacaaaagttgcttacacgatataatagactcttaagtgtacaatagcattgtaagaaaacaatgtacataccttaattttaaaatatttcattactaaaaaatgctaatgatcatctgagccttcagcaagttgtcatctttttgctggtggagggtcttgccttgatgttgatggctgctgatggatcaagttggcggttgctgaaggttggggtggctgtggcaatttcttaaaataagacaaggataaagcttgctgcatggattgactcttccttttacaaaaggattctctgtagcatgcactgccgtttgacatcattttactcacagcagaatttatctcaaaagtggaatcagttctctcaaactcgccactgctttatcagttaagtttatggaatattctaaatcctctgttgtcatttcaacaacattcatgacgttgttcatgacaatgttcagtgttcgccttcaggaagagcaagttccattgcaagaaatcactttctttgctcatctctaagaagcaagtgctcatccattcaagttttctcatgagattgcagcaatttagtcacatcatcaggctctacttctaactcgagttctcttgctatttctaccacatatgagtcttgaaggggctcaagacttacttcctccactaacttttgaacccctcagagtcacccaagaaggtggaataaacttcttccaaactcttgttattattaatttttgatcctttgccatgaatcacgaatgttcttaatggcatctagaatgctgaatcctttctagaagattttcaatttacttagcccagatccatcagaagaatacagtatctgtggcacctgtaggcttctaaaatgtatttctttaataataatacttgatagttgaaattactctttgatacataggctgcagactgggcattgtattagcaggcatggaaactacattaatcttgtacatctccatcagagctcttaggtacgaggtacattgtcaacaagtggaatatttttattttttttattgttattgttttgagacagcctggtctggaatgcactggcatgactgcagctcaaattatcctcctactccagccttcccagtagctgggactacaggcacatgccactaggctgggctatttttgtatttttagtagagacacaatttcaccgtgttgcccaggctggtcttgaacttgtggtgaatcaatctgcccaaatcagcctcccacagtgccacaattacaggtgtgagccaccacactggaccaagcagaatatttttaaaggaatacaaattttttcccaacagtaggtctcgacagtgggcataaattattcagtaaatcatgccataaatagacgtggtctcatccagggtttgttattccatttatagagcacagggagagtaggtttagcataattcttaaggaccctaggattttgggaatggtaaatgagcttggcttcaacttgaagtcaccagcagggaagagagtcagcctgtgcttcgcagctttgaagccaggcattgccttctcctccctagctctcaaagtcctagacagcatcttcttccaacagaaagctgttttgtctacattgaaaatctgttagtgtagccaccttagtggtcttatctagatcttctggaaaacttgctgcagcttctgcatcagcacttgctgcttcatgttgcacttttttgttatggagacggctttcttccttaaacctcatgaaccgacctctgctagcttccaagttttcttctgcagcttcctcacccctctcagccttcacacaattatagagagtgagggccttgctctggattagattttggcttcagggaatgttgtggctggtttgatcctgtatccaaaccactcaaacattcttcatatgggtgataacgctgttttggtttctatcatttgtgtgttcactagaatagcacttttaatttccttcaagaactttttctttgcattcacaacttgcctgtttggcacgagatctggctttcagcctatgtcagttttcgacatggctttctcgttaagcttaatcacttctagcttttgatttaaagtgagagacatgcaactctgactttctcttgggcactgaaaagccattgaagggttgtaagtttgcctaatttcaatactgttgtgtctcaggtaatagggaggcccaaggagggggaaagagaaggagaacagcaggttgctggagccagtgtggtattcataaatataacatttatcaattaagtttgccatctgatatgggtgcagtttgtggtgccccaaaaaatgacaatggggacatcaaagatcactgatcacagatcaccaaaactgatataataataatttaaaagcttgaaatattgtaagaattatcaaaatgtgatacagagacatgaagtgagcaggtaccattggaaaaatggtgccgatagtcttccttaatgcaaagttgccagaaaccttcgatttgtaaaaaacacagtatttgcaaagtgcaataaaaggaaatgcaataaaatgaggtatgccgataatacatacagctcagtgaagaatatcttaaaaatatttaaaaagaaggaagaaaatcactcataattctgctgcccatggcaaccacaattaacccatgcctgccttccagtctttttaccacgtgttgtgttgtgtggtgtttgtcccacatagagatcattgccatacgcccatttggcacattgcttatttttccctgtctttatacatttcatcatgttgttctaaatgcttcttaactgcaattcttagtggttgtgatagtccacagaggggaagcattgctgtttatttatccatttctatgttgttggtcatttatatggttttaaatacttttggtgtcataaggagtgttgtgataaacatctctgtgcataaagcagtttctatagttcccattatgtctttaggatagattcccagaaatggaattactaggtcaaaggttgggcacattttttaaaggtttgtgagacatattgccaaattgctctccaaaaggtttgtagcaatttaaatgatcagaagcagcactgaagtccagtttcgtctaaccagtattgagtgctcattaaaaaaaaaaaaatcattactaatatgataaacaaacaaatggtgtgttattgttgggttgaaagaagcaaatttggagaatccagagaaacacagcggaaattcaatttatgggctacattaacccagcattttggattggagggtttctaaagaggtttcgttatattaatggatgacaagtggatacttaagaaaaagtgtattttggagaaagttgcaataatacctactagagattgtgtcctccctcaaaatcggagtgccatccgcgctccatgagtctgacactttgtaggtgctttataaatatggattgaagcaaatgagtgacgttcatatgatgttttgcagttttttcaaagtgggttttacattgagaatctcatttttccaacaaggcaactaaggcatggattcaataatgtgccagcggcacacacatagcaaatggtccagccacgaagagaacgggactgtccagccgggaggacagtatgcttttcacctccctctgtacccttctctgagaactgtttggtttgaatcatgatggcagtggctggcttctccacgatgctgttgtgctgaaccctattaacctcatagggaagacactaggatcaagaggccagagaagagacccagagccagcaaacaagacatagggttttattaggggtttacctacaaaggagagagtttagtggcagtgggctgggcaggagaactgccttatgtacagaaatggttcaggggccgtggaatggacaagactccactttcctacagtccagtgtcagtggctggacaacataaccacacagcccagtggccgtggcctgggcagggaaaccgcaactgcctgcaggaagagtgcagtttatttagataacattttcacttaacatcctgccgttaatgacctccacctggcaacctttatttaatccaaaactcagggactggattttccatacggcctgtgaggccagggggctcagttgttcctcatagacagggaatgtatctcctgattggccactcccagattccctagctaggaacagacattcaggtacatatacccttcagagagtcattctcaaggtatgctcaagctattgctgtcaggcgcatttaccctacagagctgaactaccatttcctcaaaagtaggtacagatggggtaacagtgggcaatgtggccctttctgcacttccacagtacccgaagtttaggcgcccctcctgccaagagcccccattagcagcaaaatatatctcacatggtgcccagagcaaaggaccctgtgctagttttttgtggctgctgtaataacggcaaactgagtgacgtaaaacagcagagatacatttgctcacggtgttggagcccagacgtctgaaattgacactgcttctggggacactagaggagactttgttcttcgcccttcccggcttcaggtcgcggtaagcattccttaactggtggtcacattactctatctgtgcctccatggtcacttggacttcccttctgtctgtctgaaatttccctctgcgtttattttttgttgttgtttgtttctgagacacagtctcactctgttgccccggctggagtgcagtggcatgatcttggctcactgcatcctccatctcccaggcttaagtaattctcctgccgcagcctcctgagtagatgggattacaggcgtgcgccaccatgcccggtcaatttttgtatttttagtagagacgaggtttcaccatgttggccaggctggtttcgaactcgtgacctcaggtgatccacctgccttggcctcccaaagtgctgggattacaggcgtgagtcaccatgcctggctatctgcgtttcttctgtaaggatacttgtctttaaatgtaggacccacttggaatatccagaactatcgtatcaaaaaatgtttactcacacctgcgtataccctgtttccaaatagagtcacagttacaggttccggggagttgacatgggtatcctctggggcagggggcacttttctgcctaccacagatactgaggtgcattgctaattacatgagtacagcatttgtgaaaactcgctcatgatatcttctccatagtcgcagtcagtaccagctgctgtggaaaaaattttacgcattgtgtttacaacagaatatataacatggcttagagacaaagtgttttacttatggccagtagatggaattctaaggtccgatgtcggtttgccatgacttgggcattggtttctgttcggctctgtttacggggctgtgggatgggtacatagacactcgtctacttgaacttccagggactcgggaggcctgcagttgaataacaagagaccgtgctggtgagaggtggagtttgcagtaggatttcaaagactccatggagtccaaaaggtgggaggtgtgttttggggcatgcgccaagggaagctgggctttgggaagagaaaagaatccgaactggtggcttcccacaattgctgggagtctgagatagattcaattgggaaaactaggttagtgccagataaggtccattactctttaaaagtggccactcatccctaataataaataaaccaaacattgggatattaaaacaattcgttctcagcatcagaaaagaggtcgtgtgtgtgtttgtgtttttttaatatcccatccagcccccagccccagtaaccctaagattgaacaaaaccctacttacgtgctacggatttaatatagcgtcaggctcctctaggtacaataaaataccaagttaagagcattaattccttacaaccctgatgggtcccagctgtgcacacgcatgtagggtgtgagggtgtgtgctcagcgggcacaggtgctgacggggctgttccacctcggagcgcgtgggccgggaacacagctgtttctcaaatcatccgccacttgcttctaaacctctgtgaagttgtaccgcctctgggcacaattaaaagctgtatactacatttcatcaggtagtgttagaaatttaggctgagccaaaaaagaaaagggaggaggtgggagggaggaagcaacgagtcccttgttcaggcggcattaacccccttaccctggctattggaacaatagcgcttctaaaagccgcacaaaatcctccaatattaagaacggagaaaaggagtgtggaaaaggtgtgggcaagcacggcatctcttctttctttttcttctttttctgtttctttccttctcttgctatttcctttctttctttttccttcccttccttccttccttctctctatccttcctttttgtcccttccttcccctcattctttctttccctctctctttctccgtctttctttcctccctcccatactctctacttttcttcttcccttccctttgttttcacgctaattccttaatttgtttttgggtctgctcgcaggaaataaccgtaagctaggataactgaggtaaaatttgtacagctaagctgaatggtgaaaggcccagatttagttctcattgtaggaaaaagggccagaataccttgcccatttttgccttgggaagtgagctcaatgaaatacatcttcatatgcccattttacagaagcagcaactgagggctgttgtactgaggcttgcaatggccacctcaacttttaggtctctgaggcagcaatgggacccttgccggggcctcgccatccacatggtcattgcctcaaaatttgggattccagttgcccttttccttcttctctcttgaacaatgtgaacgcaaggtgaggatgggccttctccgccttcaaaagttgctgccttccaaggggaaaaggtctggtcttgtaatttctggtctgtgcgtgctgtataaggaagaaggtttgggtagggaagcaacagagtacccactagtgagagggaggacaccgctggtctgtgctcaacagccaggccagcaccacatgaataaagcatgatggcaattgcctgactctgtcctcggtggggacaggagagctgagcataaggatctaagtttagacgccctcctaggattaccaacgtaggcgtgatcaggcccataaaatactgcacatcttggcatcttacctataaaaataatgcagatacattcgtaactccccaggttttcgggagtggaaatgagggcagctggggagtgaatctgtcgtttgttgagactctttttcctgcttgccagacactgatctaggctcattcatacaccagttcattcatcctcataacagttctgtgcctgagtagattcttgtccttatgtaaggattaaggacgttgagacccagaagggtctcatctaacaggcagtagtagagccagcagtcaaaatagtttgaccccaaggctccaggctttttccctatttctttctcacccacagccaattgcaatctggaccctttacctgtcagctgtaggaacatgaaataatgtgagtggggtgaaataatgccatttaaaagcaggcacattataaagaattatgtcaacctgatttcttgaatcccaggacaattcatatccccgtgccatccgattagtgaatcaagagaaactgattgatatacagcaacaatagttaagaaacaggcagcatcgatggaggtttgattaaaccgataccctgggtctcctgctgtatcaaatcatgggcgaattggtaccattaggataaattactacaagaggcactgcaaagccaagctaaataaactctgccttctcgagcccctgattgtcttattaaataatttctttgcctcttaagtgtggactcggagcactcgtgctctgaaagccctcctgattaactatagccttggcctcaagttgattttataaacttcggatggtgccccagagggtgaagcttcctgttgtcaattctgcccgttgctatagataccaaactccacaatcagtaattagagcgtgccccctgccccagaactggtcaaacggtgcagagcgctcggcaaatggtcttaaaagcatccgcgcttgcatggaaatgcatttccaatggtgacggggtttgttttattcatggactttttgaaaaaaaaatcactggtttattggaaaccatagagaagtataagtaattattatgctttttaaaatacaaccgaggttcctcatcatgatacgttaagggaaaggaagacagggcaggagggtggtgtggcacaaaggcggctctgtctgacctgtcacgttaggactgagttcattcttgttcagattcagcatcttttgttatacccgaagtgcattccatggccctgtcccagccatagaaagaaatgcctttatttttaagcgagacttcttgtggaatgatgaatatgttcagggaggctgttgatggcaagaaaagaagggtgatgggttgggcttatattgtttagtggagcaaaacagatgtgaaacatttgtgtcttaaagtgttttggtcaagagaaactaaattggttagaaagtgtgcaattttgcaagctttataaaagtataaaccaatgagtctggactctgttccctaaaggggatgaggaatgaaaatgaaggtttgcaaagacatcttgccagacccttacatattttaatttaaggtggtattactgtcctcattttcaagctgaagaaccaagctctgagagagttaatgattttctccagatcattcacattcatttctgttacacagctgggattataatccatgcctgtctgactctgaaacctattttcccatctttttttttttttttagggataaatttctcccaaactatatgcagatcctgctagagactgcccatccctctatccatttctcagtttgaaaagaaatcctggaattcagaatgatgaatattcattttaacatcatcttaaaatgtccttatagatgtatattacagctgtagtctgccaggccaagaattcgattggcatttccagagtactgttgattgtattttagaatcttccaaacctccgtaattgtcttgttgatttcaaacaccctgagaacatttcctaaatgctcatagcgtccaatagcatgggaaagtaaatggtttatgaggagaatttgggatgtgcaaaataagcctttgaagagagtgcattatctgaagcctgacattgtaacagcttcttaattacgctttctttcatgtggcatttttatgggatccagtacgcccaggctcaaatgatagacatttcaactcctacatccaagtgtagggagtcccaactttttgaatccatccgtgtggcaaatgtagctggacccttgggatgaagacccttcctgcatcctcccaaggagacaagttctgggccataactctagagcaaccccaacccccaggccatggaccaagtgtcaacaatgttgacattgtgaatccctgatctggaggaacatagctttggggcagtgccaggatttaatatgggttctttggacttcagagccccttgtgctaaattgaaacattatggtgttgctttgagcaaacaattagcatttttgccatagctttttacttctccatgttgaaattatcaaagattatcgtcgaaggcgtggtttctttactatctgtcttctccaggagactgtcatctctgtgagtgcaggaatccggctggtggtgtttttactctaacacctctttcagtacatacatacagtaggtgcttagtagatgtttactgaatgaatggataaacatgtacaaaattatgatcccttgtgttaaatatggtagggaagcaacataatgtgccctggagtttcacagaagaaggggctttcttccagcttggggatggaggtgagctgtcattctggatgatgtgatggggaaagaggatgtgagctgaggcttggaaccaagcagagcttgggctttggggtgctgggaggacagaatgctggaaacagaggtaagaagggtaagcacctagtcaacatgagtgatttagctttgggagctgatcaagtgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacggtgagtcaattaaacctctttcctttataaactacccagtctcaggtatttctgtgtagcagtgtaagaacagactaatacagcaagggagcagtgatggagcacaggctggaaaactgagttgaggggtcagtggtggaccctgaaggttagactaagaaatttagactccagcctacataaatttagactccatgcagaatgactggatgtcctataggacatgcaaagccacagggaattttggaacaggaaattgtgctcaaagctgaattttgaggaggtaaatacagcctctgtgtgtaagacagagaaaaggagagagtgggaagtaatttatgtatcacagttgcctagagaagacagaaaataggtgcctggcttatgtggccactgctttttttttaaacttatttctttaattttatttttttttaaattaggattaaaaaatgtacatatacacataaaatatttatttttgaataggtaatacttttatatggttcaaaaatcaaaagtagaagataaaaacaaggtgtatatgtatatatatttatatacctatgtgcatatataaaatccttgtatacatatacacacacacacctatgtttttctttatgtgtgttaaaatctccctctacccctttcctttagcacctaattcctcttctgaaccgatgttatttcctggtgcatccttctagacattattatgcatttacaaggcaatatgtttgtatattcttctgccctccccttcactttgctatacacaccttgctctttttgcttgacaatatatcttagagatggttctaaatcagcatataaattatttcttcattttttaacaactgctgagtattacactgtgtggatgtttcataattcattgaaccaattccctattgatagacatttgggttgttcccagccttttgctattgcaaattgtgccgcaacgtgtaaccttgcaccgacatcgcttcccacgtgcatgcatgtatttgcaggattgagtcttagaaatagcagcatcggctgagagagtatgcactccggtcgttttcatagatattgccaaattgccctctacggaggttgttctgatttacattcccactaagcaacatacgacagttagggtggcatttcctgactccatgctttgtagctgggtggaggggtggactgagagtacatgtggatgggaaggtgcaagtgaatgctctcaaaatgtgctttaaggagaaatattttgttgggacacagaagttagactgcaagaaggagaagattggattcagggcaggaaatcagtacaacttgcagtagtccacatgacagttacgcaaaggcctggtctgatagaggaacaagagagagagaaagtgcatggcaaagacccatcattgatgagtgactggatgtgaggaatggagcaggggagatgctgatgatttggttacccccttctccatcccccaccacccactgatgttattatccagtaaggaccaggagagaagaagagatttaagaagaagacaatggctgtggtttgatgaagataaaacgccctgccagaatcatttgagcaaaagcttaatgttgtttgtggcaatgtcacttactcctgatcccattggagaaatctttcctatcacttccaatccacgtgtgttcagacaaacactaattttgttagtacaacgtcccctaatagctaagagttaaaaaaaaaataggtcttagaagtgtgaaaaacaaaaaacaaaaaacaaaaaaaaaaacactaaaccccaaatttgtccttttaacactttcagcaaccctgtaaagtcattatcatccccctgttacaggtaagaaaattaaggctcagagaggttaaataacttggccaaggtcacacagctattaaggaatggtaccatgtcttggacccaggttaactttaaatcctgagctttataacggtttgatttcagtagcaaatgcagtggcacagaagggtctgggcatttatttccaaagaatgatttcactcaactgaggaattctaatgttttaacagcatcctacttatttctaaagtgttggggtgaatttgccaaggtttgaaaagtgcatttgtaagccagtaggattcaatctgaagtcagggataacagagccgggggcggaggctaggtctccttacatattttgttcacaatgggactagaacactctgcagagtatgaaggttgtgattcagttgcccaagcagtaaggcctgactggtgtcacgatcccacaacccgcacaaaggtgccattgttgcccagtgtgaagggagctgaggcatcaccaaagggggccaagcgtcccttctctgggttagaaatgttgttttccatttgctggtaaacaacagtccaagttcattgtcctgacacagaactctgtttcttcttttatgctgagagtttgcaagtatggatcttgataggaatgcttgcaaacaacggtagttataaaatgttgcctcctgtatctcagtaggcactgttcaagcatttgaacttcatcaagtatcaagacaagtctaagagaaggtggggagagaccatcagggcctaggattggaaaacctccaacgcaaaatagagatgtagttttagcgtgctgcccaatattaaaagattgtataaatgaggggggcacacttcctgatatgttcgttatgcacatagtcacacacctctcagtgccttaaaatttgttatgatgcagtctatctcgtatggaacgatcttgatgtatctatcaaacacgggagaaaaaccacttaaaatgtgtaaaaagtttattaataaaggagtacatgattgtgttttaaaagctacatacattaggtttaagctgcagaaaatggcggtttattccgaaagactgctgtatttatgcttaaataattaggattacctctacctggtatatttgcagggacaagcaaagcatacactgaaaataaattctcaaatgaaattcatttcacattagttgcatcccaacattcctttatggactgcattccatgcctggcactgtgcctatgatttattaaaatctaaagccattaataaataaattattcaatccatgcattgaattatctagctcattcaaagacagtcacagtccatccctcaaagagctcatggaccagtcgaaggagggtgacagcctgggtcaaattggtgctgagcacacaggcaggggtcaggctccctggagtgaagtgtaagcgtcgctgttcactggctgagtcatctttggtaggtccctttaccactttgccactttaagtctccgtttcctcatctgtaaaatagaggtaataaaaacagctaatatttacagagagcttactccttgttagcagttttcattaattaatgggtgtatttattggaataaccgtgtaaggttgccatttttatttccatctgtgtgttacagatgagatgtgtaatagaaagggaatttgcccaagctcacagtcacaggctggtggagttgggatttcaaacccagagtgtctgattcctgaacctgtgctcttgtctcttccttcagtaccacatacaacagaggggacaaaataatttctatataaagtgcttagcatagtgcctgccacttagacctcaaaatatattgttttcattggataattaaatataaaataacatacagcatgatgattaatacaactaataaatagtgcattagtattataggcacaaaagacagtatgaagtacagcacagatcatgaggagggtagggtcagttctacgtaaaaacagggttagtaaaggcctcagagagaagatgtcctttgagctgagtcttgagactccagagatcaggactcaaggactgtggaacctgtacattcacatcctggtaatcttacattgctcagaagactccagggacattgaggttgcccccatggagttgaaactcctatgctgatcacttaggaagccaagaacaaattaacccagggcaacaagaaacaatgactaattagaccctaatgaagtgctgcggtactggcgtccttccagatttgacttgtaatcgccacaatgtattacagatgcagagtcttcatcttgttgggctgtgatcaagtacatatgctccccagcagttctttgagatttccatgttctccgcacagtgcggagctactgcgggtgtgtgagccaagggggccctgtgacccttgaaatagaaaagggggaaatggctgcatgccaaccgaagagaccactgcattgttggccataagtgaaactagtgagatgtgtgggatatcataaaaagaacattgacataatccttttttggatgaagttatatcacaaccagaacacacaatgaccagcaggcttctctttttttgtttgatttcactcctgaaaagtgggctttctgtgagagttggacagactccatgctgcccctgcctcccgggccttccttcccaagcagggatgagctctcctctgcatgtaacaagcaaggtgattcagcaagaagactgctggtctctcccttcctccagggccatttgtgagagtgagacacaaaatattagaagcaaaagaagaagctgtactcccaagaggcatggatccttgagtgagttatgtgcttggaaaaaattagtttgcacatgaggacacaaagagagcctgaaaagcaggaggctttgaggtctttttttccctcctgattcggagggaaaaaaaatgttgtttgtgttcatttatggaaattagatctatcacatactcttatgcaatttatgaaatgttaagcaatacccctgaatgtcctagtcccaggaaagttgagagttgagtgcaagacggggacacccaggagccagtaaatcaactcttgaatgatggtgtattaagtgataaccttgtcatagttaaagtcacactggaaggatatatattgaggctttatctctgccatggtgtcagcatcagtgaattaacacagggtgtcttaacttttcaaaaacaggacatgggtgatcaagcagcagtatatctctttactccttgtattagtccattttcacactgcttgataaaaacataccctagcctgggaagaaaaatcggtttaatggacttacagttccatattgctggggaagccttacaatcatggtggaaggcaaggaggagcaagtcacgtcttacacggatggcagcaggcaaagagagtgagcttgttcagggaaacccctgtttttaaaaccatcagatctcacgagacttattcactatcatgagaatagtacaggaaagacccacccccatgattcagttgtctccctccaggtcccttccataacacatgggaattatgggagatacaagatgagatttgggtggggacacagagtcaaaccgtatcactctcccacccaacacttgcagaaacacacacacacacacacacacacacacacacacacacaccccttcctacgtcctacatccctgtacttggaaagcaatcatatttaaatcattgctgctggaactttagttgactttataagttacattttacataaaaaggcagcagtggtgaagctggaagagggcacctaggctttgatttcaggcaagattttgttaggtcccagtattgggacttccggttggtggattttgctcaagaatagttttctctttgtctaacgcttcatgagagacaacctaaataaagccacagccagtgttacagaaatagtgtttcgtgattaaaataatggtacttatttgggagagttacttgccacgtttcagatgattgggaggtagtcttttcaggaatattctgagtttgtttcttgatctcgatagcagcaacctttccatttgctctctgtctggtttctctgtgtctctctttttccctcaaacatcgcttttctttttttaaaacaagaataaatcccttaggaccttgctaagttattacttatattgtcgcttaaaaaaaactttggaaagaggctctggcatactttaaaaaagttaagcacactcaagcctctttaattctaaattcagttttgaatatgcttgtactgatgtcaatgacttttcaaaagagagtgtcccaattatttaggtggccaagagaaacagctttaattctttatcacataaatatgcttcaaaccacgatttaaaccagatggatggagcactggattagtggtggggcttcttggctgatctgagtttcgcctcctcgatcttgcctgggtctgttctgtcacttggatcttaccagtcctggcaggcacacagctctgtgagattttccttctggctttgcatgaagcttttgaaaagaaaacacatacatgcaagtgacctttctagggttgtttctagtttcttcgtcttacataaagcccctgctaatttagcatggtgtgtgcccgagtttattttctttttaacaactttatttatgtaattaagcgagtgaagtcatacattttattgatctaatgaaacgcatttcatggttcctcctgcccttcatcttctgaccttccccttcagatcacagccctttactttcgtcaatgagacgccacttaacaattttccaccttgccaaatttgaggtccccctcaacattaacggggaacccaatatcagttccttaaatgggagcaaagattgatgtcaatataaactatgacacacattcatattgcagaaagggtaagaaatccttacacagaacgagtacggtctctaacagtaaagtacagaacaggtggttctcattttagtatatttaaacttcaggtccttaaatgttcttttctttttccttcattctgtttctttattattttaatggagtgcaaggtgcagtctttttgaagatgtagaatgtggccttataaaagctaagtgctactttatatttctgctgtccttgccggtggcctgcactggggagttgtatattgtatcagtaattttaaaagccagcaagtgttctaccagctgaagaagttttcctaatggtggctggtcaaacgtattacttaactaggcgtatagaattgaggggaaatgcaggatgtaatgaaatgacattggtcaatcctcagtaaatgtttttttcaaaggcttggcacaaaaaatgtgcaaaatcttggaggtagatttttttgggggcatttgtcagggaagagattaatataatactcagtgaattcaggcaagtcctcaagaagaaaaatttaaggagcaaatatgtgagccaggatctcatgctggactatctaagcaagcatgtaggaagagtttgtttcttcctgctatggccatagaggtttggttgtcactatgaagaatgggcctgtgtttttttttaaaaatatgctgatctgggtgaggtcacattttgctattctcagtggagggaataattgggattatcttatgatttttttttctctttaattttcttacaaaggaaaaagaaagaatccaatttgttataaataactgctgagggcagtacatgttgcaggtagtcactatctgggactggtggcacaggcagtaaaggattcaccaagacagttgtaggtaaagaaaggtggatttattggagaagataagaaagtacactgtaaggttgcaacaggcagcccagcatggaaggggctgtctgcaaagaggcaggggctggagggactgaagttatacagggtcctgttggagggagctatgtgcagaatgaggtcgaggtcattgtgcctgcggattgtttgttgttcttccctacccggggcccactcctacctggggcctcttcctcattgctgcttacttattagaactccacagtagattttttataaatgcagacacatacagacacccacacccacacatacagacacacacagaaacatatacacatttaggtcgcgatttcttcacaaggacattcttatagacatgtcatgaagggacttggggctcagagaaatgaagtaactcagctaagtctgtacagtacttagccaggggatttagaaatccacccagggatggctccagttgcctgtttcttttcatttgacacgggatggcctaatgggtccccaccaggggtggcttggaaaggagaaagcaactgcattcccactggaaggtgttctgtagcaaagtggagtgaatgccaccaataatgagttccaaacagggtatgtgtttgcagacaggagctacatacatttgaaaattaggatgatttgaaattgaaatgagggcttatgctgttcattggattaatttttctctcttataaataaaaaatatatacaaataatacataaacattgtttttcactgtggcttgaattttctaacaatttttttcttcttctcaggaaatgttttcttcttatacctccaaaataaccactgttgacagtgtattgttaaccttgctagaaaaaaatatttatttttgatccatacacgtaaatatgcatactcataaatatgcattcatattttgtgtatgagtacacttgttaatttacatgtatgtcttgatttatatacattgttctatacctttccttttcccataattttatggattacatttattttcatttctgtatatttagttaattcttttaaaaggctgcctgttatcccattgtctgtcttcaccatcatttacttatgtaataaatctgttaaataattttaatataaatctattcatctatccatctattaaaagagatttaagttatttctaatctttgcatattataagttgcatttcagcttataccttgactttctttgacatatacatcaataggtagagtatattcctagaaattcaattgtggaccaatgagatgtacttcaaatttttaacagatatttcagtattgacctcccaaaatgtattcacacacccaccaaatctaagtgtctgtgtaacacacagatgctgatttggagtattaccattttaaaaaaataatatagctatcagtcgtgtaaaaaaaatcctcaccattatttcttaattttacattgtaattgtgagtgatgttgggtagatttttgtacttttattgaccattcacatttcttcttttctgaactgcctttccatattctcggtccagctttctataagattgctctcatttactggtgagagctctgtgtaaattaaggaaaccatcaccaccttcgaatggctgactattgtaaatattttaatgtttgtcgtttgtttgcaaccttgtaattttttcctgtgcagcaattttaactttctatattcaaatatactctgaatgcacagtgaatttggcagaataccatttaagtcttgtattttccaaagctagtcaacgtccaactgccaatgttgcctgaacaggaaatatttatacctgaaagcgtccaggtgagagtcaggaaagccatgaaggtgcaactggcatactgatgtcacttcttctttttttttttttttaagacggagtcttgctcttttgccaggctggagtgcagtggtgcaatctcggctcactgcaacatttgactccctggttcaagcgattctcctgcctccgcctcccaagtagctgggattacaggcatgcaccatcacacccagctaatttttgtatttttagtagagacgggattttaccatgttggccaggatggtcttgatctcctgacctcatgatccacccgcctcggcctcccaaagtgctgggattacaggcgtgagctaccatgcctggccctgatgtcacttcttaggctaatttctgtgaaattgtgattgggaggaaaaagtgaacaggaacttaaagccagcagaggaaagctacctgcccttcactggtggtcagtgcatggattccagagacagggtgggcaccagttcctcaccgggtcctttctagttgcatgacctggggcaggtgactttatgtggctaagcctcagcttcctgacatatggcaggagtaataatatcccttgaagccaacaaaattcaataggcacatgccatgtacatgcctgtgttatgccgggaacttcttaacatttccagaatatgtgtaatcatatttgttacatgcaatatgaaattatgtgtaaactgtccaacctgcaggaggcagtagatcaatcaattacatgtgattaatcctccccctatcttacagagaataggagagaaaatagagctccaaggtggaggaaaagacaactgagaggaggctattgtgatgttttattaccataaactgccaagggttagtcgtagccctccatctgccagctaattccggtttcattaatatgaatattctcacgcttccagaaggaaattcttggaatgttatggatctctgtagcaggcacatgcaacgtccagtgcttccctgctggtaatgtggcggttttattatgcatgccatacccatgctctctatttcctcgatagaccttatagaaatcaccatgcttccttttagaagaaaatgatggtatcacatggagaacgagctgaggagcttgacaatcttggcaaggcttatcaaaagaaaattcatgtgttagccttaagttaacactacttttattaaattcagtttttatcacagctgataacttggagatgtaagcatttagagacagaattcacttatgaatgttctaaaatgtcagaaagtttaggattctcttcaggtagtttcctttctctcacttggagtgacatgttggacccgtggcattgtcccgaggcaacgttgtggaatttttagagagtgtttgtctgttagctgtttgttttgaacatgttcacctttggctctgacctgccatcatggaaaaaaagtgtcaatgtgttgggaaagaaatgggctgcttctcttttctcctccctcctccgtctccttcccccgaccctcctccatccccttcctgcccccactcctcctgctctccagcctggcctctgtcccctctgtgttcctccccttcttccttgtatccttaatgacttccaggtgtgcctgctgggtcaggcttctggccccgtcctggggaggctgggtctgtgcctccacaaacacaagaccaaagttagggggtgggggactccagaagtacaacatcagaggaagaaaaaaaaaactttgaagttttgaggatgaaattggtaaaaataattctagatgaagatagacccgtttacattccaaggaagggaaatgttttacccaaactgtttccatggaccctgtgggttcttgttaatactgttcaaccttgtgattgaaagcccaagccctgtgatccacagcaggggccacagccagaaataattccccgagaatactgcgtgtgccttcaaatggtccttgatcatttttcttggatgccccactttccaaaggccagaaattgtttcagggagtcattccagttggggaaggttttatgttctaagagcaaggtgctgtactcataggaaaatgtgtaattcgtcatgatccttttgtgtggagaggatggcggtggtccacttctcaacttgggagtcccttagtgactcatgatgtatccttcagtacgctgcccagtgccttccccatttgacttagattttctgccacagtttaagtatcacctcctctatgaagtcttgccagacacattcctcgtctctttcctgttggaacaactgcctcactcctgtggccccactgtgccatagacaggttagagaacatgggccctggcatcagacctggcaggcagtcttgattaggcccgttattagggtgctctgggcaagtaagtttacctgtgccagggatgcacctttttaacccaacacttagaggggtcctccatgtacagccatgatcacaactctctaacgtggtcacttgcttgcacacacttgtttagatgtctctgccctgctgttaattagactgtgagtctccagagggtgagactgacatctcatttctctttgcagtcacagcagagatgcaggcccacagtagggactcaccagatgtggcagggtgagggaattgtccatagatgccttaaagatatgctatccacaggagcagagagcacagcaggctggatgccaaggagaattcgaccagggtaaggcttacaggcaatccattcactgcagagtcttcccccatccacacatataactccctttagtattgatgacctttctctcctgaaatattacagaaactgccctgaacgaagatagatggtcccccctcagcgttcacacatggttccgtctcatccaccagcttccccggccccattccctctgtctcaggaaagtaataatagtaactcataataatagttcaaaataataataatcatacctgggatttatatttcagcgtgcctcctaagagggcaaataaaccattttacacaatgcagagagaaggacagattttctttgtgctgctgctgatcacgttaagccaggagagatttacagtcaaattccagctacagaagcaaagtgttggtgccccgttggcatgtggggatccactttaatgttgttctcttggttttgcttaaactgccaagtgaattactgtaacacactttgcctgcagttaatttgacatctagtgccagagagctgctttatatttttcaaggcaagccagggtgaaatttttgcaaaaagatttgtccatcatttttactgatgtccaaacacgatgtctttagcttctttggaatcgagctgtggaagtcacgtgggctttttcttttttcttttctttttctttctttctttcttttctttttttaaggatcacagaagaaaagcaggccgatcttgttgaaatgtttttaaaatctccaaataataaaataggtttagggtgtttgcttatgaaagctgactttcaccagaatgatttatatgcatcatgggcagaggggcagtccaataaaagaggcagaaagggctcttgaaaaatgtccctgggcacttgcccgaatgactttagtgacagtatctactaaaactgatactaattctgttacgtgttatggcgcatacccaagaccctccccataaactatttgaaagaagcaaagttgtaattctccaaatacggacttgtacatttctgatcattttagcaccaacattggttcaaactctggcagccgaccacagttccagctgagctttgctgcgctgtcagcaccatggggcctgataaagcatttttggatttttcctactcacagtgcccccatggtctcaatgctgttgagaacattaagctccttacctgtgttttgtggttgttgttattgtttttctttctggtaaaggactttatctgcagtcctaacaaattgacttacgttaacattctaactcgtggctaaaccaaaaataaacttgcagaccctgccctgaaatgcacgctctgagcagtctattggatgcggtggtgtggccgatttcttggacttgctacattcttaggcaagtgacatctcccttcatttgtacagagggagttagaattgaatcgaacttccaccgcagcatccgccagctcttataatcacttgccctttgctgatggtgagtttttagctgctttctctcctaccatacagcactgacacctgagaagtccagtccttttggagttcagtagattccttgtctctggaaaatcagcagaaaacaatgcagcctcctcttgatctcccctgaactttgcaaacctctctcagcattgaccgcatgaagggtgggtgccctgaggcaggcaagccaccaggtggtaattaagaagcaagaagcgctgctcccaattctctagatctggatttagaggccagttggcttcagaaaacatctcattcacacaaaatgggacatggtcttttgtctgttaaacataagctttcaaggtgagttgtgcagaggcaagtctgcttgtttcatcaagctgacgtttatacttctgagtaagtagggggatccggagagtcttcttgtcactcaaacagtttccgtacgtcagtttcacacctctgttctgcatgtctctgttgggaaggatgctgatgtctgggatttgaaatagagatggttggacctctgactttcaacaggaggaaatcaaaattaaaggaagaatataggcgtacgcttagaaaggacctgtgaaaggaagataaatcttgggcccccaaatcactaagctaaagggaaaagtcaagctgggaactgcttagggccaacctgcctcccattctactcgaagtcacccctctgttcactgagataaatacatatcggattgcctcctttggagaggctattcagaaactcaaaagaatgcaaacatttgtctcttatctacctatgacctggaagccccctcctcatttcaagtcttcctacctttgctctgagttgtcccacctttccagaccgaacgagtgttcatcttgcatatgttgattgatgtctcatgtctccctagaatgtgtacaaccaaactgtgctctgaccactttgggcatgtgtcatcaggccctcctgaggctgtgtcacaggtgcacatcctcaaccttggcaaaataaactttctaaattagctgagacctggctcagattttcagggttcacagacctgtcaacatgaactgtcagtggtgatagcacccgttttcaagtctcattttaatcggaaggaagttttaccagctctttggctttgtagaaggtcgagttctccaaatttaagagattcaaaaatgtcctccaaagaagtttggggtgaaaacacatgacagtttcttgttcatatttggccagaaggaagcagtgtccattaggttgactctccagtgcttcttggtgttgtgataagcccgtctagcacggagggccagaaggaagcagtgtccattaggatgactctccattgcttcttggtgttgtgataagcccgtctagcacggagggccagaaggaagcagtgtccattaggatgactcttcagtgcttcttggcgttgtgattagcccgtctaacagggcgggccagaaggaagcagtgtccgttagtatgactctccagtgcttcttggctattgtgataagcccgtctagcagggaggagatgtctacacggtgttctccaaactgctcagaaaagagcagtaaggacaggatggggcccagttaagaggtatatatcttaccttctctttttctccttcttctccatctcctgcccttacttcttcctgcctgtcatttatttattcttttcacagatatttagtgagtccttgctctgtgtcaggccacagtgtagatattccagggatggaggtgaccaagcagacatggccatagtgacaggctaaggaagcacaaatcacaaatacagaagataattcctggtagtgacgggtgcctccaagcatataaaacagggtagtgagatgggaagttagagtagaaatggctcaattttgtgctggaactggctgcaccagcaggagccaatgattacccatctcccatgtttagtgacatcatgttgatagcttgatttcagccatagtgagaatattttcaccacggaaattggcacatgctacacatcagggctccctcctccccaccaaagctgatcattaaacattttctagaacatacctggaaggcatctgggaagaggtaacattgatcttaattgttattagagagaattttcaatttcagttgtagcatgaaaaatcacagagtccatttatttctcctcttcgagtcagtatatctcaaaacattttttcaacgttaatagaaatataagaagtgcctggatcagtttttgtttttgttttgtttctttttgagatagggtctcattccgttccctaggcgggactgcagtggcaccattatggtttactgcagccttgacctcccaggcccaactgatcctcctgcctcagtctcccaagtagctgggactacagggacacaccatcatgctgagctaatttttatatatatttttttacagagacaagttctcgccttattgcccaggctgatcttgaactcctgggctcaagccaccagcctgcctcagcctcccaaagagcagagattacaggcgtgagctaccacacccagccatttatctgttttttaaatagcattttggagatgacagaaaaaaaaataaaggaaagagaacgctcatagaagtttaaggttcagaagtatttggctttgaaaaaaaagtttaagggactgtttgtcatggggtctggtcttccaaatttaatgcctcattccaggtagctgcagattttatagtttctctcaaagaatgtcaatcctattgtctttccctgcttccccctcctggatgaagtctttctctacactcttttttgggaagttcccaaatctgtcagtatatattacaaaaactgttaccgcctaacacattaaatgtatttaaattatttgttctattaaaatgtcagtgtatttcttgaattttaactgtgcctgaagatcaatcattgtaacagctgcagggaaggctttatgacttacctgaacggtggtgtattctgtggctcggctaagtggattcttcgactttaatagattttactagctaggacaaaccatttgagtggcttctgttggagttttattcttgatacataccaatgatttactcagatccgttagaaaaaatagttttagggatgataaaaattatgataataatattgacaataaatagagtattcgccaatatgtatagagtgcccattatgtttcacaccctatgtcttgtgtgtggtgactcatttgaaccttatagcagccctgagggataggtgccggtttgtctctatgcgcccatgggaaactggggcacagaggtgttaagtaagtgacccaagaacacacagctggtaggagttttagccaatattccagtctcgatctgctgatatgaagccgatgcagctagccaccatgttatacccacccatagtcatgaaaataagatgagcttaatttttttcttttgagactgggtcttgctatgttaccctgggtggagtgcagtggcacagtcatagctcactgcaatcttgaactcctgggctccagtgattttcagcttactgagtagctgtgactacaggcacaggcctccatacccagctaagtttattattttttggtagagatggagtattgctatgttgcccaggcttgtcttgaactcctggcctcaaagcgatcctcctgtctcagcctcccaaagtgtggagattacaggcatgagccactgcacacagccaaggtcagctttttcacttcagcacaccaggattttcatcccagctctccaatcccccagctgtgtgggcctggtcaacctgtttagcctgtcaagacttcagtcccttcaactgatagatgggagaaattaatagcacctgcctgagaaggccagctttttgggggacccaggagttacgaatgcccagcacttctcaggtgatagctgctgcttatctccttgtacagagagaactggaacattctgaagatgaaatgggataataatgtccatgaaaagacctggcttcacgcttgcctcctgctagttccttttctactctatttcagcttcctgtttgtaacatgatttaagcactaagctattgaattttggagtgcattaaaaaaaatatcgagtggaaaaaggaatatttcttagggaggaaaaacccgacttttgactttataatattaagttcgttcatatctctcttagattcttatataaattttattgacctaatgttctgtacagtagtccttaattacagttttggtttccaaggtttcagttatacattgtcaactgtggtacaaatatattacttacaatatgatattttgagagagagagaccacatttatgtaacttttattacaatttattgttataattgttctattattgttgctcatctcttactgtgcctaatttataagtatactttattgtaggtatgtatgtataggaagaaatgaaatatatgtagggtttggaaccatctgaggctttaggcatctactgggggtcttggagtatatcccctgtgcagaagcggaggctactgtacataaatttgcctgtaagtgagcgcgttcttggattttgttgaatggtgccactgattatgggtcagagcttgttgaaagggtattaatccattatttactaaaactaattaaattttcatgtcatttctttacttattgtttttattctctatcagtgtaatttattacagcaaccaattaaagaacaattttatggttctatcagtgatgccaaaaaagcatttgctcaaattcagaagtcgtgataaagccaaccaaccaacgaaacagcaatacttgtaactaaaattgggagaaaggaaaacactttcagtagagtcaaggatttttttgttaattatttttatttttagagatggtctcactatgttgcccaggctggtctcgatctcctaggctcaagcagtcctcccatctcaacctcccaaagtgttgagattacagttatgagccaccgcatccagcccacaaatattattccaaactgtaaaatcgtgaaatgttttccattagaatcagaaactagacaagaatattcatgatagctgtcaattgtcacattattttagaagttttaacaaatacagtaagacaaaaaaagtcttaagtaatgggatgaaaccaaaatgttctttgttttaaacttctgtaattataatcctagagaagctaaaatattcagtaaaaattactagcaatgaaataatttgaagagttggctagatgtaaggtaaatatatacaaattagctggtatatactagttataatttaagatggagatagaaaaaaaccccattcaaaatattaacacaactatcagatatttaagaataaatgtataagagtgatcaaatacctgtattaaaattatataatttattgaaaggaattttttgaaagtcacccataaaatgatataattttaccataaaatatcagctaaaaagggggcagtcagcaaaagctcagctgtgaattaagattattttctaacccttagttctttgataacataaataccggtagaacttggaatatttcaagtaaagtaacatgctgtgttttatctgtattcctggtaacttgcatttttcaaggaaggaagtgtatgatatgaagtaggcttataatttagtcagatgagctcttggattatgttaccttgaatataatgcagaggagaaaacaaaaagagtcttttgcatttttatttcttatcaataggtccctttttcttggaatgtcagcctgaccctgaaggtattctcctaccagcagagccttctttgatgccccgtcttcaacctgccatgttttcccatctctgaggcttctattttagagacttttcctccagaactggcttatatcatcctgtgttgctgcatccgatcacaggtctgtggctgacctgggcagcgtagtagaagggtcttgagatttggagtcgtaacgagttttcaaaactcataactatattacagtttgcgcaagtcatttaacctatctgaagcttcatttcctctcccacacaggataaaataaggataataacagccattttagagttcgtattaatatttaagtgggagaatgcagccagtaccctgagaattaaggttcattcactcagcaagtgcttactaagcatctggtttatattatgggaagttttgagaattaggtggtcagaaaggtgtggtcctcgccttcaaggagcttacattctaggaagcgaagactactgaacaagagattttagtgctaggattggagaccccagcagaagtagcaaatactgtgtgaggtttaaggaggttggaggcaccttcgcttgtacttctacatgtgtcccttcatgtctagttcactgattttttaattgaaattttaattgaagactcacatgtagttgtaagaaataatatacaatgattcctcatattcttagctcagtttcccccagtgatagcttttgcaaaacaattgtgcaatatcacagtgttgacacttacagaatctatggatcttattcagatttctcattttacctgtactcaagtgtgtatatgtgtgtctgtgtctacatatgtagttttatacagtgtcatcaaatgtgtagcttcctttatacacaactacatcaagacagtgaacagtgcatcaccacaaaattcccttgcgttgccttgcaaaccacacccaccttccttctgcgcctgcctcatccctgacccctggcaaccactaaactgttctccacttttaaaatgttgttttttcaaaattattatataagcagaatagcatagtatgtaatcttttggggactgacttttttcactcggtacaattccgtggagattcttcccagttgttgcacgtgtcggtagcttgtttaatttcattgctcagtagtattccatggtattgtacatataagtgatcgtatgtttaatcactctcccgctgaaggaaatctagtcttggctattgaaagtaatgctattataaacatttgtacacaagtgtttgtgtaaatagaagttttcttttctctgggataaatgcccatgaatgcaattggtgggttgtagggtaatgacatgattagtttgtataagaaactgtcaagctgtttccatgctattttacatttccaccagcatttggtgatctagtttcactatatcttcaccagcatttggtggtgttgcagttttttattttagccattctggtaaacatgtagtgatatttcactgtggttttaattaaattgccctgatagctaataattttaaacatattttcatttgtttgtcatctatatatcctcttcggtgaaatgtctattaatgtttttttctcattttctatttgaattgttgtattattgttgcattttgaaaattctttatatattctagttattggttctttgttggatatgtggtttgcaaatatcttctctcaatctacagcttgtcttttcatcatctttacatggacatttgcaaaataaaagtatttagttttaatgaggtccaatttatcaatttttcctttcatcaactgagcttttgttgccaaatctaataattctttgggtaaccatatatcccaaataatttctaatatttttttcctaaaagtcatatatttttgcattttgcatgtatgcccatgataaattttgagttaatttttgtataagatgtgaggttaaggtcaagtctaataaattttgcctaggaacatctcattgttttagcaccatttgctgaaaatgatcttcctccagagaatttttttacctttattcaaaatgaattgagcatgtttgtgtgggtatctttctggcttctttattccactgatctatgtgtctgtctctctgacaattatacgctgtcttcattactatagctatgtagtaagcctcatgtcaggtagagtgattcttctcactgtattcttttttattaagattattttagcttcctaagacctgtgctttttcatataaattgtacaatatggttgtctatgtctaccagaagccttgctgcagttttaatggggtttaaatctataggtctaacattaaacctatagatcaattcgggagaattgacatctttactatgttgagtcttccagtttgtggacatggtatgtaattctatttatttagtataaacccactggagtgtgtacctaagcatttcattttctttggagcgattgtaaatggcattgtgtttttaattccaacttctacatatatctagaaatatgattgagttttgtgtgttgatcttgatcctatgagcttgctgattgcatttattataaagttccaggagttttttatttttgtttgtatttgttagtttttttgagatttcttgggattttctatctagcctgtcatgtcatatgcaaatagagaattttatttcttcctttataatatgtgtgccctttttttattgccttattgtagtggctagaacttcctgtgctatgttgaacaagagtagtgagaacatccttgccttgctcctgatcttagggagggggaagttatttaccatttcaccactaaatttgatgctagctgtaaattttttgtagatgttctttatcaagttgaagtgattcttctcaattcctaaattactaagaaacttttgaaaatgataatgggtgtgtactttttatcaactgctttttgtatgccaatctatatgatcatatgattttcctttagctttttgatatggtggactatattgattttaaatattgaaccagccttgaagacctggaataaatcccacttggtcatggcatatatgtttttttatacattgttggatacagtttgctaacattttgtggatagctcaccaacttttattcagaaaacatccgtctcagtttagtgcccaacaaggaaagcatactgtttgttgggtgggttccatttttgtggttaggagaagaatatagctcccttcctagggacggtctcaaatgagtccccatcagccaccagggagctcagctttagttgcataagaaccaatgagcatttagtttcatgtctcataaataatctgcctgcttatattttcatctgtacttctctcagctggcattctgccacagactacatttaggaccgcagccagtgggttacagcaggagaccagactccaagttctggcctcacgttgcttggtatacatcactcagttctgttggcatggatgctcctcctataccccatcagccatcttgcagtatgggtttggtggatcacacagggattcagataagagggttcagatccttctatccatcaacccacccatccacatcactgaaaaagggactctcagatgccgatgaccagtaagaccacatctgtgggcacaaaagagcccatttatgttttttatgggaacctaagaaggaaatgcttttctggtcaaatacgttcttctctgattaggcctctcattttaaggcagttgagaagactcacagatgtgattcactggcaatggctctggttcaccaagcttagctctgctcagtctacctttagcagaagattaaaaatgaaaactcttcttgttagaggtagaagagatcctttcccaaaccatagattcatggaactgtcaaagagcagcactgaactttgtactcaatgccttaatttttccagttgaggataattcacactaaacaagggatttcacctctctgactcatgcatcaggaacttggagataaagccctgttaataattcataattatatagcatagcatagggcagtttcagatgcttcaactaccaggtaggtagaataaaggaatgaagttgctgtgtatacgatgataaatggtgctaaatctatgtccccaatatagggaagacaggagaaagtgccaaagatagtgtgcatgcctcatctctaaggggcagccattattgacgtccagctgaatgttgccacgtggaaattagctataaacttgccagaacctccagtttttctggagagattagattagaaattcatatatttttaaatattaaatcatccctttttcttgagatggtgtcacgtcgttgcccaggccaccgtttatgttgtccaggccaccctggaactcctggactcaagtgactttacccctttggcctcctgggtagccgggactacaggcgtgtgtcactgcatccagcttaagttatccgatttgtaaatggtggcaatgaaatcattgcgtaggccacttggagtgagccaaataaaatacatccgcagtccagattcaacctgcaggccatcattctgctgtcactggtgtagaagactttttcagcctagtttattctaggctcttttcatttctccctgatttgaggctttgtaggacgttgcacaggaattatttcccttttaaacgttagttttcattttaccagtgcaactctgctattggcacatctatgaaatacgtaaagctatcattttaatactaaagaggaaacacaaatttgactcatttccccagaaaattcccctcctgctttccatatgttatatagttaactgtaaaagtggcaccacctcttaaacagccagctattctgatcatttgaaatctggaacattctttcctacggtggttgacttttcactgcctttgaggttctttccaagtaaaggcgttattctttgtggtgtgctcctggaggtcactaacaaaacgtctccagcaggtgttgtgtggattcccccaaatccgtaggctcttatttcctagacatgaagagtatgtgcgccttctttttggttaccctggaccagacattcctcagcactggcttgcattggcaggaggtggcagagggagaggacagtaaccaataccgctccttctacatgatcagtgttcaggttgaagacaaacagggctccaattatgttgtgatttagaaggcgacagagctgagacctcaccctctgcttatgggctgcatgcctttctcagtgaaataacgcagaatgcagaggccatgcctgcagatcaggggtgctagaggataggcaagaagtaagtggccaccctatctcgtgttgagagcatgctagtctccgaacggcctgccagggtgcctgacagccagagccacctaatgggcctatttgatcctggagttgctgtaatggcaagaaaatccatggcctccagccccagtgttgaagttttgacgctaatgtgatgataattctcttttctttgactggggacttgcctttgtttatctttttttgttgttttagccatgaaatatcacatgtaaatagccgaggatatctgggctctgagtctttaaaaggcaacagaaaggtctctgttacgaagggggaactagttttcattgtcactgtattaagcagaagttgggaatcatagaagaccttgatcttaccatatcccttgttaaatttcctctaatactattgagaagtttatcctctactttttcctgtagagtaaaagatatcgattttgtttctgtcggcactgccttggaacttgcttgcatccctcccccacgcgaggcgaggccctgaggagcgggattcgctgacccatgctggcagaacgggtgatggatgaggcagagaagggtacaggctggctggaccatgcgatggggaatgcaggtggaacaggcttcctcctgaatcaggagtggaagaggagtctggggtgaagccaaggggaagacagttaagctttaaaaaaccaactgcccagccgggcgcagtgtctcatgcctgtaatcccagcactttgggacgatgaggcgggcggatcacgaggtcaagagatccagatcattctggccaacatggtgaaaccctgtctctactaaaaaatacaaaaattagctgggcgtggtggcgtgttcctgtagtctcagctactcgggaggttgaggcaggagaatcgcttgaacccgggaggcagaggttgcagtgagccgagatcacgccactgcactccagcttggcgacagagtgagtctccatctcaaagaaaaaaaaaaaaaaacaaaaacctgccctgcccagccatgcccaaacagagtggccagcagtcagcttagtgtgggcagagctcagggaattattctgcagtgcagctaacatctagcaccttctttgtgtcaggtgggccagcactggggtggaggccgagacagcttgtgagctcactccctgggagatagaacggagtacccagttgcactgagggaagagcagggatagaagtgggctccgggtctaggagacggtggaaagagaggactgctcctagcgtgagagtgtcagggaagcttgctgggggaaatacaaggaaggaagagaatgcaggcagctcaaaagagccgggcaaggagacctgcagagcgagcggaggcctggtttctgtgaagcacagggcaggaaaatccaaactcacttgagtacacgctcagggtcatgggcttgctatatttttcattcaaccgccaagaaatcttgagaggcagctttatcatctccatgtgaggaggaggagattcaggcccagcgtagtggcttgcgaaaagattccagcactaaagtttgaccccagtcctacctgacttcctttctccagctgtgagactcccctgtacaatttttctggagggtctagagtcacatgagtcacgccaagccgccctttcagtgcgaaggaatccaagcagagccctcctctgctgtgggtacttacttagggaactgtggaggtgtcctcaggtagccactggtgtgtggggtcataccaagtcatttggtttacatcgggaatgccttttgtcgttatgtctagacccctggagaacagcccacggcaatgcacttgtggaaattcggactgtggattacactgagtaacaatcctaataatacctgcacacaatcagttgcctgtccaaaaagcaataaagaacctctagattttgtggtcaccatattaatcataaattggggatcatagaaggccttaatctcattgtacatacttttctattcctcccagtaccatttaaaggttagtgaaagcaacctttagtatcatctgttttttggggggggttttttgttgttgttgtttagctgtttatgggtaggagaatgcgtgctcttttagggacatctcttcaaataagaacaggttgtaacctacactcaaaagagatgctcttggcaaggtatggcccctaaggtttgaaagcgttttccaggcctgctgtcaggccaggctggactgtccacaatttcttgtcctgcctcccgtgatgctagccatggatgcaccccagaagcatttagaatttgggagaaaaaggagcaaggcatactgcccaaatccaaaacaactttggctccctttggcctccattctaacatgctgagtggatgcatcatggatagtcttttaaaaacaagttctcatctattcaatgtcagagccctaaatggtatgaaaaataggcaacttgggtcatgccactacagatcgacacccactaaatccttttaatttagtctagtgcaacaagtatttgtgtaagtgtcctctgccctggacaccggtgaggtcaccgtgggaatggctgggcaggaacaaagccttttgtttccagctgagtttccttttctgaagattgcctgtcctagacaccagttctctgttctctgtgactctgattcctgtctcctcttctttcactctcatccattttcaatactggcccctcatttcacttcctcagctaaatctacctctcaaagatagacatggacatataaataattttttaaaatcctcttttgcaaaaaaaaaaaaaaaaagaggtgaatttagttgaaaggatatagccactcttttctgaagtgatggggatattcgatggcaattttgtgttttcttcacttggaaaaactaaaaagtttgcaacatttaaaaaaaatacaacccttatgctgatggatgtacactgtaaaacaaccacgtttggtaaactgttaatcactttcatagtgtatgtggatggagccagttaaaccagttttcatgtcttttgggtccttttgagtctgaagataaccattttttaggtcctcatgaacctctgagcatgaaccatgaaattcctattacacctgtgcttttataaacttgatccaaggtttaggctctcagtgcctgtttcctgtttaatacatatcatggttttggaaaaaatgaaagaaagaaagaagaggaagagctgtcattcctctgacaagtattttcagtggaattagggtcatgatgtcatgcttatttcaaaagatagcttcatctgtgccttcacccagacttagggttctagattcttctagattctacagcaggcactggcaagcttttgcttaagaaggcaagccgggaatggtggctcacgcctgtaatcccagcactttgggaggccgaggcaggcagatcatgaagtcaagagatggaaaccattctggccaacatggtgaaaccccatctctcctaaaaatacaaaaattagctgggcatggtggcgtgtgcctgtagttccagctactcgggaggccgaggcaggagaatcacttgaaccagggaggaagaggttgcagtgagctgagatcacgccattgcactccagcctggcgacagagggagactctgtttcaacaacaacaacaaaaaaggtgggggggtgggcagagagtaaaatattttagactttgaagtctaagagacaaaattgaggttattatgtaggtattcatatagcatttaaaatgtaatcattttaaaatgtagaaatcacttttagatcgtagaccataaaaaaacagcaggaaaaactacatggttggctggatttggccaagttgacatagagagccaatccctcatctccagcagggcttttactcaatgatacagtgcgcatgaattgcttgggggattgtgtacaaagtgcagatttggttataggaggtcagggaggggcctcaattctacattcctaagaagctcctaacaggctgataatccatggatcgcattttgaatagaaaggattatgcaaaaagccagagtttttttttcccttgtcttataccagtggtgcctagcatggtgtcaggtttatagaggactaatacatataagaaggagaaagggagggaggaggaattccagttgttttttttttaatctaggtacaagtctctctgttgatttctaaacatcgaatgaagatgaaggaaatacttaaagcacctaagcactcataactcacttagtcatttcactattaaaagagaaaaatagttagtttacaatttccaggaaatcagacaggtcaccaccacctcttcaacgactggaatttgcacagtctcactactcataggcccatctgttactactaacagtgctaatgtgattgtctgtaggtctagcaattggaggttgttcgtttctttgagacaaggtctcactctgttgcccaggctggagtgcagtggtacaatttcagctcactgcaacctttgcatcctgggctcaagcaatcctcccacgtcaacctccagaatagctaagacccaggtgcgcaccaacacacttggctaatttttgtgcattttgtagagatggggttttgccatgctgctcaagctattctcgaactcctgacctcaagtgattcacccgcctcagcctcccaaagtgctgggataacaggcgtgagccaccgctcccagcaacaattgcagtttttaaaggcagaaaatattacacaggtgggttcaaatttgccacaccaagtagaaggtgttggaaggaaaattaggaattcttaagcttcagaagattagtagtcagagttaaaaaccagacaattaacaagttaaaaaaaaattgtgaagcacacacagctgttatcttccagaaacactgcttacagaggtaattgctcacagattttagggtttacagcaggtatcacaggatttcaaatttaagaggggggtgggggcctgtgttcaaagtcttaagaatatccaagggatgtatgatgtatgcataattacctgaaattgaaactactgtagtttaaacacttgctgaaagaagaccttttatttcatcttctctacaggctgaaggaaagaaaaaacaaaactaacaactaacagaaaaacttttcatgtcgaatatgtagatttacaatatgtgaattatcatcagaagaatgaggttctttgatgattgttgcagataccctgaagaactggcccttgttgtagaagaatggcacagggcacatggtaaaatggccctggccattcctttagacattttgtttgtacttatattaacttgagagaaagtattaggaaaaacagagtaattctgtagaaatattcctgatgatacactaggcaaagcagggagaagagaaaaagtgagcaagaaattgtgactatgaattccaaaccagtttggctggatgagccaaaaagacaaaacaagagcattcaagagtctgtcaggaagtggtggcctttagttcattttagtagcaagaaaactgatctttttctgattttaagaactataccatctctattctgggcttcactcttagctctcacagttagaaaacagtgagccttggtcaagtctcataaactgtgtctcagttttttcatttatacaatggccaaaaaaaaaaaaaagaaagaaaccacaaaaccataccttctttgcagggttgtgtaaaggaaggttgaactagaataggttgaagtcaatcacatctctaaggcatttggcatgtagtggaacctcagtaatcagtagtttttattatttggtgcacgatgaaactggctatctggagatgttttaaaatacaggttttattattatttaggtatgctaagaccagcagatcaggagacaatgaccactgaaaagacagtttgtgagagttgtgatgattgtgatctgtgtcctttacagtttgcaagggaaggggacatgctatgtcagagtggagggacatggggaggcaccaggactggtcaagaggcagagggagagggtcaaaccgtgggttctgtggggaggactgaacgaggcagggtaagtagactagggtttgagtaagttcagcaggctctggggaagaggggctgtccctatttttctggtacctggccctgggtgattagaaagggtggatggtggcctggggcatgagaaataaaggaggtggtggggtgtaagttctggattggttgggttgcattcaaaaggggtgcccccaagtgagttgtttgctgcctctaggaatttattgaccctgggaggggagatcccagatgtcaaagcatgggaggacagaaaagaaacagcatggttcccacaagagagaagtagacagagacctctggaagtttaaaaatatatatgttgggatttcatagatgaggtgagcaaaaaattggccgggaagaactattaaggaggagatgatcagaaacattttcaaaatacctggaacaaacaaagaaccacatttcaagaaaaagacagagaaacaagactagcaaatagagttttcaggtggaaaaatcacacgttggacaggagactgaaggtaagggaaaccaagtcaggctttaacaccattctgaattgcagctgcaggatcacttgctttagatggaatcacccagcggatggcgtttaactctgctttaaaccccttcatggcttcccaccacacttacaaatacaactccttatcctgtcagcaggggcttgcttaatctgaccctttccacatatgctggatcacttcacgcctccctgttctttcaattccttgaacacaccaagttcctgcattcccgcctcagggccttcaccttcagcctctctgtccccacctgctatcctccccagctttgcacacctgattgctttttgtaagtcagatctcagattaattgtcgcctttacagacagatttttcttaactctccagtctaaagaagccacctcctccagttctcagcactgtgcttctcactctcgtttattttgttgtttattcatttgcttgtcatctgtattttcccactagaactcaagtttgtgacaacaaggacctaggtcattttcactgctgtagtcccagttcctacaacagtgcccaggacacaccaggaacgtgacatttattgaatagatgaaagaacagtgtaaaaaccacattgctcttcactctgcctgcagccaactcaagaacaatttcctaaagcagctctgaaaattacgaaagaaatagtgcatggattccagccccagtaggcttctgggcttggtgtttctttaatttcatgtaaatttctctaagtaaatatgccttaaaagtgaataaaattttatttcgctttaacaagagaatataaaagttaaaaaggtcactgtagtaatagactaatctcaattaccagggcagcctctgaaaccctcactcccacctaatctcattcggtgcatacgcagctcaccgtgtgatttccaacacagctaaatgaaattataaagcagtgttaaatttattaatcatttaattagctaaatgttcctgcaagtactggctagatgaatggcatgtcattttctaatgcaatttgcctctcaggcagccagggtcagaaagggaagctcctggcatctcgaatgagctctttatatcacaccttctactgggagacggttgttataccactgattatatttgagacttgtacacaagaccagggcactcagatgctggaattggaaaatgctctctttcttacctgggttacaaagaggaggctcagggtagctgatgagtcccccagagattgtctctccccgtgtccccttgcaggacaaatcttttcatatttaacaagccactgagcagaacagggggaaagatagcaggcagtattaaacgcatgctcaatctagttttatttcttcaaatttactcagtcgagaaaaatttgtggagtgcgaattctcctcatgctaggtgactttctaatccttctagttgagtcaggatttatttctccattctcgccttctagcctgggcttgtcagcttggggtgtatgccgcacctcctctttgaagaggatcttcatttggaggggtgatctgactcccaaccctccccaggtgaaagcaccgggattcatacctagggggctttgggatttggggctgactttgacccgtcattatttctgactgcaaaattcctgacaaatgtctgctgctgggtgctctgtgaatctgttcccatttgcagtgagagtgctggcatcaagcacattgtctaaattcactcggcaagaagccgttggagtgggtgccacgtgaggccgagaacatccaaatgaacactggtctgtttgttcaagatgggagctgtcagttgtgagagctcctatgggaagagtgttttgatgtatagacatccctggtccacagagccaccaagcaaggcagactatttcgtgagaaagaaggaagatagactccatgcaacacagtgggtgtggcaccaagcgggaggtggagggttgctacctagtcccggctccacctactgtcacctgcattcccctagacaaatcacagcacctcaggatccttgatctcatcatctgtaaaacagagatcagatgaaccctcgatattaatatcaataagagccgatcataggactgctctaaggattaaatacaatgatgtaacctacttgaaagtgtcatataaattctgaggtgaagtggaggcattatggatgcattttattttgttttattttatttcatttattctttttttgaagaggtatgggtcaagcagatctgcagcccacactcggctcactgatcacgtcccatacaatcttggcagatacttagctgaattccatcgatttagtgataaaatgggaacagtagtaatggtgcagattagagaaaaaaatgtgatttgtgcattcatatgtctgtgtgtacatatatgtatatgttctgtgtatatgtagacatgtatagatgcatgtgtgtacgtatacacgcacacatacataaattgtgtacatacacatatacatatacacatacaatacatatattctgatacacatatgtacatatatgtgtatacatgctatatataatgtagcacgtttcctggcaccttgtttggttcaataatgttgctgggattatactacaatttccattactctgactatggcaacactgctgatataggagatcacttttccgcacaaacacctctaggtattgtttaacacagacctcatgaaataggtttgccatggattagataaggcaattctggactcacttccaggatagaaggcaaagacaagtaccaatatatttggtaaaaatatgacatgacatttgagtgcacacaggcaagtgaaggtggtttcaaatcctccctctgtcttttcccagctaaatgaccttgtgctggctcctcacctcctaagcctcagcttatctctaggatggacgtcattgtactcccttcatcccacctaaggttgttgttaaggatgaaatgaaaagtccacagcataagcttgacacataaaataagcacccgatgaatactgactaaagagagaggaggagtaggggagagaaggagagaagagaggaaatgaaaatgtttctgaataagttatgtctaagttttttcactttttattttttattgttttcaggacagggtcttgttccattgcccaggctggagtgcagtggcgtgatcttggctcactgtagctgctgtctcccggattcaagcgattcccctgcctcagcttcccgagtagctgggattacacccaccaccatgcccggctagtttttgtatttttagtagagatggggtttcaccatgttggccaggctggtctcaaactcgtgacctcaagcaatccacccgccttggcctgccaaagtgctgggattacagacatgagccacctcacgtggttgagattttttcactttaagaaatgctttttctgtcacctccctggactgtcttggatttgtttctttgaggggaaatatgaggctttaattttccctcccaggccttggaaaggccaagagaagcctggagataggaatccacctacacagagtgtctcagtaaattggcagtggccaggaccagaaccaggacacctgtctcccagatctgtccttttcttggatagcttgaagttacgggtagttattgaattggtcactggctaccccctgaatcattacctgattttttactgagtgttcctacctgtgagtaaagggtgcctggttttgcacaagtgttttcttggcccaagagatatttttatatttgcctttgggttgatgagatgctggtatgtatcattcgttcagccattctttcagtaagtcatcacggaagtctgcctctgtgacagattctggggctctaaggcggaatttacttcttcaaagtacagtttcctgccttgcaagtttggagttaaggccacgcagaccagagttacgtgcacaggttgtaatactctctcttgtccctggttgcctgattcaagttaggggcttcttctggattccgtaggtaggatgctgactctcagctgtcctgatgccactggtgttcctctagtaggcaacattgatggtaaacatagaaagtcatggaaggcctcagttacctctagccctgaagacacagggatacccttggggcggagaccttagggacaggacaataaagatcaggccttgggagatgcaaacagtttgcccttggaccatgtcttctgctttcatccttatgctctcaacagatcatgccaaggtcctgtgttcaccgccttcctgagtccccattcagaggctcaagaattgagacaaaagggcatcctgcaaatttgctgccctggaagctgtgctgggggagccagtagagacttcaggtggatctggaggtccttccccaaccttctgcaaaccatgtcttcccagagagcttctaagccaaagcaaaggtgttgctctctgcctcctgttgctctgtaattcatctcagcaaccatctttcccatctctgggaagagaatgttgtcccccagaaaaagtccttatggatagatttagttattgcttatggtttagagaaagcgcctttcaacagtcacatgcaagtattctttcaggcatttatccaaacacacaggatgaggcctctttgtcaaaccagtgtttgttgacaagcgacatttgtgtgcaggagatggctcattgtgtgtgtttacttggagctgttatatatgctgggggagacactgtgtatacaaacctaggagggagagattgggaggagggaagaaagtgaggaataggcttagtgagaaagagaccagagaaagagaaaagaaataaacattagcagggtggttaaacatccaagcattgaaaactgcgtggtggagctatgtactaactggggggtcttgaggaagcccattagtctccctgagcctcagtttagtagaagtaggaatcgtcattaaggcgcctaatttatgaagttactctgagctctataagagataagcatacagaaaactttggacagtgccttgcacacagtcagtaatcaatgcatattcatcatgatgttagagaaaggccgggcatggtggctcacacctgtaatcccagcactttgggaggccgaagggggtggatcacctgaagccaggagttcaagactagcctgcccaaaatggagaaacgccatctctactaaacatacaaaattagcctggcatagtggtgcatgcctgtaatcccagccacttttgaggctgaggcaggagaatcactggaactgggaggcggaggttgcagtgagctgagatcgtgccattgcactctggcctgggcaacgagcaaaactccacctcaaaaaaaaaaaaaaaaaaaaaagagagagagaataaggtcagagggggaaaagagagaaagtgaaagcaacagtaaggaagagaattggaaaaaaaaaaaaaggaactgatctggctgtatctgtcgagttgcttctgccgtttctagcccagcccacggttttccctctgcagggtgtctgtgggcatggtttgcaaataaacagtgagaagtataagctaaacatagactttaggcatatacataataggcaggcgtgatcgcgttcacccattcagtttgccatataaaagcttttcctcggtgccactttatggcccagaaacaaggctacaaaaactttaatactgctttttattttatagaaaaatataaatcaatactttcatgtctgtttgacgtgtttgggagctacagcaattgaggcttgccagtgtctggatgccccaccactaccacgccacttagctcagagtttgtttttttccttccaccatgtgaaatgttgctggttaaccagttaaaacggggagatggccatgattgcttttagattgccacttccacattgagtgaattttataataagaagccattttttccccgacaggctgcccttgtgcccgcctctctgactttgaggtcctcattattgtgggtttaaatgaaggatgttcattcaggcagggatggggggatggggggaggccaccaggcatcagcgctgttatcaggaccttctatcaggccaagtgacaggcgtccagagcaagaatgcagagctcatggtggagacctccggctgacaccaaaggtgactcccctcactctaaccttgaaagggaaagttcccactttattaaaatgaatttcgaaagggccgctctgacagctgcataattaaatactggagtgtcagcgataatttattccactcgcatgtggtggtcagatccttttcactagagggtcagcaaactcagtgacagaggcaaggagacaagggattcagggccctttgtcatttatgtagcaccagccctgaaatcggagactcataaaacctacaaatacacacacaaacacaaaccaggcaaacccacacaccacagagaagaggcaaagtgtgcataaagataccctgttgttattcacccagtacaactctctaattcatgtataaacagtaagtgtaaaatgttccacacccttatgtatagacttttaacctctatttgagggtctctgggaggaccatagttgtttctgaagtatcacttatcctacgttccatgtaagatctctttcctagggtaaacttgatatggaaggtcttcacagattaaaacgaaggaaaaaaaaaaaaaaaactagataaatctccctggacatgaacttttgtagaagtagttacaatgctagtgacctcatatactcatggtaacggcttccggcatccaatgaccttgccattgcggaggtcaatttcatgtgtgtgtgcacacatgggtgcgtatatgttacagagggaaacttgcctgtttgaagcaggtgtcgtggaaacaacatgggctttagagccagacatggaatcctttcttatgattaatgcagctaaatttcccactgcagccggtagcatattgcttcataaatgtctataaaaaaatacgaaaaatagaatcagagcaaattcagcatagacctccttgggatgtttattctttgtttatgttggtgttttgttttgtgttgtttcagctggggtgcagttgtattctgttccctctttgctagttcagaggcagtgaaagcgtgcttctcaggactcattgtccagaagattctgcctacagctggttttacgcagagaagtagcacacaaacccagtccatgatttcttatttgactctgtcctgtttactctgtcagggtgaaaagcacaggccaagctcggctagtcaaagcattactttgtcacaggcaggcttggcttctccgagtcagcctgaacaaattacatccctcactcggtcgccgaaccgggaacagggttataactcagtctaagcacccgtccctcttctattaccttcataaccaaggtcatactaatcaactcaattaccagccctctcagacattttcataatgttttctggtagttgctctcctgtgaaaatctttcggtctaagcaaattaatgtcattttcataactatctgcatttcaggtacagtgatctcctttaaaaaggctgcgtcccagcagcatagaccagctttacctcccagcgtagtcttcagacaagttggggtattgccgaagtccattcttgactttttttaatagtgcaaacaaatcatcttgtttttaggaaaacatgaaattataaagaaattgacttcaatcacttctggaggcagagcactgagttgcctccccacctcattcccctcactcccaactcagcaacctgggtgtttcagccagggcttttccaggccttaatttctctgacacaggaggatggaattacattatttccaccacaaagattgtgttttaaatccttcttagtttgcagcttttcttcccttttgcctcctctttagttcattccaatgataaatcctccctcctttgtcacagagccactgtgtactttcatagaccatcctatttttcaacgagagttcagaaccacaccatacgggcagtagtccgcattttcaacatttcctaacagcacaattgttaggtagctaacaattgaattgactatgtcaggtagacttatttttcgagttgtgctggttaactgcaatccaagtttaggaagcaaactaccaatttcatttaatagaatgagctaaccaaggcacatggtgactactgtccctcaagaccgctgaactaccacttccagcacctgctcagattattcattacaatgaagctctttaacactgtgtttgcattctttagtatatatcttgttaatagtaggccctgaataaagaccagttgaacaaataaactatttttccatgtattaattctttagtgaacttgcttatttgttcagaagagacattaagctaagtatacaacactcggtaaatttcaacttcatcatatatataataattatttttttttgagacagagccttgctgtgtcatccaggctggagtgcatggcctgatctctactctctgcaacctccacctcccaggttcaaacaattctcatgcgtcagcctcctgagtagctgtgattacaggtgtgtgctaccacggccggctaatttttttgtattttattagagacggggttttgccatgttggccaagctgatctggaactcatgtgctcgagcaatccacccacctcggcctcccaaaatgctgggataacaggcatgaaccaccatgcccggccatcagaaatattttatttcactattttaaaaaattagcaaagaagcaaatatgacaaaatgctaacaattccaaaatgctaataacttctgagtggtgagtataagtgtgattattatattattcttagtatttggtttttttctgtagtgtgtagtttccctccatgacactgagggctcagatggctctgaccttggagacagggagacatttagtgaaggaatgggaggtaaggagctggcatctctggtgtgtccatcatgcactgacctgcactagatgttttgcttccagagtctcctggaatgctccatggcctccacgcatcgtaattcccatcagcttaaggcagcgaagcgaatgcccacagtgcccaagtcacttgcccaaggttatccaagtcaaataagacagagatgagattcaaattcaggccacaatgacttcaaaaacccttgtatccttgttttgtttcgtttccctgcaaacattgttttagttgagatgaaattcacgtaatatacagttaaccattttaaagtgtacacttcagtggcatttagtgaactcagtgttatgccaccgtcacctctttttagtttcaaaactttgtcatcaccccagaaaagcatacacataaagtcatcactgccccattcccttcttccaacttctctgcttttggtctctgtggatttgcctattctgggtataccacataaaaggaatcaaagaatatgtgaccttttgtgtctagctccgttcacttagcatgctgtttccaaggcttgtctaagttgtggcatgtgtcagtactttattcttttttatggctgcatagtattccactgcatggatataccacatcttgtttatctgttcatccattgatggacatttgggttgtttccgccttctaggtataatgacttgtgttgccataaacatttgtatacaagtttctgtgtggacatgttctcacttttcttgggtatatacttaggggtggaattgctgggtcatatgatcagtctaggtttaactttttgatgaactgacaaactgctatccacagtggctgcctgtaccattttacagaaaatctctgcttttaatacttctggatgtgttctaaggcactaggcttttcattaagttcatttctgcagaaagagttaaggagtgttctcaggtaactataatcaacccccagggacttactcaagttgtgcatgtgcaactgaaatatctggcaggcatccagtccctgttatttcagtctctccccgcctccctgcccacacctctgaagctccatattacccaggaagggacaatggggggcctagaaatgtggagggaggcaagagagtgataattatgccatctacacttgtcgactagaatttccaggtactttcacctctaggctcttacctggcttttgtgaagcccctcagggaagaggaggaaagctgggcaagggggaggggtaaaccaagtcccaggaaagtcattccagtttcccaagatcccggagcttgtttgtatccagctgagatccagttgagaccagaattcactctctccacacctccatcagctgtggcctcgagttccttaacattttttaaaacaaaaaacttttgcatgggaaaaatccctttagaaagttaaaggttttccttatacaaactatctcactttgaaaactggcccactgtaaaaatcttgattccggagcttccttaaaaatcttttcacccctttaaagtgaaagttatggagaatctattagatacaaattaatacgggcaaggcgtgtgctagctgttttataaacatgatcccacttaatcctccacttcacaattctgaaaagtcaacaaatttggcccatggtagagaggaggaaaccaagacttgaaacattaaataacatgtccaaagtctcccatttcagagacaggggcatttggctccaggtttttctgactctagacagtagtttgtttttagcacatcaaatgtctgagacttgtgatgtgttagaaagcacaaaggactttgatcacaagatcaagccccagagggccatgactgcataaaccacaacaactgcgtggctgcctgtcacgtcttcatctgcaagttggaggaacttggagaaatgcagtgcttccctgcagctgcagagggtctcactgagcactattcttggaattcttaaaagctgggcctgtaagccttttttgcatttcctttcagccacctcctggctgtccttttaaagccagggtaaagtccccagcacccagaatcaaggatggggaagaggaattttgagaatgtgcttcctgcttcacacaaatagctaaagacagaaatgatggcacaagccctaaccaacaactaggaaggtaggttgtccaagacaaattgcagtttagaatggacctgccaaatgggtgggtgggcaggatggctgggatcgccagtgcccaaccttgccacagcctccttttgtcactctagggactacccttttcctccccagacgtttttcctgactctaaatagtgggaaaagtctggtttgagattgctgtattgcagggaagttcttacagcgggcttgatgggcccagaaatcaagatggaaaaaaacaaccctctatgttgatggccatgcacagtggctcagcagaactggctctgttgaccaggcttgggtgctctcctgcagggcattgcaatctttaggacaccttcattacccctcctaaaaggagattttataatgagcgccaaccagctcaaacaagttaggatctcctaacatgtctggtgaaaatacaggagtatttttcatcatctctggaaaagttgctatcatgtccttcaataacccagtctaaccatgtttttccagtggaaatgattcccggtagaatgtcctatgttccttttgcacatttctccttacaaacatcatctcatttaatcctcaccacaaaactgatagtgtcatctccaatttatagttgaggaaatagaggatcagagaagctacgtgatctatgcaaggtcccccagctaggaagtagcaaagatggaatttgacccaggtctgactccagaagcactttcctcttttgcctcctaatacattttcttatagggagcatcctgcaatacaactgttaagaccacttaatgttatctttggattaaaaatggtaccactctcataaatcaatgagtttcataccctaaattatgccagattaagaaaatgaaatctgactgtaaattacttctctaggagcaaatgattgcttgattctattgtagaaaataaaaattttttacttaaaccacacaaattaaaaaatggaactcactttcacagtcaagagttacttctatttttttttacagtaaatgcgctctttaagatgttgcaagctcaattcatgatttttttttctttttctgtatgtttctaaatttagaagttacatttacaaggaggtaatttgcaaggtcatccttttttaaagaaatttaagcaggagatgaggtctttccaggtttgagggtgatagctcgtgattcttcatcaactttggccaaaccttcgtggattcctgtgtgctgattattagtgccttgcctacaaatttttaatacattgacttatctaaatattcctgcatgcacactccccaatctaagaaaaatgtgagatgttgggaaatgtttccaagaatagaccaaaggattagtcagcctagagaagtgaactttaagaggaactatgtttattcagtggtgattatttgctgacccagtgctaggcacgtgagagtgagagggatggaatgcttgcaggagttgccttggatatcacacactgacttgggagacacacatagcgacagataattacaacatagggacacccggggaaaatgtagacgaggtttaggggttgctcagaggaggaattaactctataaggaagtattctgataatggctttcaattataggacatatctaataacatgattacatactctcttaatagtgtagcactatagttgttatttatttcccacactgaacaaatataattatcatatacaccctttccattattagctctctccatttttaatgaaaacagtggttggtggtttataagaagttttttgtcggtgtcatctttcacatcagtttgctacccagaatttaaacattccttttttgctgctgttttaatttgaaataagaatggtagcccccaggtcccctaacagtgggtgctgatttcacagtgggcttacaaatgctcttcaagagtatctcagtgttgagtccagccacccaagggagactggttcttcactgtgcatcatggccttttaatgccattttgcttttttatcatccaatcagcagatgttctttcttcattcacgttgaaagcacttcgctatggaaacgagtaaagttcattgtcttattttttgtttgttttgttttctgatgtcctgacagcagaatcaatcttcggaatccttttcaataaaaaaaaaaattaccaaaacaaatatgatcacagaagcttttaaaatctgaaatcccaggaagctaattagtgcatccttttaagatggcttcctgcatttcgatatacgcataagcttgggtttcagatgcagttggcagtttgccatgagtcagacaggtcatcctgactctcaggaacacggagctcctgcagaagcctgtggagcgagggcaagttgggatcctcccctgtgttagcacgtgactgtcctctgtcaccatgtagcaggtggaggccaggaactacattttcttgggttcctggtggttagttgtacgccccatgaacttctctcatttccttaattatatccaaaataatgcccttgttttatttccccacttggcactgagccttagggagcaggaactgtgtatatcccacagctttgcatggcacttggcacgtaggaatgtattaaatgcagctgctttcgtgcaggaagcgcggacttcagatttggtcaaagatccatgatttcagagcaggcagcccttttaaacctgtatctgagtcacttcaatgccttgtgtttctgctctgggctgcaaactcaagagcagcaaccacttatcttggtacctgtagtcccgagccctgtgtctggctcagagtaggccctacataaatgtttgctcctcctcactgagtggctgcatgaattgcatccagcatgtctactctgggaaagaacctgtggagcctctttaggagtgtgtttttgccctccctcggaatctggtgatctcactaccaatggcaaagacaaactgtgaggtgtttttttgtttgtgtgcacgcgcacgtatgtgtgtgtgtaaaaaggccatggaaatataaaattgtaacctaaatgccttcacggccagttatggtggctcacgcctgtaattccagcactctgggaggccaagatgagaggatcacttgagcctagaagtttgagaccagtcagggcaatatagactacctgcaaaaagaaaaaaaaaaaaatgccaggtgtagtggtgtgcgcctgtagtcccagctactcagggggctgaggcaggaagattgcttgagcctgggacgtcaaggctgcagtgaaccatgatggtgccactgcactccaggctgtgtgacagagcaagaccccatctctaaataagtaaataaatgcctctgtgaatccatttcattgcattggaaagacctccaggattctctgcagaagaatctttcccaacataaaatccattgttaatcacatttgacacacatgtgtgcccatgtctctgggcctgtgtccataggcatctacgtcactgcagagtgaaccctttcggttcacatcacctgctcccctcctgggcctcctgaggggtgtgagagtggcacattccacaggaagggaaccctgcatgtccatgtgccatgtgccatgtgccatcttagagacgtaaaaacactttgtatgtttggggtacaactcagtaacccattggtgcagatatgtgattcttaggatggcccacatgggtctctttcacacacccacgtgcatgacccaagtgagcaaacaggcagagactgggaccagaagctcactgtggttctaagcaagcagttgaactggtggcttctgatggcctgagaagcagtttcccttgataagtcttcagccacacaaaaagagactgtagctcacaacactcacagtcaaagccactggaaataactatttcctatcaaataaagcctttctcttgaaaaatttgaagaaaaaaaaaaaacccacctagtgaaaccttagaatcaacctgaaggttcaacagcaggtgaatgattccataaatcatagtatattcacttaatggaatactaggtagccactaaaataaaatgacagttggaaaaaatacttatgataaaaggtttaatgacaaagtggggttcaaaatgagagatactctctgactagaactatattaaaagaaagatggatgggggagaggacggtgggtgatatattatctacatagatactttttttcacttttcaaagtgtttaatgtgttgcacagcctttagaatttgaaaatgtctaacttaaaatgcctccctagtgaaatctgtggcagcttataaactggcaggatactgtattttcaagatacgcaattgtaagtggtgctcacatacagtcagaatgtttatttgaccttgatcttgtgagggcttggttcccatggctttgtagagtgaaaggtcctgagaggcaggttagtgacgataccgggacacgtattgtagacaggttgataaagcaagcttccctcagcccagttttcagtggcaaatgcctcttggccaccaatgctgtacactttgtttctgtttccttacctgtcaggcagttactgaaaaattatcttttcccccaaatacaataattagtgccttggccagacaagttacagcaaatccttcaagattaagaagggactagccgggtgtggtggctcacgcctgtaatcccagctctttgggaggctgaggcaggtggatcacctgaggtcaggagtttgagattagcttgaccaacatagtgaaaccccgtctctactaaaaatacaaaaattagccaggcgtggtggcgcatgcctataatcccagctactctgggcctgaggcaggaaaatcacttgaacctgggagacagaggtttcagtgagccgagatcgcaccattgcactccagcctgggcaacaagagtgaaactccatctcaaaaacaaaaattaagagggactgatgtccagtgaatttctatgtccgccctaagcactgaggtgaaatgaagcctagatggttcttttagaatatgagtgagcagtactcatggttaattttagaagctaataagtatatatttgataactttaacagaaatattaatactaattaagagtaaaaagatgatgaataaagtagcttcacttattgagcctttactagatgccatcttgcataaatggttgtcattttgcaaaatgtattccatctaatattagcagtaaccctgaggacttggtattcttacctggatgtgtcttatatcaacatgcacgcgttctctccctcagcataccgtgtcttattaacttctaacctccctctcattatcccaccaatctctgccagtacaaccacatcaactgtgcagatcacttctctagtgtttgggatttggggcaacctactgggtctagctatgaccccataaaagttgaacaactctgccttaatggcgctaatttttaatatgcctcattctagttgcttgaattgaacgaaggcatttgaaaattgctgaagtgcttctcagtgatgaaatgttacagatcagtttgaaatccaactttattcaacataagaaagcctatatactctggagcttaaagactgaccttttcacttactgtaaggtatctaagacttctgggtgtgggttttaaatatattttggatgagctttgttcatgtttacacatggccaccaggtcggccacaaagctgtggctctggtcagtctgactctctttagcaggaatcacgtgacaatctgtgtctgtgattagctccgtggatattactaggtagatttctcacttgtccttgttttgatcttcattcctgggtgaaagaatcccagggagtggaaaatgtaggtagttcatagggctcctgaccttccatggactgtgtctaactcagctgtgatgaggacgtgctctgattctgatgaaggatgttagcattagaggcaggcctgtgtgcctgttctgtgtcctggcaccgatgtttaacaaaaaagatcctttcagagttactcatacgacttacacattcccatgggagctccaactctgtttggtcccaatgtgccctttttgtctcactccttcctcccacacatcctgctccccactcccctaattactcatgattgcactaacagccacatcctttcacacctctgagcttttggtcatgctgtaatctctacctgagttccattcctgcctccacccttgcctgtcaaattccttagcttcatgcctttgaattttagcagaaatgttacctgctctatgaaactggattttccctttgtctccattccctaagctgcacattagagcagctgttacagtttgaagtgacccctatatggattgtttgcacacctgtgttgcaaatgtattagttaggataggctgagctacagtaagaaatagcccccaaaatgcattatagctgaaacccccaaagggggatttctaacacagaaagcaacataagtgggtagtcctggccaatggcagctacgttccacaaagtgactcagggatccaggctgcagccacttagtggttccattctccctgctgatatctgcatccagtcatctggtatttcttaccagccttaacctcattctattggtaagcactagtcacatggctatctcccactgaaaagtaggatgtcaaatatcctctagccctttgctcaggaagaagagcaaatggatttttgttaagaagctggcagtctgtcacaggagctacttgaggatacacacagttttctccccattagcatctgcagtctctggtataaacttgagtcttctctttggtccctgataaatatacatagaatgtatggatgtgagaaagttaaactgatgtctgtgtgtcttcatgtcattaaactttgaatctatggacatgtctttttctttctggcatagtttggaggtcttcattttatgatagaatacaaaacaccgagggctttaaggaggcatagtggtatgttcagctgtattttctcataatatagagtcataggaaacctgagccttggcatttgtaaggcaaaaagacccctggaaaagagtaatatagtaattcatctttatttgaaaagtatatcatcatccatttatttccccactggcataatccaggccgactttggctccccttcctgtgaaatgcaccctttccctctcatcagtttccacccctcctgctgaaaatggagtacaatgaatagatgtataataaaatcttttaattgtcttagcatatgttgcttttattaggtgggcataattgcattcatgggatcacctacaaagtcctttcgaatataaaattgaaatggcttcacactcagtgcacaagtccttctgaggcactgttttccccttcgctgcctccggttccccttttgctgtgaagttcacattgaagtgtgaaaagagagacgtggcaactgacacatgctggatcttatcagccgcgagtgccgttgtggccgactgaaaagcgactgtcatttctacaccatttattcctcgcctggcctcattgctcgcttcgtttcggaggaaattttccctgttaaagtactgtacttgtcatttatttcccttttttccactctccctccgtggctgggtttggatatgcatttatccaaaaggcaaggcttttacacacttccgctaacctcttatggtcaggctcataaaagcaacccaacaaagcttttatggggtcattacagatccctcaaatccctctccttccagctttcaataattctcttgtctctaatcaattcaccggctcttttatttgaaaatgggtgatggagtgggggaaaaaagtgggagcatcagctgaaaacccactttatttggactaaggtttctcaatgtgtgttcagttctggctcatgcttggcacttacatttgagccatattcagtagtcccagccttacttattcttttacaaaaagggtcagcagactttctgaaaagggacagatagtaaatattttaggctttgtggaccatagggcctgtgtcaaaagtactaaatgttaccattttccttactttgttcaggctgctataacagataccataaactaggtagcttataaataacagaaatgtaattcttaaagttctggagcctgggaagtccaagagcaaagcaacggcagattcagcttctgttgagggctcgttccctggctcatagatgatgacttcttgctgtgtcaacttagtgggaggggataaagcagctctctggggcttcttttagaaaggcacaaatccactcttgtgatctaatcacctttcaaaggccctatcttctaatattatcacattggagattccttttcaacgcttgaattttttgaggatgcaaaccttcagaccatagcactatcatagtgcaaaacaaccatggacaatacacaaatgaacaagtgactatttgctaatagttttatttacaaaaaacaaaaaacagtgggcaggatttgacccatgggctgcagtttgctgatccctgttttattaattagttaatattattgattgagatagggtctcactgtgtcacccaggctggagtgcagtggtgcggtcacagctcactacagcttcaacctcctgggatcaagcagtcttcttgccttagccacccgagtagctggatgacaggtgagcaccaccatgcctggctaattttctaaattttttgtagagacaaggtctcactgtgttgtccaggctggtctcaaactcctgagctcaagtgatcctcccgcctcgacctctcaaagtgctagaattacagttgagagccaccacacccagcctgattcctgttttacatattaaaaatttcatctctccaatcttcgaagaatccgtagtccatttttaagtagctcttgtcttccaaaggtatgggatgtgcctacctaatgctcttcctggatgggagaatattaccaaaaacgtttggtcgactaattttatgacagtttccaactacaatttttttcctctttgctttcttttgaataatagaaacaattttttttgtttaatatatcttgaagtacttcacttaagaaataacttcatggtggcacagagagctgtttagttagaagactgagtattatatttcccattgactatgcaggaccttctagggaaatgtgagtttatcatactcctgcaaggtaaatgcagcagtgagaagaatcagtctactgtgctaaacctggccctgcctcagcaatattctgtgagcctggaggtcaagagttaggggaccaaggtcctgctaaggacacatgggggaactaccagaaactcatcatctcatttaaactcacaaaacctggaagggacataattaaaagtcctgtcttccaaaagtgtagcattaaactcagagatgtaaaacaacgtgtctaaatgccaggtaagcaatgcttacttgacttggaccagggtggtgaatgaacataaaaaccgattacaacatttttccatttttatgtttcctctgaaaccagccatgagaggtactcttagcaaatcacgccttattcctaggcagacttcttgggtacactttccaccctccccagcagtaatgcctgaccaactaatggaatcctaactaatgcagtatgtgacgcctggcagctccagtccgaaccaagggaaaacctgcaaacatgcaatccttcatgcttttgtttttgtttttccttcagcctagctaaaatgaaggcaacattcagaatgatgttagaatctaggtgtggaaagcaatgtagcttctggctggttccttgagtgaccatgtggagcagagcttcccttccattgtatttgagccactggaaatctattacctgatctttctttaccagatccttctttagttgggtatggccaggctcagtgaatccagtagatgtttgaatgggaaaggactgaaagatctcaaccttgaatcccttaactccttgggatgtgtaatggagatgtataagctgtttttaaacatttcagcagctgtcatggaacttaaccaaatgagtctaagtaccctatgaacacatttgatttaggttggaattacagcatagatgtgaagtgacttgtccaaggacacacaggtgatgaagtttacatacaagacttaagtccatgttactggattcctagaccaggttttttttttccccttatcccatagaagatggttgttgtcttgaggtttccactgagttgctttttgagagattctattgtgcacttttgcccagttcaacaagaaagaatctttgctatgttagaagagactctggggaatccagagtcttggtcacgggtacatcaaaacgacgctggtgcctaacttctagttccagacaaagaaggagagagagagagatcagtaatttataggctgacattttccttgggtccttataatacttgtttattacagataatttgcttaagtgtgcacaaggtggaaggtcacgcaaggaagctttttattagttgtgtactgaatggatcaatagtgatttgaatactataaatctatccgttaacaggtttatttcttcatcagatattaattccagagggtttcacccattataaaatggacataaagcctggggtggtgatggtgctgcctctgtaaccaggctcagctgtgtgtcttcgtgagcctccttgtggaccctcaaatgtgggaaggagataggggcaggaggaattggggaaataggaaccttagaaaccctgaagaagtggaaagagaaaaggaaggtcagtcattcattcaattgcttaatttgcttctttctttttctcttcttctttctctctcttctctctctctttctccctccctccctccatttcttcattcctttcttgtctccctgtctatctgtctgtgtatatctattcatctatccatccatccatccattcatcaatccatttatccactctgaatagaaacctaatatagatatacaaaatgaaaaactaggaaaatgcaagaaaccttgacaaaattgctactgtttctaattccaatacttaataataaccactgctacatacaaggacatttgtgtctggtctttttccctattccaggcacatgcattttaatacagttgagatcatattgtatgtctgattttttagcgtattagattttttacattattaagttaatacatgctcatttaaataagtcaaacaatatgaatatataagaagaaaacgctcgtaatttatgctctacctcttccctttgctaagtggcaattttggaccttctgtgaccgtgcaaacatgcagattatacatgcactataggagtggaatgtatgtgacttaatagcgtaatattttgtccattattttaaaacttgctttatttggtcaagacatacggaacacgtatagatcaaacaaaaatttttaaaaatgcttgcatactgctctgtgctgtggagtagccctaattaaatcaatcattcctctgtttatgggcattccatttcttttcaattttgatattattgttgttttagcccttatgaatactacagcaatatatgttattatatactgctggttttaattttgtaggacagatgggatttctgagtcaaaggtcaggtgacataattttgtatcctgtggttttacttaacactatgcagaacgatttcctcgtattgttgaaaactcttggtaggggttttttttttaattggctggaagcacttcatcatatagttgtaccaaagtttgcttaacatcccccttattactcagcctttgggtggtatccagttctttgctttgataaataatgctgagatgaacatctttctgcatggctctttttccttcttttgacatacttggagttctagaagtggaattactgggtcggaggtcacaaatggagaggtcttttaaatctcagcctgcaaacaatcccactgcaggtttaggctgcatgtttcatccatttgcagctgtagcattttacaaaccacagcataaaccctaggaataattctgttccccactgggatagagcattgttattaatataattttacaaacatcattcgtttgaaagctttatccagcctcaccacagctcattagtgaaccttctgacaatcccggggcagtttgtggattctgcagcagacaggttatcgtgtgctgaagggtaccgcaggggaaccttccaacatccccaccctacccaaaggatgattcctgctcacaccagccagctggagacattagagcattacttctcggtggcaagggagggactcttgttctttctggtggttcgttttcatcttcaggtcatgccctgtgtcacctgactcaggcaccattagcatctggggctgtacacgtctttgtactgcacactgtagggtatccaggattcctggccctgccccatgatataccagcgccatgttgtcatcaaaacgaccggaaatgccttttgtgtctccctacttccctttttaacatgtcagcccttggtctcgatattcacatctatatttttccttatcccgttaatatatgttatctaaatatgtgccatctttgtttatgggcttttggtgtaagaactctctgagaatgcagtgattcttcactgggattggaagggatcagaaggagggaaagtaattagcggggcctgttataatggggttggtggggttatttgtgcttttaaagtagaatatcagggtgtttaaaagccaagattctggagtcagaaggcctgggttcaaatcctgacccctcctcttgcaagcttgtgacaccgggcaagttattaacctctttatgcctttattttactataaatatgggataattatagtttttactgcatagttttgttatgaggagtaaatgagtcactatttctgagacacttcgtgcctggcacagaacgagcactgtgtgtgtgttacagaaatatatgtgggtgggtgtgtttctgttttccgtaattccagctaggcaaagacatatttaacaaaagccttctgggctgatgagcatcctcagaaagtaggctgagggagctcttttaaggcagcaggactaagaaggtaaagacatgtactaggcgggtcagcatagtggtggccctcgtctgacacacatatttcaggaggggtcacccctgccgtcttccatgttggggtgctcttctctggcaacccactatgggtactccactgctggccttcatgcaggtggaaccacaccgggaagacccaagccgaggggagaaggcgtgagcagagcaggtggcaggcaccatgaggcagggctagccttgcccactgtctgtggctgaccagctagactcttttccttttcttgcaaacctaatgtaggtacaaggtcaaggctccctgtgaggcttgcatagcaccttcaaccttctagtctttgtcctcccagaaggaaaaaaatgagaggagggagggacacaagaaaagaagatgcattttgtcagccaccgtgctatgaaatgctagcgcagatgacgttcagaactgccctgtgagcagacataaaagcttaggctcaaagagattaaatgtcttatttctgcttttggaagatacacattttatttttttctgtgtctctgaattggcatccaaccataatcattgtgctaatttactgtattcttactctccctctccagtgctgtgagtaaatcagtgtgttccttatacttaataacatactaagtggcaataataattattataacaaatgtatcaaataactatgtgtgaactctgcatgtttcagcccatttaatacccattacctacggaggtggtttctactattgcacccactctacagatgagaaaatggaggcacaaaaagttaaatcatctgccctaggtcccagagctggaatttgaaccaaaggttctgtgcctcccaaatttgtattcttatctctgcatcacactaacactgtcactcagtccttttctcactgctctggtctctatacttagagcttcgagacctgccactcagatgactccagaagaaaacacgctttggtgtcgtgcttgcctttgcccttgtcactttctcaactctcctcacctctgtgactgcatctttataactctcctttattagtgcttttgctggaggaggcaagcatgaacattgtcaaaaggactcaaaatggggaaaagtggcagcaattgccagcacaatcactgaaaaatcttctgaatggattgtaaattaaaccctcccccaaatgctcagaactgttgaattgactaattcaaattcattgagtcagatgcagttagtgtaacagtctatagtaacagtgtagactattagtttgtagagtccacacagaagagtccaattttctttgcacaaagagcctaccattcatttattcaacaaatgcttttgaacacccatcactgtgacagacagtggcaatgcatgtaggaacaaagtgtgtccatgggggcagagacctggaataatcagtcaccatgtaaggaaattcaccagaccaccaatttccacgccttgtatgtttctgttgtctttgctgcagactgaccaaaagcacaagacaaactcttgtccacttggattttagcatctttccctgaccctgcctctgactctggtgttgtgcacccactctgcaactctccaagctccagccctgtagtgccagcctgtacctgcctctcctgagggtcaatatggcatccagccttggtgaagtctcccaccccgtggtgattcatatctgaccctgagaattttccacctttcccagaagagtgggagtctaggaagacaaatagccaagataggagtttgaagaggaggcaccaatggcaatttgggttgttaattcctccagctaatttagttctgatttccccatgctcttggcagtgagacagttggctccagaggaaggtgataaaaaggaatcagtcaaggaacaatcaagaacgtgttacttttttggataatcattggctgtagggattctcctttacattttaaagagggatgaggttgagtctgtccctagcactgacaatgaaacatttatgctgtttataaaaatcaggaaacacacaaataatttgattaacgctcaccttctggtccttttgtgatttgagaggtcttgagataagaaaaactgtggatgaattttactgaactattgaattgagaatggctgagggggagaggccccttccctctgtgaaatatagggaaaagttgtttttcttttctcctagtttcagaatacttggacttacagtcccaaatagcatcatttcctggtgaagccccctgaaccagacaggaaactgcctctcttcaataagagcagaggcagtctcaataaaaaacaaaatttcaacccatcctccgctttggtggcaggcagttcatcttctcacctctacttatttacagtttgaggggaaaaaagaggtaatacttgaaagtgtatttgaccatattttctaactgggagacaatttttttctttaacaattacttttggacatattacttgttagttaaaggagatgtgacacctcctgccccctggccagccaagatccatttgtcatccaggtagcctcagaacggattgagagctcgccgcacagatctcatgtcaaagacaggcgcgtctgtctttcacggcttgggttgtcaggatgcagggagggccttttgtcaaacacctgccgatgagcgtttggcagagcctgtgctaagacatcatagatttccttctgtgttgtcttgagagcagagaaggtggcaggttaaagggaatcaggaaagaaatgagagtgaggataaacgagagggtgtggttctcagggtagaatgcatcggacactgcctagtgtgagaagggactcatctgttttctaggaagtactataaaaaagataaatttagtgctcagatatctgaggcctgatattaggaaaaatacggtaaggcatacatttagaacagatgccatgtctgtgtgtgtgtgtgtgtgcatgcgtgtgtgtgtgtgtgtattattaatatgtctgctggccttgagaaggtacattcagagaattttctgaagtctttttcacatggcctgtattgtcaaaaaatgatgttgggtgttttctgcctgtggctgtgggcctctgtgttcacacagatggtcatatgttcctaaaggatacatccaggactgtgctgacttatttggggtggctgagaagagacatgagccagatgataacaggaataattcagtgtgtgcttcccatggctgctgtaacaaactgcacagcctagagggcttcaaacaacaggaatattatctcacagtcctagaagccagacgtctgagaccacagtgtggacagggccatgctccttctctagagaactctccttgctcctctcgcttccggtggttcagtggcaacgcttggtgtttcctggcttgcagctgcaactatctgacctctgcgtctgtcctcccacggccttctccctgtgtgtttctggatctcttctcctttgttatcaggacactggtcacattggattaagggcctaccctattccagtctgactgcatcttaactgtttaactctgtattccaatctaattacatgtctatttccaagtaacgtcacattctgaggcaatggcggttgggacttgaacatatattcttcgggacatgattcaacctataacaagtaatactagtaatcatctcactcctgtaaacagtacagttgccatacctcaagtatctagtatacttgggacattagtctgggaatttttctccaatcctcacgctagcatttctagtaatgaggaaactgggggtcagggaagcttagtccacatttctcaccttttctccttttctcccatcccccagccagtttttcaacatattggtttttcaccacatgctcactgcagtgaatgttcactcccaagcccaaaagtagacatgtggagtgacaggtgtcactatatcataatatgaagaatttcaaaagccagaagtgcttgagaaaatataaattgtgcagtaaaagaaaacaccctaaatgtgcagagcaggaagtagaatgactctttgggtattgtgtttgttaggggggtcattagaaaatcatagacactgagccgaaccccctgggttcaaatcccagctccaccacttacgaattgaatgactttgagaaagttacttaaatgctgcgtacttcattttcctcccctgtaaaacgggttaatatcagcacttatcacatagtttttgagaaagctaaacgtgcttatctatagtggttattattactagaaagaatatcgtggtgcccccaaacatggatttaacaagcattgatcaaatacctcctatgcccctacgaaccaggtactagaaatccactcctttcacttgcttttgttctgttgtgtttttgagacagagtatcgctctgtcacccaggctggagtgcagcggcgtgatctctgctgactgcattctccatttcccaggttcaagcgattctcctgcctcagcctcccaagtagctgggactacaggcccctccacaccgcacaccgccaccacgcccagctgatttttagtggagacagggtttcaccatgttggccaggctggtcttgaactcctgacctcaagtgatcggcctgcctcagcctcccacagtgatgggattacaggcatgcgccaccatgcctggctaatttttgtatttttagtagagatggggtttcactatgttggccaggctggtctcgaactcctgggctcaagcaatgcactggccttggcctcccacattgctgggattacaggcgtgagccaccatgcctggccccctttcacttgtattttttgagaagagaaagaaagaattatgaatgaattcttctgagctgtgagtccttcctgtgcaccaggcatggatggcaaggcacgattgataatgttccctcttatctcgaaatgtccactctctctcccatgcacggggagtcaagctgtgctcttcaaacacaaattccttctcccacttcctgggtagttatgctcttttcttccctgaggttgctaattgtgggcagtacagtgtagagtcactttgatttttctcatctccttcctggaatgtgccacagaagaaaacccacgaagtcttgagctaaacgaagcagagatgggagaagggacaaggtgggaggcggtagtggtgctgcatgggataaaaatggaaacacacacttttgccctctgtacccaaaaggaaatgtcggtggaggcaggcgttcaagctggcctcgtgtttgtggttttagacacagctttgagtcgtgaccggtgtggccaagacctatttcccttgcaaatgctctctctcttttttcggtaactgtgttactaaagttctcttagatactttacatttcctttcacggatttccaaaatttctttctttgagaatgtcaggaccagtaggaggttcagcacgcattgccagagaaatcacagatgactaattggaatgcctcagaatcattctccttttgtttcacctaatttccacacttacgaagtcaaactctcagttaaatgtttatctagcaattcatttcttctgagccatctgttgctaggcaggatctgcagacctcttggttgcatgtgctgggttgggtcctccaagtctcttagcacaaagtcctgatgtttaaatcctgcaagcgaattgccacctttatttccaagttctcctcgaaatccacattcttccctacagacaacggtggggttcagtgtttgcttttcctggggctgctcggttctctcaccttgcatttctgtggcgccaaggtaagctgaaggcattagtattcacacttgtgtgtgagcagctgagctaacatgcaccagagggaaaatattacttctcataaatgctcaataattatagtctttattgcatgcaaatctatattgtgacacatagtggaaagcttttggattctgtgtggaagagttgacagagatttgcaggtgaaaaagaaaagaaaaaaaatacagatacgtgtatatatagagaaagacaaaaacttgtctgctagaaacctagggagagagatggtattgcccctgggacattggactttctgtttccagcatggtctgtcgtcttccataatggcatttaattttggaaaaattgcctgagcatttggaacaggcatctattaggaaagcctatttcttttttttttctttttgttttttctgagacaggatctcactttgtcacccaggctggagtacagtgtcaccattgtggctcactgcagcctcgacttcccaggcttaggtgatcctcctgtctcagcctcccgagtagctgggactacaggcatgcaccaccactcccagctttgtgtgtgtgtgtgtgtgtgtgtgtgtgtgtgtgtgtgtgtgtgtgtgtgtgtgttttgtagagacagggtctcactgtgttggccaggccggtctcaaactcctagcttcaagcgatcctcctaccttggcctctcaaagtgctaggattacctgcatgagccactgtgcccagcctaggaaagcatatttttgaggaataattatttctagtaatttctgttctaatctaaggggtttgaggttatcttttgacaatagatgttagctaggagagataagaaatggagcaagggaggggtttcatcccgccgtgttcatttgcttggctgtcctgaaattgcgaatacacagttgttacctgctcccggtgggaggggggggatatttatttggcatcttgcaattgataggagctgagtgattttagtaggtagtttaactccttaaaaacttccagtggtttcatattctacctagttttaggtgacagctggtatggggtggggaaggggggggggataaagatattaatttggaagcatttgattgctccattattttatcatcttcccatggaaatgttttcataacgccttgttttttaattattattattattttttgagacagagtctcactgagtcgcccagggcggcggtgtgatctcggctcactgcaacctcagtctcccaggttaaagcaattcttctgcctcagcctcccgagtagctgggattttaggtgtgcaacaccacgcctggctaacttttgtatttttagtaaagacagggtttcaccgtgttggccaggctggtctcgaactcctgacctcaagtgatctgcctgcctcagcctctcacagtgctgggattacaggcgtgagccaccgtgcccggcctcatatccttttttatggaaaaaaaaaatcgggaattagcgtgtagctattaggcgtagattcctgcctaaggtctggatatgaattccaaagaccactggactttggaatattcgtaggtctctgaaaattcagacccacagaggccttaccccgctacagagaggccccaagagagaggcctcacaccctctggctccactgaaattcacttcacgtttccaacttggattaaactggcacgacagttcagtcaaatgtcaagtccattttgtcaagggagggaactcattcagaagatgaactagttggtgttacttagatgattaactacttggcattaggtagaagagggctctgccaactacagttcatggaccaaatcctgcctgctgtttgtttttgtaaataaagttttattggaacacagccaggtgcatttgtttacctattgtctatggctgcttttgcactacagtagcaaagttgagtacttataaatgtagagcctgcaaagtctaaaatatttactatctgcccttttgcaggtaaatttgaggactcttgagttagacagctaattagttggtgttacctaaattttgtgaattgtggctaaatctctcatttgtctacacattcaaataaaatcatgtatcaaaggtgatgtgtgtataataagatgctgggaagatgagcaaagcatgacttcttttttttgttgtttgtttgtttttaagagacggggtctcgctctgttgcagtgtcgcccaggctggagtgcagtggcacaaccttggctcagtgcagcctccgcctctcgggttcaagcgattcttctgcctcagcttcccgagtagctgggactacaggcacctgccaccacacctggctaattttttttgtattttagcagagacagggtttcaccgtgttgcccaggctggtctcgaactcctgagctcaggcaatctgcccgcctctgcctcccaaagtgctgggatcacaggcgtgagccagcgcgcccagcccatgacttctctttatgggagagaaaggccaccgagatagtaagtggacatcaggacatggattctattaaatctaacacctttatctttgcatttccatacattttgcttatttcaaagtagctacaactgcacaaagaatgggctgtcctctcctgctactttataaaagccaagtttttgcttctagctggtcgaaggtcctgtgggagctcacgtttttctcaattactgatgatcatttgagacataatttggagaaggtttctatcaaatcctagctggactgcagtgaaatgttttcaaactagagaagcaccaaataggccatgataaagaataaataccacctaccccaacctggcaaatgtgtgctcacccaaaagtagtggagcctcaagctcagggagatgtgactggaaaatccactgaataaatgtctatttaaaaaaatcatagcgtctaggggatatacacttctaagcccattcttcaatggagaattacttatgcgcataagtagtttaaacaaaattagtggaaaaacagggagtttaagggagcaagagatcaggtcttctgggctcaccacacatcaggtgatttaagctaaaaatggcttaaaataccgcaatcacttgaaacgccttacataaactgaccaggaatctggggcattcgcgttagagacaattttcttctcctcaagataagggatggggaattagtcatagggtatttccagataatgtagttaacacctcgtgtaatattaggtgggcagggagctctgctctcaggaccaaaattgctcctgccagctctaatagggaatgtgtgtatttttaaagtctgggtaagcactgtgagtcatttccacaatacgcctccctttggcgtgaaatggggcagaaagtgccccaaacagctgttattttcgcagtgattcattcattcattcattcattcattcattcattcatccacccatccattcattcattcactcatcacatggcaactcatcacccctgtataccagacccagtgccaaatactggggagatgtgtgtgaacaaaatctcattttcaaggagcttattgcctgctgcacattttagcctcatctcgttagtgcaagaaataatttaacaactgaaaaagatgtgaggttgtacctggtaaggtctctattggtcaaggaaaggtttagcatggagagatttctcttaaggtgcctaggtattcagaagcacccctaaaactgatttgtgtggccctatgcttacaagtggagcctttccctcatttttgctttatttcttttgcctctcactttttatttcctttgtggagtccagcccctttgcttattctcagcacaaaagaggcagtagagtgagaagaacgtgaacttcagagcccacccatcccgtttcacatttgaatcgcaactctgtcattcaccagctgtgcatccttgggaaagtcacttagcctctctgagctctaatttcctcacagggccgcaggactgaggttaaggacctgctgtcactggtacagtggttgaagaaaaggtgaatgaaggaagggcctcgttttactccttgtctcacattcctttctgctacttctctttggctcaccaaaaggagacagaagtttgtgtccatggctgtgaactgccaaagagttgccaattctctacgatctttgacctctgtgatcccaggggcaaggccagcactttccattccattagacttcattctcttgtgggtgctttctgctggaatctcccaatacagaacagaaagcacaggttatggaatcagatagaccaaagttcatctccaaatttgattccctctgcatacaagttgcttacccttgggggccctgtaaaatgaccataatagtaagcacctctgaggctcactggaagaactctttgttgtctgcacagaagatctcagcactaagcctggaacagaggagacttcagtcgatgtagggcatctccccaaactgcttttattctttatgcctcactgaaacttgaatcaaaaagcggctggaggaaaaagagctttgccaccgggcagtactgctgggtcttgcgtcacagagatgccttctgctcccttcttcagggagacctcagagtatgaaagtgctgcttacccagcagatgagatttagtccagtcatccatctgcgtggtctctgtggataaagtaagcgtttcattcaacttttaaaaatattgcaaattgaccctcgcacatcttttcttactgccggtcacctagccagcaaagaccccaggtgagatcccactggtttggaggaaggagaggaaagtccccacttgggcaaaaacaatttaggatacctgaagattgcaaagcccagctcctcacaaagggggtggcagctggggagaagctgaatcagtagacagacaagattgtggtttaacgagttcagggacaagagaaggccccagtaacctacagaagcaactagctccttgccttctgtacaacatggcctttggagtcacaggacgtgagtttggatcccagctctgccacttagtaattgtgtagatttgcacatgttgctggacctctctttgtctcagttttctgtaaactggggaaaatcttagtaaatctagctaacgtggttgttatgaagattctgtgtgtgtgtgtctgtgtgtgtgtatgtgtacaaagaaagtttagagcagcgtgtggcacgtaatgcatattatgtaagtgtagctccaatgtgagttgttacttgtagagaacagctatgtcaaaaccacaccaaaaacgatttggaaaggaaataatttgactggtcattttgtttatccatcaactgagttggattgatatatttttcctttggccttcaaaggaaatttgagcattcattcattcatccttttagagaaatattctctaagcacctaccgtgcgccaagctttgggttggatacctggaacccctctcagtgagatcacagtctaacagcacacacccaactatgaaatatagatggactgtgaagatgaagaaaggttctggttatgaactcacagaggaagtgacggctgaactttgtaaggacacaagtggtttaacaagtttcctggcccatatgagatctcggctccgacgttacaggcagcagtgtggggcctcaccttaccttttcccacttccatccttctccacccccgttcagttcccaggctccccttgtgtgaactggctcatttctcactgcctttctgttctacagcccccgctctgctgagtcaggaggtgctactttctccatctgctttccatcgtccaaaatttttgttgatgtttcttgatcactgagttaaataatttttccccgtattatacattcagtagagtttctggagagagtgcatacaaaaacgcctaactgaatctaccacgtctaagcagatgctcccagagtctatgcttttttcccccatgccatactccccaaactaaaggatgagaaagaaccatgcaggcagaatgagatgagtagatgctactgctaatgctgtcagttctactactaccgccactgctgtcttctgctgagtatggattatatgcctgttccatatgagaacattatgcatatggtgtgatttggtcattccggatggctaaagtgtgagcatacccgtatctcagatttacagaggagaaaacagaggctcagactggttatgtatatttctctaagtcccccagctattgtttgttgtaggttgggtaccccaggaagtagattctgcaactgagattggcatgtaggaagattactggggagtgttctaggatccacacctgtaggggaacgtagcaagcaggatggggtggagggaggattgagctgtgctgtgggagatgcgaatgctccagtcaatcccaaggaaactctgaagctggattattcttcagagatgcaaggaggtcaggaagtcattgatgtgggctccctcctggagtgcgtgttgctttggtagggagctcgctttggctgtgggcagttcctgaggagggactcataggacagcctagcatctgaggaaatgagtgcctcctggcccagaatgggggatctcagcagcacactacaatatccactacagtttcttgggcttgctctgaagccatgcctctctaacttcagggtatattcatgtaagtgaggtgcagggatgggggaaagggagaaggtaaagctacaaaggtaagccagcttgtctagaccgggagctagctccttgtgaaggaatggcaatgataatggttaagtcagattcaagaagtgtgttttggggaaacactccaggtagtggtacatagaatcctagcacaagatcagtgactgggtgagtttgacattgtagatgcaaatgtgtgaggaattatagttgaaaggggaaagaacatttcagtttttcatttcctgcgtcactgtttttcttatttggagatgctgttcctctcaagtgggaaaaatttggttatctcaggtggtaaagatgcctttgtttaaaatattcttctgttagtggggacaataatactactaatttctagtactgacgcttctcatgcaatttaatcagtaggaacctgtttgcatgttcatttgaggaagtaccaaagccaaaagtagcttcgaggtttggcacctctgataaagttacagaagtgcagtgtgagcaaaaatcatcctcttctctgttcttcacctgttggtgaacagtgagagaccaaggtgagagactcggaaattacacatgtacattgtatattacatgtatacaacatacattgtgtattacacatatacaaattacttgtcataacgtgcagatttcacaatgagagaccaagttgaaaaatgcttaaaattcacaagtctatatcattctgtcctccaggtaccccaagctggtttgggtttataccagtttgaaccgagggaccttcagctgaggaacatgtgctctgtgtgctggaagctcctggaggccccagggttatctctgctcacttaggtttgtgatgttgggcaaaaggagaaaatgctgagtctattcggacccaacttccattaatgcctgagaaataatttaaatcgcaagatttccaatcccataagcagccctagcctctcttctcctgatactccacatacccagtctccattccttcttcccccaccctccagttctcatcctgtacactacctccagacccccagggattcagatcctgtctcccccaatgagagacttttttttttagggggagccaaattatttgttacaacatgtagatttcacttgttgtagagatgttctattttcaaggatacagagctcaaagggagcacaattccctggagagctagggaaataatgaagtctaaggtctggcagatctggatctgaatcctggcaatgcatttcgggagttcggtgtcaccctgagcatctttcaattccttgaacttcagtctcctcatctctgaaatggggttattatctacctgcagaggtgctgcagtattaactgaggcaacgttgcaacgtttctagaatgatatttagggctcatattgacccagtaggaagtatagttaccttgggccaggggagctacctgagtggagtcaacttttaggttatagggaccaagttgaaacatgcttaaaattcacaagtctgtaccattctgtccttcaggtaccctaagctggtttgggtttatacattcccacagtgcctaccacatcccaatggctttatgaccttgaggtcctgatctgttttatcatagctcttgatcttcctcaaaaattcttacagctgtattccacaggtcatcaccaagggactgctagaactggatcatagcagcttccaagagctgagtgtgtacatttcctcccaactctgcattcagtttaaattgcttgtggtgagagtattcataccatgggaattggcagacactgtgaatcaaacccaccccctgcactgcccccctccagtgagcgagttcttgaacacttactggtacaccactgtcaccaaccctgctttttgtagacatgtcctttaagcaaagcaattcatgggaaagtaaatttaattatcagaccatttcattagattcctcactgccacaaacaggtggttgtggtgataatctgggcttttttgatcgctttagaaaggcagttctgtaatgacatgaaaaacatattgcttggtaatttatttatttgttcccaatgtttgctacggattgtggtgaaaacacaaacacccaggacaaagggcaaggttcatcccaccatgacgatgggaggcagtttcatcccaccatgatgatgggaagtccttatatcaggactccagggatcttgtgtcctgatataaggctctcactttccaatcagcaggaagttatgcttcccagcctctaggaaagcataggagttaaggagaactgaaatctggggcagttataaatcttcccttatgtgtacaacagtttaaatcaattggtcatctaccaaaatctgaggaacaagagcagctttagaaaatgggctgggcatggtggctcatgcctataatcccagcacttggggaggccaagacaggtggatcacctgaggacaggagttggagaccagcctggccaacatggtgaaaccccgtctctactaaaaaaaaaaacaaaaaccacaaaaattagctgggcatggtggcatgtgcctgcaatcccagctactcgggaggctgaggcaggagaatcgcttgaacctgggaggcggaggttgatgtaagccgagattgcgccactgtactccagcctgagtgagagacagactgtctcaaaaaaagagaaaagtaaagaaaagaaaagagtaagattaaaaacaagtaaagaaaataaatcctcccgctttttttgctccttcatgggtatggctgcatcctctgctcactggtttgagttattattttcccatgggcaattaaagccctggcctccactgcagttttcacatcaaacctaagagtctcaggtgccccttggtggagcaacctaactagagacattaatcatactacgggataattgacaaatgcattgtgagtgtctgatttctgtggctcaggatgcttagtagcagtggggtcaagggcacagatgacacaggtccaaatttccccacccctacgtagtagctgtgtgacctggggcaggttgcttaacttttctggacttttgattccacattggttagatggaaataccatattattataaatattgtaaatagtacccatcaaacacttaatgtgaaccagaaaccctcataaaatgtttgctagtctttgttgttgaaaggtcactatgatgatggctcaaaatcctgacctgaaggtgtgctatgttcctgcttcacttgtgctgtggacatgttcctatttatcatagtgcagttgttgagactgggtgtctagagccatgtgatttggttcagctcctaactctgtcacttgctctttgacctaggcagaaaactttgcctctttgggcttcagtccccggtgtttttattttattttatttttcaagatggagtctcattctgtcacccaagctggagtgcagtggtgcaatcttggctcactgcaacctctgcctcctggcttcaagccatcctcccgcctcagcctcccaagtaagtgggactacaggtgtgcgccaccacgcctggctaatttttgtatttttagtagagatgaggtttcaccatgttggccaggctggtctcgaactcctgacctcaagtgatccacctgccttggcctcccaaagtgttgagatcacaggtgtgagccatggtgccaggcctctcctgtctttaactggggataatgtgtgcagaattccccctaaaggatctatcatgcgtaaggtggaccctcacagaaagcgtcaaagacacacgaatctcttagcaggaggccgccaggtggcacaaaatcaaaactgcatcattgagaattatgttatgaagtcatttactgacttgagcctcagttttcctattaatacaatgagactgtagtaacttcatagggctcttgcaagagttcagctaaaattctccaccttgccacctagaacatgtcacagaaggtatcctggcccctgtatgggattcatacatgaagaggactgccttgtaaagtcatttgattagggatccagagggtgtactggtagaggacagattttcaaccccttgacagttcgaaggtcagctacacaactggcttgtgttcctcgctgacacctccctgagtagcaatgtgcatttgtgtgccttccctttgccaggcatttctaagaggatgaatcctaacaggtatggcagccagagggcaggggcagggagaagaataagatgttccttggtgtaccccattgtcatgagttcatcatttctgttaactgtgggggcagagagttccaattgcaactggcttgttgtgagactgccccggtggttgctgccagatgatccacaaatgccaagctcctcacctgagccctgccagccttcaggacctcctttgcacgaagagcaatttgcagaagagaacactgcaggggaggcaccatagaccccttctggtctgtactgttcaaaatcacatgacatccgccagaggcctggtgggaagccagggttttaggcactagaaatggagctcagaaaggaggagaaaggtccctgctggtctgtggagagggccttggccaccagagggatcaaatggcccaggcaggaaataagtatcccgctctcagatctgaggccagattttcaagtgtatgcatgattctggggtgctacaaagggtatagagtatggagttagaacattacacgtcaacaagaatatgggttttgaacccagacctcagtttgaatctgagttccagcactgccccgttgcttggccgtgagttacttcacctcctttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattgagcctcacactccctggacaaagacatgaaaaactctggatgatttggaagggagatctagaaatggtgaaaggactggcaagtgcctctgtgctgatattgtacctgggctcagtggtctggctaaaggagaggtgctggggccaggtgacaggcgagtctctatacggcaggcccaaaaaatggaggtgcaggcttcatctatactttgatgtgtatgcttccttctttaaacttgtgataatcagagttatagctgctttaaacttgtaaaaatcagagttatagctgcttttgaactagtacttgttgtgtgcccaggaaatggccaaatgttatcactcatccttccaagaaacacatgaaggttatattattatgtcgactttccagatgaggagactgaggctcagtggcttgtcataggtgtcaaagacaggagtccaatgtaaggacttctggcttcagcacaggggattttcctaccatcccatattgccaccccatctgcaaaaatacctggatctatcttcctcctgctgattctcagctccctccaggactgaagagatgatattgattctcacttgatagaggttagaaagggcctctcccttccctagctgaatagagagggtttcctttttcttttctttttttttttttttttttaaatgggaaacttacagggaataagatctgtttcttcatttgctttgcaagagagttggatttgtacacgatgcctgagctggctcggttttctaaagacctaactttgcagcattcttcaagggctccagagagtcccttgtgccatcaaattaagtttggaaacttcaataaaaaagtcccgaaggaaactgtcaattaatgcatttacactgaagcatcatatttgggaaaaacatcttcaaacgcaaacgctgttttccaaccattaaaaagtttatgcgctgcttggtttccatggatacctgaggtaatagcctccttcctctcattgaagagtgaatgttgctcagttacttttttcctgttttttttcacttttgtcttcctgacttttttcttccatccctatttatgaaaacaaaaagataactaaattgaaacctgacaatgtaatttgtcagaggaaggcagcctgttttataagctcaggtgatttcatttttgttcacctgtttatttcatgacacttgcaggaaaaagaagaattttcatttgatcaaatcatttccatgatccatcaaacacacaagttaaaaagggaaatgctctcagtctttaataacagtcttaatcgtgtgtagagcagagattgacaaactatggcctgccggctaaatctggcccagtgcctttttttttataaataaagttttattggaatacagacacgttcatttgggtagacgttgtcgatggccgctttcacaacaatagcagagttgagtgatcgtgccagacattatatgggccacagagcctaaattacttaatctctggccctttgcagaagtagtttactgacctattatatacaggaaagaatgagggcttgggtggcacttagtagtgttgtcacttttgtcattggccttgacctgactcagtctccgtattgttgagatgggaatgacgggaccctcagtagtgttttgggatataaggcacacggtaaaggaacaacaaataggaattacattccgtcgagattcttttgctagaaagatccaaagaaacctaccttgtgattctagatgttttttaggaaacccaaagaaagtatgaaaaagcccaagccaagtccttccactgttgttcccgggcctgtgtgtgctgtgtgtctttcctgggagaaggtcagagctggagtggggcactcgattccggcaagagaaggcaaacaaaagaagccacaacagtctaggaagaaatctttaatttctattcagctttaaagagtttgagagagttttttcccctctgttaacaaacgagttcaagtacatgccttcatattataaaagtacctgaaattgcctagaatagcagcatgcatagcttgttagtatttacatatatttacatagggaaacaagagaaagatctacagttatttacagtctacataggggaagagaaaggcagcctaattgtatttcctaaaatacagtagatgagtagtcagcacatgcatatttagataatatttgcatgatagaatgcaaactttaaaaaagacatacctttgtaactttctatgctaaggtgttgcataatcaaggttaatttttgtttgtttctagtctattggcatcaagtgctttaaaatgctcactaacaccgaggcagaattatttacccgggcaattaaagcaacagcacacacgatcatttcctactaactagcaacacgctgctggtgaatgaaatatctattgtttctcattacccatcgaccactgtgaagagatctctctgtgtaaaggcagtgcctaagctatcaccattaattatggaagtaatataaatgagacactctccacagtatgttctaaatgaaatattaacaaggccagcgtcttggaacctgagaaatggtctgttccagtgagctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgtttttttttttttttttcttcagtgctttttcaggactatgttatagaatacttatggggcatacgtgtaaatgaactgtcaaccttaaaatctaaacaaacagcttgtttgtggttcgtcctgaaatcctccctgctcacaaaacagccagctacttggttttctaaaagacgtaattttgcaggcagacttcgtagagccattctgtgcagaagaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtacacgagctagctataaccataacagaggttaaagaagtagagtaaaaatgtaaaatgtttcaaataaacacacactaaatatcttcttttatatcttataaacacccagcagtcctttagcacgggcatcaaggtggcccagttggaaaatttcagtgacatgccatcagatttgttccatgtagaaggacgacactatcagttagatgcttattttgttggcaaatttctatggcacttctgcttggctatttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgttaggagtaccctcaccctaaccccagcaaagcatgtctagggtctcacaataatagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgagagcgtaccaaggtcaccctgcccttcaatcctgctgatagcccaagttaacatcctcccatgccttggccttcccagaacaaacatggctttggacgcctttgggtggttgggactggctgcctatttttctctaaaacttaagttttaggaaagaattctttccagctttccatcctgaacctgctggtctccaggctcgttcctgcaaatatttcacagaggagtaagagccacattcttgctggctttccaattcattctcctctcttcgagtccacctcttaaaacttcttagtgctcttgcaagaaactcatgtcttttgtcagggagaatggcatggcctttgtatgacacttccttctagccagactcggatttgggggcatcatatttgggatggctgcaccgtaaacaggaaaggccacaggacagctcacaggttctctctgaacagaagcctgtgagcacgtgcctgtcatttaaaagctgcatggcactcttccccctgcatgcgtttctctcaaggtgtcccttgtaatttgtggttgtggtctgtgcttgaacctgttgcatttatggtgatggactggcactttactctctctgagccacggccatcaagcccctgtcatagacactgtccctagtgtcacctggggaatgacactcttcacctgtcatgggagaggcaactgaaaaggagcctgaggtttttctacctttgtgaacctgttgctagcaaagaaatatttttccttgtggcaaaagatcaacatctaaacacattgtccacgtctaatttgttagggagggcatgttctcttctggagggctaagagttggcatgggatctaaatggattctccagaacactttctcacacttctaaagcctgaaaacaaatatttgctttcctgatcatcttcattgtttctttttgggaaattgagtgcattcctcttctataataaaggttaagaatagcctgtgagttagcaaaactcccaaaggtttatgaagaaagttacatttcaatacctacaggaagtatttgcatgtgtctaaggctggattgttgaaggcctttgtgggagtcagttgtcaggaatttgtaggaatgactgtgttaggaatcattggaggagagggagtcagagggatggatcagtattttctctgcaaacctgatgaaacactccagagcccgcacctacatgcgtgggaactgataagatgggggttgtgtccacttcacttgtatgggatgtcggtgctttgaaaaaattctatcatcaaagagtaggtttcttagttctgcaaatctggcacctggagatggcattttgaatcggacgacctttttagtaagggtcacttgctgttggatcatcgaagggggtgctgagtcttcatttttgttcatccaaatggatatcatttcaatttagctccatgagtaaatcaatggaaaaaaaaatctccttttaacatttctcgggtgaacacacgacagcccccacatttcattttaggccatgttagggcatcacctcatggccagacatggcctggctgagaaggcggcagagcaggcagagaggcataggaagccggagccccgtggaagacatagatgaggaaatgggccacgtgcaaatatttgtgtcacatatttggggagcaggtttcatgtaccaacggacacggagtctgaagtcactcactctacgtaattatctgtatggctttggacgagttgcttttgatctctgatatcaggtaggcttctctctaaataaatggaaatactaactgtccctggctcatagagctctgtgagggttaggcaacaatgcttacaaagctctccatgcagagcctggcaaatcgtaacctctcaataaatgctagtcattgatgtcacttgaatagtactcgttggctacaactcactgaaaaagccgggcagtttgcagggctgaggactttggagtagacatctctgttctcgtctgctgcttcccatcattttggtggaagttggtgtgttcgttggttagcacttattccaaattgaattgtataatttcattatagaagtatcacggtggaagaagagggtgacttactggtgtggtcacctagccagggaggcctatgagcctcattcctgtataggctgcattactttatgaacaaatgcaatttgtggcaaatgtgtcccctaaaagattgctcttggatagtgagtagggaacaagtggccttttggagcagtttgctttcatttgtgtttccaatgagagattgaagctgtaattgtttgtgaggaatggctgtatcccaagcaccgaggtatctggagatgacctctgcactgttctgggagagtggttatagcctctcctgggggagtgttactgggagacagggaaagacagggcgtgtagacggccatctattccacctgtgacatgagggctcaccccctcatctccaccgcagcagctctctgataaatgtagctctctgataaatgattctgttcctagtggtgtattcacagagtcaatggataaggtggctggctttgcatttgagaagtatttgctttgtccaacagacaccagatgagtaacaatggaagtaggcagggtttgaagaggtatgtgtctttccttttagccaaacctgctcacttcagatcaccactttgtcctgggacgttagtcatgggaacactgccgtcttcaaaagggctgttctccttccctgctcttggtgttccaagcctaatctaacttccagggttcattcctttcataactctactttttgcataagtggattaattcagcatttgctgtgcaatgtccctgtaagaaagcaatcttagaacatctactctctcacaatcattgaatatatagatatgccatgatattgtgtctattttttatatatctcatagttaagtctactttaagacaggaatctcctctttcttttaaatgagcatgcattttaaaatagaaaaacctgaaagcaaaacacggtgtaacatgtgtccctgtgagtattatattagagtactaaccaatgcattacaaatatcaatatgtgggtgctttttttttctttaccatatattgtttatcagaaacctctgtaccctttcctttaaaggagtcaatatgcatttgtattctgtgctgacaactataaattgatggctagcagttatcaaatgaatgttgatgaaaagcagctacttaacattttcatcccaacaccgagttttggaaggatggataatttagatctgagggcctcaactataaataaacagcaactgctttctaaatcccacctttctgtagttgaagattgtgctgcaaatctgacagatgatttttgaaagagaatgatgaatccttattaccaagatactcttaatcccaaacaagagtcctgggtaattttacatatactctcaagattgattgcacagttctcctctggcagctcacaaatgtttgactagatcggaaatggcattcgggcatgattaaaaagattcttctgggcttcccagaaattctcagtcctgtgtcgtcaacaacctaactcattgccattgctgcgggatagacacctcccccgtttcccatgattagcaaccatatacaacctacaggcttctgataaatgattgattctcaaaaaaaaaaaatcgtttaggggaacccatagctccagccagtgtttgtatgtcaaggtattattatttatcacaatggatcagtaagcattgatgacaactggcaaggtattgcttcagatattttataacggagttgttaacattatttcctttagatggctctttcatcttttctgcattatgaactgatgccccaaaaggtggtatgaatgaaagtcatctgatggtgattaaagtgctctttaaattttttttttaatcagtttaagaatgctttctcttttattggcagtacctgcttgtttactattgagatttcactaatgtgcctcagtcttattctgatgatatgtaggccgaaaagctggtgagccaaaaatgagaacctgttactaaactgtcatcacatctgatcatattaagatgtcactcagaggttgccattggtacggctgaaaattctccaagagaccaaaggtgtggtgtgtatgggaccaacaagatattgttactgcttaattgtccagcaagggaggaaagtagagtgagtacccatgagcaccaagcatgaatctgagaaggagaatttgccaaaggtggacgattgatttttggagtagagaaggtcgtctttgctttcgggtgcccctcctgtgtactgtgttctacaaagccagagccacttgtgatggaatttagatggtaaatcaccccaagcctagtggcaaaggaatcaaagccatctcctgataaaaagttaggcttttcaaaaaggtatggctctcagcattgtagccaaatgtaggttggcatgaaatgaagccagttgtaattgcctttagattccgtggaaggaaaaggtaggtccccagctcctgcaacaatggcattctgaatcaatgggactgcagaatttcttagcaaaaataccattccagtaatgcaagagtgcaacgtggtatcattacagtaggtcatagtggcaaaatattttatcaggttaggaagaattctgctttttgctttcccaaacggactgctttggtctttcctcacgcttggcagaacagtgaaaggccagtctgtcatgacgtttgaatgctgaatagtataaccattgtggcatagagggcgggaggctggacttgaaatgggtgagctggattctcccaccactcgggagttaatggcaagtcacttggccactctggtcgttttggcagctgcaaggtaaaatgaaaatatatgacagatatctggaagttgatacaaaacaccatctccaccagaactctaagattccaggccaaaataatacttggcttgagttagctggatgagcatctcaattctccaatttgtctttagaggcacttctgcttcccttttccccacatgggatgcagaagagccagataaaccccttgaagttgtttagataaatgtgccaggtgctaagctcagggttattaggaataataattcagtgaaaggaaatttggatgacatgaactcatttccattagacttgagccacacaaatcaatgggaaaagaaacagctgaatccaggataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcactcacggtccacaccccgcccagagtcgtatcacttgactgcatttgaccattcagttttcagaccaactccattgttactagatatcctgacactgaagaagctaaaaccaaacaacaatgacaacaacaaacccaagtctgccttatggcagattcttcacgtcgtaacaccttccttgggaccctatttctcagtatggacctgactctcccagggatcctagaatgcaagcatagtgattgcaaaccagaccatttgagggaaactcctccagtaagcaccctgcatggtcacaatgtaaaccctgcaggggcagaaaaatgataagctttgggtcgggtcggaaagccatttcccccacaatcaaagttccttagtgttttccttgtgggggcgagcttatcttcagttaccttttccggtcctctcttgcaacccctctccctctcatcagctgaaaattagtggatgcagctagggctctgaaacacataaataatcataagatgccagataaactgtattggttttaaattagagacgtgccgaccatgtctccctctgaacagcagcctattatttttaattatggcttgcaaagcaaagtgatttcttgccctctttatagcatccctgacagtattctgtcagtttggatgatatgatgcctcatcactgcacacgtccctagccacagccgcaactgttactcaaaaggtgaatgaaagtgatcagctgcactctttgcaacttacattttgaagtgggctgggaggaaatgtacccccttacctgtggtcccattgtaaatctgggtcaaatatgacatttagaaaaaggttttcatgggatctggatgaattaatgtgttatgtgtttgtgctaagtatgaatgtatggtgaggagtgtgtgtgtgtgtgtgtgtgtgcattaaatgttttaacacaacattgccaacccttcccctagcagcaccgtgggcaaagcataaagggatgatctggcagcagccccacttgggttttctacctgatggaccacaattaagagtggttggtttgtcagacagaaggttctacaaacgatttggtatcgaattacattatacatggagaagttgaggggttggatgaatttgttcttgcacgttcagaaggataccatctttttctctgtgtggaagaggcgcctgccacgacgtattgatatgtgtatttattttccaagcctgtccctgtatgaggtgtcaaaagttacaccagctttacaagcggagtttatgaactcgtttttccaggatagtcacattatactttttacagtcatgtgctttcagcccagtaccctttgctatgccaagatccagctgaaactgaaccaggtgggggaggcctgctaatgcccaggcagtcgaaatgacgccatctcatcactccttttcttaaaatttttttttgtctttcttcttggatttccagcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctgaggtcccctcgtcccatccagctaccaccacggccaccactgcagccgggggctggccttctcctacttagggaagaaaaagcaagtgttcactgctccttgctgcattgatccaggagataattgtttcattcatcctgaccaagactgagccagcttagcaactgctggggagacaaatctcagaaccttgtcccagccagtgaggatgacagtgacacccagagggagtagaatacgcagaactaccaggtggcaaagtacttgtcatagactcctttgctaatgctatgcaaaaaattctttagagattataacaaatttttcaaatcattccttagataccttgaaaggcaggaagggaagcgtatatacttaagaatacacaggatattttggggggcagagaataaaacgttagttaatccctttgtctgtcaatcacagtctcagttctcttgctttcacattgtacttaaacctcctgctgtgcctcgcatcctatgcttaataaaagaacatgcttgaatatca

SEQ ID NO: 1108 - DNA, 179043 bp, Homo sapiens
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggtccagcgggggtcacctggtggcttcccggcgcgccctctgctgttcaggatgcagcactgcgcggcgcggcgagggcaaagcggcctcatccccgccaaaaaataaagatgttttaaaaagcgcacatgctcagctccctcctgcaggctctgggttgcagggataggagttttgttgtgttttgttttgttttgtccagaccggtattgctcagtcatccaggctggagtgcaggggtgccatcatagcccactgtagcctctacctactgggttcagacaatcctctcatctcagcctcttgagtggctgggactacaagcgtgcactactatgcccgactaattttttaagtatttgtagagactagggtcgcaccatgttgcccaggctggtctcgaactactgggctcaagcaggccacctgcctcagcctccagaattgagattacaggcgtgagccactgcgcctagccaggagtattttttagtagcagtcctagatagcttcactatcatttcctgggaaagttttggaaaccccagcagagccttcatctttaactgtgtgaccttgggccattgaaataacgtttaatcttggttttttcacctgtaaaatgggttgatacgagggtcagttcaggcactgtgcgtaaagcacatagcaccgtgtctagtaggtactctctgttccttaactgtcgttccttgattgctcttaagatacgacagtgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttcttttttttttttcttttgagacggagtcttgctctgtcgcccaggctggagtgcagcggcgcgatctcggctcactgcagcctccgcctcccgggttcacgccattctcctgcctcagcctcccgagtagctgggactacaggcgcccgccaccacgcccggctaagtttttgtgtttttagtagagacggggtttcaccgtgttagccaggatggtctcgatctcctgacctcgtgatcctcccgcctcggcctctcaaagtgctgggattacaggcgtgagctaccgctcccggcctttttttttttttttttaaagacagggtctcgctccgtcgcccaaactggagtgccgtggtgcgatctcggttcactgcaacctctgcatgccgagttcaagcgattctcgtgtctcagcctcccgaatagctgggattacaggcgcccgccaccaggcctggctaatttcgcgctgttggcccggctggtctccaactcctggcctcaagtgatccgcccacctcggccccccaaagtgttggcattacagacaggagccactgcgtcagcccagaatttctgatttaattggtttggcccctcccctctcccttggtaggttgtaaaatcttccctcccaggtgattctaatctatgcaaggatgtgaaccactgctgcctttggtggcaaggtagaggaaaaacaaccaagttctgatgagttcattcaagacacacacaggtattatgtgacaggcctttggctggcactggttataccgaggcaaataagagccagttgtcatccttaggacccaatcttattagggcacagtgacatgtgtaggagcgtccccacgcagtgtgtataccaggaagtagtgtgtctggcatgaggtgtgtgtaggtagttgggggggtcgtgagggaatatggtggcaccctcacagtaaccttcacttcctgggctcaagcgatcctcccgcatcagcctgttgagtacccgggaccacaggtgtgtgcctccacacccagctaattattacatgttttgtagaaatggggtctcaccatgttgcccaggctggtttgaactcctgaactcaagccagcctccctcccgaagcactggaatcacaggcctgaggcactgtgccaagcccagagcggtgttttgagctcaagtagaggtgggtggggcaggagggcagtctaggtagagggaacagtgagaggagagaccccctgcatggcctgtccaggggcctgtgatctttgtgagggtccaggaatgtgaaggttaaggcagggaagggaggacccatttcaaggatttctgtgccttgccgagaagcttgggctctgttggcagagccagagagtggcattcattcagcttgtgaattctggaagaatttctggctctggagaattaaagggacatttccagcagcagagctccagtagcctttgcagggacggaggcaagctcctgagcgggcacttgctgttcctctcacctgtacatctgttggggaaaggctccttctcatccttcagagctgagcttacatgtcactgcccaagagaccttcttaactgtgggtgtcccctcgaccttgtactagtcaccttgtttctctgcttcttcgtgcttagccttggctgtgtactcctccttgttggccctgtctcccttgcccaggttgcagatgtcatggggcagcttgttcatctgagtgtccccagtgcttggcacccagaagccataagatgagcccctgtgggatgagtaaatgaatcaccttgggagggtcagccgcaggcttctgtgggtgggtgggtggtgcactgggccccagagtacaaagatgcacatgacccgcttccggcttcctaagcccacctctgcctctggctctgtggggcgtctcctcctttgccactcagccccagaggtgcttctgcttccctgcaggcttgccctggagcctggcgctagggccctggggctcccttgctcctgcgtgccccctgcgcctgccttcctgctgcctggcctttctcccatctgctttcttcctgagtggcccctggccaggggactcgggtgcatacatggtttccaaacgcctttcctccagccctcccgactagtgtcttaaatctcaagctggcctctctggctccgctgttttttttttttttttttttttaatttaatttaactttaaattccgggatacatgtgcaggatgtgcaggtttgttacataagtaaacctgtgccatggtgacttgctgcacttgtcaacccatcacctagttgttcagccccccgtgcattagctatttattgtatacaccagctgagatgccagggcttggctggctctcagctggagggctcactctctggaccttgtgtccgtccctgctggccctcagttctctggatcagggttgaaaggctgaaattctttgggtgttagcttaggatgcctctgatccatcctaacccgacattcccttgatctctcctgatctgtgagcatcctggcccttcttttcttttcagttttaatttttgcgctggctccaaccccttttcattcctgactctggaagtgacacttgtttttctcttggggtttgggaaactttgtggttgttctttctaggaggctgctctttgagtcatttcttttccatattgtttctcctactgtagcagggccatggccagggatagaggctgtagctcccactgagacctcggggtctggtggaacccggtcttgtgtgggtgctgtcggcctctcctgctttcccacctgcctcacggttcacttgtgtgcctcaaaggcacacatgtcctagcactccaaagcccaccagggtgggctcccaggggtgaggtcgaggtagaccgggaacccaagagagctggtgggcctttcttctacccctctcccctcacagtctcagagcagccccttcatgggagatgggaagtgagggacaaggtctcagtgtcagagccgtccttgtttgcccttccccgtgcctcttatgaagctcaggccttttggcagtcagaggcctcaatggtgcctgtgtccacagggctggctgtcctcaccgtgaagtctagatctccctgctaacttacactgtgctcaaaacacacacacacacacacacacacacacacacacacacactggctgtcctcactgtcaactctagatctccctgctaacttacactgtgctcaaaaaacacacgcacgcacgcacgcatgcacgcacatacacacacacacacacacccataggctggccatggtgggaggccaaggtgggaggatcgcctgagcccaggagctcgaggctgcagtgggctatgattgcatcactgtactctagcctgggccacagaatgagaccttgtctaaaaaaaaattaacagaaaacaccccatacgtggaagtgtggtattcacataatatgatgttcacttaaatttgaatcctttggtttaagtttagattactcttaattatctttttaaatgacaagctcgttgaaagaataaaaaatcaaagacggcttctatttaaaggagaataggagaatgcttaggggacatgtgttctaattttctcttcattaaaaagtcatttaaggttataattaaaaagaacatcttttaattaatttttatatttattaaaaaaaagtcttctattgaaaggtacagttcttagttcttcccgtgttaactcactcggttctctataaccccaagaagtaagtgctgttattgtccccatctaaactgttgaggaaactgaggcatgggattaaatgacttcttcaagggcagagtggctggcaaatgggagacccagaaaaccttggcagttgggcttcagaatcttcacgaccaaattactctctctgcttcagctggttccggattcttccccagggatggttgtgtcctgcaggggacggctggcaatgtctggagatgctttctgttgccacagctatgggactggggtattggcatctgatgggcagaggccagtggtgcccaaggcagccccgcaacaaagaatgatgcaggccgggtgcagtggttcacgcctgtaatcccagcactttgggaggccgaggcaggtggatcagttgaggtcaggagttcgagacctgcctggccaacatggtgaaaccccatctctactaaaaatacaaaaattatcccggcatggtggcaggtgcctgtaatcctagctactcaggctgaggcgggagaattgcttgaacctgggaggcagaggttgcagtgagctgagattgcaccactgtactgcagcctgggtgacagagtgagactctgtctcaaaaaaaaaaaaaagaatgatccagccccaagtgccaccagcagtgagaataagaaaccctgattcaggcatgttctgtgaaagtcaagaacgtaggttgacagagtttgttttgttttttaaatgtctttctgaataaataaaaactgttctgagtgagttttgtagttcctttggaaagtattcattctgtttgtttacatttgtgcgcctgctgtgggccaggcatgaggctacatgtctgagggcccagcttcaccttctaagggctgggaggctctttctatgccagcctgcctgccaacaaggctcagcttccactgttaagggtcattttgtggatttttttattttttatttttaggttgagtcttgctttttcgcccaggctggactgcagtggcgtgattttggctcactgcaacctccacctcccaggttcaggaaattctcatgcctcagccactcaagtagctgggattacaggcatgtgccaccatgtctgtctaatttttgtatttttagtagagatggggttttgccatgttgcctaggctggtctcgatctcctgggctctagcgatcctcccgcctcggcctcccaaagtgctgggattacaggcgtgagccaccgtaccccgccactccatggattcttgagggcagagttttttggagccaggcttcaagcacatttgatgtgtgcctatgagataaagactgcttttaatggcaggcaaggaaaatgcaagtccatctcttaactttcttgaagaagcttgagacacagctctgcaaggggctggaaggtttcatgttattgccaatgcttggtttatctgattgctgttgccattcattttgaaggagaagcaggagttggtataccaatattcccactgtgccagcagagagcgggttatccttactagagagccagagagtcagaacggtttttttttgttttttttttttttttttgagatggagtttcacaattgttgcccaggctggagtgcacgatctcagctcaccgcagcctctgcctgccgggttgaagcaattctcctgcctcagcttcccgagtagctgggattacaggcatgtgccaccacgccaggctaattttgtatttttagtagagacagggtttctccatgttgttcaggctggtcgcgaactcctgacctcaggtaatccgcctgccttgccctcctgaagtactgggattacagacatgagccaccgcgcccggccacagagctgcttttttttgcaagtgatattggatggtggttgatgtacaaagtaggagtttgtccttgctactgataccgtagctggtacaaggttttaatcgttctccaagcactgtcacaggtgtcatgtgtctcgccttttcagcagctctgtgaggtggcagtagccctgaggagactggctggactcagctagcatgggctgctcaggtcttcagcgtgctgagtgaggcattcctgcactatgacagagacccagctgccaagactttgtcaaacagaccagaagccagcagttcatgaaaagaccttgcttgcaagttgtagaattttttagaaaattcgtgctctctgtatttattttctgtaaaataattgatagggaaagaatgttcacatcttatcatctagatgttgctgattaaataatataactttctgggttggcatgagtaggtgaacttttaggaaacgcagcctacccttcgaatacctcttgtagcacctggctgtttcccttttgaaataattgtatgttttcctggataccttattacctggtgacacgtgtttctagttattgacctatgtttttaattataactttgggtggtggtctgaaatgaaatgttaagtttgacgcaaaaataggactagtttgtgtaactgatttgttcagaataacagcttacatttctcagagctttttgtatgccaagtgctatgcgaaaccctggatgtacaatattcttatagtagcccctgagaccagtgctaggattatttccattttgcagatgaggggatggagattaaggagtggggtcacttgaccaaaggtgcacagcgcacagctagatgccctatgggaaggtcttactgcatctcttaactacctcttgggaccagttaggaaccagtgcttaatgaaacactttgaagttacatctgtggaaagaataaacattttagctgggcaaggtggcacgggcttctagtcccagccactcaagaggctgaaataggagggttacttgagtccaggagttccagtccagcctgggcaacatagtgagaccctgattctttaaaaagaaacacaaataaataaacattttaagagattatataaattagatattatgaattttgtccctacatcgtggaataaaaccaaaacaaatacacagcaaaatgcctctagatttatttatttatttatttatttttgagacagagtcttgctctgtcgccaggctggagtgcagcggcgtgatctcggctcactgcaacttctgcttccctggctcaagcgattctcctgcctcagcctcccgagtagctgggactacaggcacgtgccactgtccccagctaattttgtatttttggtagagacagggtttcaccatgttggccaggatggtctccatctcctgaccttgtgatctgctcccctagggctcccaaagtgctgggattacaggtgtgagccaccgctcccgacggcctctagatattttgagtgattcagcaaacctcctaaagttgaccccgtagctggggtcacagtcctctttctccttcttccccctacttccttcttatatctggctatctgggagagaaaaaatttaatacaattgattactttttagaagagttaatttttacttattactgtggattttttgttttttaacagtcacaccgaggagaagactcagtgggaacatccaaaaactggaaaaagaaaacgagtggcaggaggtttgtatgttgttgtctaaggatcttggatggaagcattaagtagatgaggaaatgtcactggcagagaggtgacaggttattgtgtgtttagggagggctctctggtagagaaccagactcccactctgaggagcttatgggatttggcagaagaagatgatgagatcatagggtggagtgaggatgatttcttactggtcttaaagtaccaaaatggccagatgtggtggctcatgcctgtaatcccagcacttcgggaggccgaggcggatggatcacctgaggtcaggagtttgagactagcctggccaacatgttgaaagcgcatctcttctaaaaatacaaaaattagctgggcatggttgcatgcgcctgtaattccagctactttggaggctgaggcacgagaagtgctcaaacccaggagctggaggttgcagtgagccaagatcacaccactgcgctccagcctcggtgacagagtgagatgctgtctgaaaaatagcgacaacaacaacaacaaaaaccagaaaataattgaggcctttgattcacagtttatgatgttttcctatcgttgcagtgtttataaaattgttcttggctatactatggaattaaatatataagtatttggaaatttcgtaaagattaccatgacttctaggtgattctgagataatgtatgatccacggaatagaagtataagaaagggacaggcacggtggcttgtgcttgtgatcccagccctttgggaggcagaggtgggaggatcacttgtgcctgggaattcgaggtgagcctaggcaacatagtgagaccccatctcaaaaaaaaatatgagaaggttcctgcccttaagaggtttaggatccagctgaagaatcaacatgtgcacatgaaaaaaaatggccgtgccctctaatgtcatatgaggtcagcgtatgaatgacgttgggtgcctgccctgcatatacatatgttctttgagctcattcaagggagaattcccatggattggcacaaccagtatggtttatagagcgatcaggaataaaataggttttcttcaaaacaagaggcaaaaatgtggagcccagggtgggatcaggggccttctgcagctgtcgcagttggaacatgtgacgaaagccagttgatgtgacaactgctgggtgggagggacaggcttgggggcggggctgggagggctccttcccttcctgacccagggatggtctttacttctccctggcacctgtagacctgtctttcttgtgtttcagatttgccatacggatgggaacaagaaactgatgagaacggacaagtgttttttgttgagtaagtgtctgcaaagaaaccactctcagctgttttgctttttaataggaatttttaattataaaagtaatacatagtaactgtagaaaaatacaaagtataacagtgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagaccattctggccaacatggtgaaactccgtctctactaaaaatataaaaatgagctgggtgtggtggcacgtgcctgtggtccctgctactcgggagggtaaggcgggagaatcacttgaacccaggaggcggaagttgcagtgagctgagatcgcgccactgcactccagcctgggtgacagaatgagactccttctcaaaaaaaaaaaaaaaaaaaaaagagggaatgcactgtgtggactgtttagtaacctgctttttccatgtaatatattatgagcattttcttgtatccatatctatttttcaaaaagatgctatttagcagctctagagttattattttgtacagatatactataatttatcaaattgcctattggacattaatgctaaattcctgttatagagaacctataattataaataatgtattgagcatccttatctgtaagactttttcacctctctgattctgtctttaggataaattccggtatcacgcagcaatagtaaccacctgtccaacatatagcatgagccaggcctgattctaatcatcttgtatctgtagcattaggtcattggatccccacagtgccctgagaggtagtattgttattatccctagcttactgccagtgacacagacttgagggggtaagtgacttgttaaggatcccacagcaaagaagtagcacagccaggctttgagcccagcacctgctccagggactgtactcttgaccaccgtagttaagaggagaattaatgtttcacaactgtcaacatttaaattagaagcttgaatagtctttgacaggattaggattggttggttaatagaagttgatttgagcaggaattttttttttttttaaagttatgaatgtaacataaacgtttcagtatttgattcaagtacaccaacatttaggggtcgggccagccctcctctgagtgtgagtccacttgcatggatccagtgtggtcttccttcccctaagcatgcctgtaacataacatctacaatttctactttcattttatgtgggcgaaagagtacctaggtgccgaggcaagagactgaaggcacaaactgtttcagtataataaagaaagtagttagaataagaatagtcataatacaggttagatatggagatgatcatggacaattatcaatcattactataaacactattaatcattagcttttaatattactctttgtggcattactaacataacctaggaataactggcatgtataggctcaggtgctaaagggacattgtgagaagtgacctagaaggcaagaggtgagccttctgtcacacccgcataagggctgcttgagggctccttggtcaagcggtaacgccagtgtctgggaagacacccgttacttagcagaccgcgaaagggagtctcctttccttggaggagtcagggaacactctgctccaccagcttcttgtggaaggctgggtattatccaggcctgcccacagtcatccggaggcctaaacccctccctgtggtgctgtgtttcaatggtcacgtacgttgtccgctttcatgctcctcccgtactcctggttcctctttgaagtacgtagtagatagtggtagaagaaatggtgaaagttttaaagtctttgatctttcttttaagggcagaaaagaaaatgctgacgtatgctgccttctctctctgcttcggctacctaaaagggaagggccctctatcctgtaatcacgtgacttgcttcaccttgtcaatcacttagaagattcaccctccttaccctgcccccttgtcttgtatgcgataaatatcagcgtgcccagccgttcggggccactaccggtctccacatcttggtggtagtggcccccaccctgggcccagctgttttctccttatctctttgtcttgtgtctttatttattacaatccctcgtctctgcacacggggagaacacccgctaagcccagtagggctggaccctacaactttaaggttgagcaaacacagtattttcaaagaatctgattgctacatcatttgggagttttatggtatttttctagcattttcactgtagttgattgaaccaaaactttttttttagctgcttgtctttgaggctctccaaagcattcgaccacattttcatagataccactgacactatttttcacctcccatgttatcagtttgtgtaatagtagcttgctggtaatgtagttacagtaacaagttcaaatgacatgtgtgttttttgagcaaacctggtgaacttttggtgcaaaactgatattgagagcaaataggccaaagcttgcttgagagaagtctcccaggccaccataggcagccccaggaagacggggctgtctagcagttggataggtgggagtgcctattatttgttaaaaggctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgctgcagcctcaacctcctggactcaagtgatcctcctgcctcagccttctgaggagctgggactacaggctcatgctgccatgcccagctaatttttaaagactttttttttgtagagactgaggctcagtatgttgcccaggctggtcttgaacttctggccttcagcgatcctcctgccttgacttcccaaagcattcatattacaggcatgagcgaccacacctgactgaatttcttaaattttttatgtagtcaaatcaattttctcctgtgcagtctttgcctttgcattcacgcttggaaagttactccctgaaatgggtattaatcaaccaagagcagcagttctcaggcatggttcctggaccagcagcattaatatcacctgggaattcaataaaaatgtacattcccaggcccccaccccagacctactgaatcagcactggggtggggcttgcaatctgcgctctaatagtcatccaggggatcctgatgttccctagcttgagagcctcccgtctagagcaggggctgtctcctttgcctgtaaagggctagataatatgttttaggatttgcagggcatatggtttctgttgcaatgattcaactctgcctttgtagtgctaaagcagctatacacaatatacaagtgatgggcgttgttgtgttccaataaaactttatttacagaaacaggcagtgggccagatttggccagctcctggtctaatctagaggagtaagcaagggctttggggggaacctggaaattggctcccctggctagttctcacttttctgagcctgttgcagtggggtgctggtaaatgtttagcaccaggtcttcagggggaaaaaagccactgtttgtttccacagtataaatactttggccatagctgatttcatgctgccaaggtgaagtgaggaattgggaagagatagtcacgtttggctcttgtaagccagtttgagccagtctagcatagaactgctctgttgtgtgtgtataatattggggtcacaaattaaggttgttataaatagaatgaggatgaggatggtaataattagaataaaggttggattattactcttgagtcttggtacttatagggagatgagtatatattttaaactaattttacacacacatacttttaaaatatgaaatttcatctatatttagaggcttcttaatagtttttaagatattctgaggtctttatctcatatcccaagaatacatttaagatataaaaagtaaattctattataaggagtactcttttcatccatatgtgccttttttttttttttttttttaatggttacccagggtcttggtctgtcacccaggctagagtgcagtggcacaatcatggctcactgcagctttgatctcttaggctcacgtgatcatcctcctacctcagcctcccaagtagctgcgactacaggcgtgtgctatcacacttgaaattttgtttagtgtttgtagagatgaggtctaactatgttgcccaggctggtcttgaactcctgggctcaagtggtcctcttgccttggcctcccaaattgccgagattacaggcgtgagccactgtgcccagcctccagtatattttaataccatttctacaagatttagatcaattccaaatcaaaatgagtgctcgtaggaggtatgagtgcagagtcttaaaatgaaaatcgttagaattttggtagttggcaggtttcttatttacaactaagactttatcattttgagttttctacttctctacgtctttaggcccttgcacagggctaagagatttaattgaaatctactgaaaagagtggctgacagatcttatagctacatttacatgaattacataaaagcccaaaaccttctcaagaagccttttttgagatctaaggatacatggcaatagttattgtatgttacagcgtatgttataggcagttctgaaggaaaggattcgatgactatctttttttggcacaaatgtgatccttctggaggccagaagatagattcagtgggccccagttctttcaggtttaaggaataagcattttggtctatgaaaaatggggttttcctaaagtataagattgtcttatatttataaatgcctgtgttcattgctgtgggttcactgctttctcttttgggcagccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaataggtaggctcttcacttagttatttatctttgggactgctataatgagatccacttagatctagctataatggaattttgtttagtggttctctgatttaaacatgacttttatccttttcagatatcgtttcattaacatcactacctctttttaaatcctaatgttgtcatggaagcctgtgtaggggctgaccttgaagtctctgaaagctgaacactcagcaaaagactgtggctattttggtattcagggatgagagacaacaggctccgtctaagagtttttgacctggtctgcatggtgtatgggcatattccaattacctgggttattcaaaccaaaattgattggtaatagaatacggggaacaacaaggtattatgtctttggaacaaaggatactacaggtttcgactggtcactgagcatatcattttcttttgggcacaggatcttatttctctataaaattggagaatgagttcctgtcttcacctcttaattgccaatgtttacccacagggactatcatgggtagatggctcaagagggtatccttgcttcaatatgatgggccattaaggagacaggagcaaggcgggagcaaaccataactcttcataggattttattctgattttgctttgatctatttacataagtatctgaatcagtgagaaccacctgctttgagtttagatatgcatcttcagatttgtcgacatatgaaacgttgcatttggctgtcttctgtcaagttctctctgtccttttggtcccccgcagccctcacacggcccccttgatgccctcctctactcatttgtttctctttcctaattttgtttttatttttattttttgtgggtatataaaggtgtctatatttatggggttcatgagatgttttgatacagggatgcaatgtgaaatagtcacatcatggagaatggggtatccatcccctcaagaatttatcctttgagtgataaacaattcagttatacccttttagatattttacaatgtgcaattaagttattattaactataatcaacttgttgtgctatcaaatagtaggtcttattctttctttctatcttttttgtacccattaaccatctgcacttctttcttaattttgaacaattccttgaagctgcagaaatattttctagcatgattagggaggcacaggaggtaaaaatacattgttcaagggtcaattattgtgttgtacaaggtgtgaaatctaccaggttgccatccgagtggagaatttttttactgtacttgcctatgaaggtaaagaagcaaatggaaatttttttttaagaattgaaaggattttatttcaaatcaactctcatacctcatcctgggctccaaatatgttcaatccacttgtctgaacttctgcattggagtaaattttatataattgtcattgaagtcaaaactgatggcgtaatatttaaaacaatggctggatccccaatctaagaagaatacattttgttgatcatattaagtactgttacagtgaatgcatggacccatacaattgtggaataattaagaaaaaaggacttaagggcttaaaaatgtctttttaacaatttaacaagttagccagaaactttaaagatcttattctcttaatcttctagctagactctttttctgtaatgagtaagatatgtgactactgattgttttttgtgttaagtgttcgaactgctccatgtgacattagatagcagactcttgaatagagctaatgctctttcaaagatttgcaacagcagacctgcgacattgtaatccaggactgatagagttggttcagaatattaaaagggtgatatctagttagatacataagtcttgatggagaggaggagattctgaagcattgagaataaatttgtggttgctgagaatggccctcacatgttggagtaaagccagaaactctttgtgcctcttcacagctcccacttccccctaagactcttccttcctgatacctataattcattttgtggacactgcaggaggtgtctgcggtccagttggaggttgtggcaaattgtaacgctcaggatggcacagatgtcgcacaaggtcttagggagaccagcctttcctattcaagtgcccacagctctttccccagctgtcaccttccgcaggaatggcctttaacactgtcacctcaccccattcccctccactcttgggaagcatacgtctaggtgagtggtgaagatttttattctgaatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgcccaagtaggctgtggcttctagataaagtccttctactaagctatgaaacatgccaatttataaattgctatcactactttagttccgctcatttaaaatgaaatagctgaatgccgagtgagtgaattgggcatctttacttccaagacttctggggcattcaggagtcatattctatctaagctttaatggtgttggtgttccctttcctttggccactcaagggagcctgttttctttggataaaccgtgaaatctttaaccctgtgaatgtccgttttctctaaggcggggtgggctgaaacataacataacaggatttattttgaaagtggtgactccacaataaaaacatagatatctaatttgccttacaaaggccgatttgcaaatctagtatttccagtggttctttctttctttctttctttcttttttttttttaatgccccatatgacgctgctttgttggaattgccattggtgaggatctcactgataaagaaggggacatccctcccttgatagactttagggttgcactagagccatgccccctttgaagtggcctctaagcaaactctgtcttgtcatcattttcctctctgcagctgtaagtgatacggagctgtattttgagtttttgatactgatattactaaggcaattggagggattcttaattcatctaaaaaaaatcagggattctgacagataaaaggatttggaggaaatgtcagaataaagcattgtgggttcatgaagtcctaggttttataattaaggtttataggcaggtattaccgctgctgactggattcaactgtctggattggagatgaacaaactgccatctctgggctaactctgacccactgcctgattttgtaagtagaattttttttggaacacagccatgcccatttattcccattcctataatgttgaactactgtttgtgtatattcagttatcccaaaataatatggccctttgcttgttaccagaagagtcgcccagttgtggcagagatcatctagctcgcaaaactgtaaatatttactctttggcctttcccagaaaaaagtgccgactgctatgttagatactccagttcattgaaagtgatatcaccctaacattctctaaattagccacagcttagatgaaatttaggcaaatggaatgccccaggccccaggaagactgtggcagcacattgtatgtaactgttggggatgttgcctgaaacccccgccttttttttaggcagctgcaaggattagaatgttgcctcctcagaaactaacactcttctctccttgacctttgtttaaccagctttctgaacctgaagaactttgtagattgaaagctgtagcttgtggacctctctctgtggagatcagcatctcagtatccagggggaagccatctcttcacccaaagcttccgctaggagatcaagaggcccggaaccccgcagtcctgaatgctaaccagtagagacaagggaggaattcatttctgtttgtgttcaacatagactgagcaggaagggccaggtgttttacgactctttggagttagcagcttgttggctctgatttggtaaaagcaacggaaatgccttcagcacggtgaacattacatgcaaatgttgggaagtgttaggaaagggaatttttttaggcgagggaatttcgcattgaggaaggtccctgcttcgtttttagacacagcctatcagtcagctaatttggctatgcatataaatactttagtataaaatgctgccccctgctacctgcaggctgacatgttgctcatcaaaggcaggatccttctaatgagggattagttggatgcctaaatgtgggaccacctactctgttcattgtcttaattagctagatgtttgttggagcgcatgcaaattattttctgtaagcagacagatttattatcatatttacggagtgacatccagggtttgtgagacatccattaaatttttttttttttttaatgtttgagatggggtctcactgtgttgctcaggtgttggtctcaaactcctgggttcaagtgatcctcccaccttagcctcccaaagtactgagattactggtgtgagccactgtgcccagatgctattagcaagtatgaacaaattagatattttcagtctactcttctgtggtaatgatgataaaacttcttaactttcagtcctaaaccagcagtggctaaaacttgatttttaaaatttttttcagagtttggtccagatgaagtttctttcaccttgcgaacctttagaacgctgggctgcatcatgtgtgttgtaactttaaagttagaatagcctagcttcgttacagtttttgagccaaaggacccattaacagaaacaaaactttttttcctgcaaacaaatacaagctggccacactggtaaataccagtgaaatatattttgggactgacacttgcattttctattggtacttatgtcacaaaatcacctctctaacgtgtattacatggacctatatatatgcatacttacatatcaaaatgtatatattttgaggtataaaaagtacgtgctcaaggtattggtcactcctcaatttgttttccttgaaacaaaatgaaggtataaatatttcagccgggcgcggtggctcacgcctgtaatcccagcactttgagaggccgaggcgggtggatcatgaggtcaggagatcgagaccatcctggctaacaaggtgaaaccccgtctctactaaaaatacaaaaaattagccaggcgcagtggcgggcgcctgtagtcccagctactcgggaggctgaggcaggagaatggcgtgaacccgggaagtggagcttgcagtgagctgagattgcgccactgcagtccgcagtccggcctgggcgacagagcgagactccgtctcaaaaaaaaaaaaaaaaaatttcatgcagggaatcccaaaatgtaattatagtgtgatgttgaaattgattgtcttagcttagagagcctactttttaaaacttagggtcttgtttctaaatcatgtgttgaaattacagtgtgaactgtagttgccatactctttgatcctacaaattgtcaccacgatgaattcatatcttgtgcaaattttaccagttctacgtgaatagaagaaaattactttttcttcatgtagagaagggtattcattcctaagattttaaatccacacttcccaattatggactacgccagcttcctttacacctttgcttctttgttttcttttccatacctaaatgttactaaattttgcctttgagcctaaagcatgtcattgatggtttttttttttctagttattccaaaaggtcccataaatctggggccatagctaacttacatttagtcattttcatgggtaaaacacactcatatgagatcattgcacttgggatcttgaaatgcctgattagtttcctttctgattgttgaccagacttaaactagtgggatcttggcatttatctttttaaaaacctggtgctcattaaggaaaggaaaatattctgaaataatcgaaataaccttttgggcattggaactccattttaaattaaaaacatttgtgcctactattatcttatgctaaattatacccaggtattgtaagtaaaattattttgaagttactttgttctaagaaactatggagattcttgacagtgttagacaaagtccttaaatgacattatataaaaattgagaattagtaccttatgacttaaccattttacactgagatattattggacattgagtgtacatggaaatcacgtgatcaaagtatttgagaagtaaatatctaaaggaagagaccaatttaaaacattctaatgagcatcatctcataatttggtaatctcatgtaaaatgcttataataggggtgtgtgtatgttatatatatttttaaaataaatttgtaatcatgtatacagtagtccccccttatccgtggtgtttcagtttttttttttttgagtcagagtattactctgttgcgcaggctggagtacagtggcgtgatctcagctcactgcaacctttgtctcccagggcctggtgattctcatgtctcagcctcctgagtagctgggattacaggtgcacaccaccactccctactaattttatgtttttagtagagacaaggttttgccatgttgtccatacaggtcttgaactcctgacattaggcaatctgcttgcctcaacctccccaaatgctgggattacaggtgtgaaccgctgtgcctggcccgtgtttcactttttgaggtttcagttacctgaggtcaacaggcatctgaaaatactaattttgagagagagagagtgtgagagaccacatttacataacttttatacagtacattgttatagttctattttattattattgttgatctcttactgtgcctaatttataaattaaaatttatcctaggtatgtatgtataggtgaaagcatagaatacatagggtttggtactatccagttttcaggcatcactgtgggtcttggaacgcatctcccgaggataagggggggctactgtcagtgtgaacctgattagatctcaactgaaacttttttgtcacatgaggccatcagttgaatttcatgcctgcatgtaggtttagattttaattacttttttatggtgtcagcataacaaatgagagtcatacaaactattgtttaatgacaaagtgggtcaaacccataattaaaaaaattaataatagatttttgttctacttgaggttttgtagcattacgtaaagcttgaaaacttggaaattgttttacttaaaacccaattaaaataatttgatcttttgcttttacatcatagagtggcacaataaaaattgtaatggaagatgttattttacattttttttctttttttttttttgagacggtgccttgctctgtcacccaggctgtagtgcagtggcgtgatctcagctcactgcaacctccgcctcccgggttgaagtgattctcctgcctcagcctcctgaatagctgggattacaggcgtgagccactatgtccggctaatttttgtatttttcgtagagacagggattcaccatgttggccaagctggtcttgaactcctgaactcaagtgatccgcccaccttggcctcccaaagtgctaggattacagacactagccaccatgcccgggggtgttgtacatatttcctttaatctaaaagcagaaccatctttatatatttttatttttttccactagagggctctgttgccctttgatataattaaacaaaagaggcagcattgcaatatagttctgttcctctcagtccatcttgctttcattttggttaaataatgtcttttacttttctaacatatcttttaggtcttctaattctctgtgatgaagttcaaactgaagactgttactagtgtcgtgtttgtttctttttctctctcttttgttttgtttgtataaaatgccagggatgaagggatccacttaataaaaaggcccattgtgttcagggagcagcctgttctgccaaatcacacaagggcatgtgttttcatgacattattgcttttgagtgtgctggcctagcaataatatgatttttttttcctaagtggaaattgtaatatttaagtattaatacctctgtttaaggttcattttgaacgccttggtgaccctatgtttttttctttgttttttgttttgttttttttttttttgttttttttttttgtttttttgagatgaagtcttcctctgttgcccaggctggagtgcagtggcgcattcttggctcactgcaaccttcgcctcccaggttgaagcaattcttctgcctcagcctctcgagtagctgggagtccaggcacctgccaacacgtctggctaatttttgtatttttagtagagatggggtttcaccatcttggccaggctggtcttgaactcctgacctcatgatccacccgtttcggcctcccaaaatgctgcgattacaggcgtgagctactgcacccgcaaccctatgtttttttctaagaatatagtgtcccttgccccctgctacaagccttacccagtgttacataatttattgtaattaaattgtttattaatgatacattcttgctgtagaagaaaacgtgtccttttgggctcagtacagtatatgtttcttaagtaagagggatcatattaaaccagctacttaatgtgaagcagatagccagtgttctccatgtacaatcttagggagggtaatttttgttttggctgtgtaattatggtttgaggcagcccattaatcgcatatttcagctgtcaaatagaaatttggcccagaaaggaatacactttggctttacaaaactgcttattttcaaatttttaaatggggacaaaaacgaatatgctatattatatacttttatttatataatttttttttcagcaactttttctcttttgaaaatgcaagagcctgaaaaacattgtgaatatacttgtaacattgcaaagctatttcaccagagtaaagatattttggttgttcatatacgagtgtgttcgttgtttatctaataaattgttaaaactagatggcgattctgggaattattatagacttcataataaataagatgctgacagttgaaacccccttgaccgttgcctgtttggtatgacacagaccttcttggacttttgtagcctatacatgagtagatatgaatcctcagccttctccaaaataaggttggggtcactaggaggccttcttggaaagatgtcttaaattaaggcaccagtagatggatcaaaaagcaggttccaatagctcgcttttagtttcttgcctaaatttgtgatctccctttggcttcataaataacggtacatttcatgaagagctggtctcagtctacacaagcctaactgaatggggtgcataggaagggttgcattgtgtgacaaggtttaaatctaattgttttaagtctttgagttatttgctcaccaggctgtgcttgatggttttactttttgtgatttttggagccttcatgttagaagccatagtcatatggtgctctctgaaagcaagacaaggtttcttcactagactctaagaggagatctgagacagagagatgggggcggggaggaaacctatttcagtgtctctactatttctacctaggtggaggataactagccagatgaacggagctaagccttttgtatgaagtttatttcatataaagaggaacaaaatcagaatcaaatttcttctgtagttgcacagaaactgaagttaaagctaatacaatgtttttcatttttacccttacctctacaatgtacttaattgttacagattcgtatttattgattatcatgttgtattacattgatagccgtttaaaatttatgaagattccgtacttgtcatatttaattctcagcaccgtgcttacagctgtcttgtgataatgtcgaaaggaaagagaagggaggtgaggtaacgtgcttgagatcatacaggtcttgggcggcgggtgcctgcaggatagatcaaagggtaattgagtctgtgcctggggccccttccactgtacatgccaccatcctgttgggaggaataacagcacactcctgaatgagctctttctaagcagctcattcattttgttaatcctgagtttggaatcaaccaatttatttaaacccgtgaagcctcgctctgtgcccggtcaagtgctgggagtggcatctgcggggagggccaaggcagatgtcatttccagactgcattggatcctggattcagaagctgaagcttaggagtgggcatggtggttcacgcctgtaaacccagccctttgggaggctgaggcaggaggattgcttgagctcaggggttcgagagcagcctgggcaacatagcaagaccccatctctaccaaatcaaattttttttaaaagctgaagctttctttaccaaaaccactttggtattatgattgtaaaacaaacattaaggaataagtctgggggaatgggaagtagcattcatcaagcgcctgtatatgccaggtgttaggctagattagcttgatgtgccttctcatttaatataagtaattattttaaaggttattgtgattaacatgtattccttatggaaaatttagaaagcgaagaaaaataaaaataagaataaaagatttaaaaaaaccccaattcttaccagttagaagtatactattaatatttagcatgtatgattgtaagcatgttttcccttctttcgtgatttttctatttaaattgtgattatctttctgtgttgttaaatactccacatcttaaatggctgcatagtattccattatgtggttccagctcttctcccagtgtggtacattcgggtggtttccagctttttaatagctgtggaatggagaagcacattttgtaattaaatgtttgtacccatccgtgactcttctatagttttattttgtggaagtggaattgctgaatgaagtgatttgctccccaaccttaatatcttgatttgttttgtcaaactgccctggaagattgtaccaatttgaatgctcctttgcccagcatccttgccaaacttgagaattagaatttttaaaaaatatcacttaaatttgcctatctctgatgattagcaagattgataggcttttcttatgtcgggccatttgttttttaacgaattgccctttcatcttatatgcatgactattggatatgtatcgattactaattgattgcttgcctcatgtgctatcatttaattttcaaaatgtcccttagaagttaatttataaagtgtctattactttaagtacctgttcaatcctgtgatcaagaggaaattcacagagaaagaaattggcctaactcctcagtttgcttcactaaaatcttttaagcacacatcttgtctattatgccagctgcaactcaaatcaaaggcactgttgctttggtacccgcatttaaggagggaataccccaaaaaacttaaacttgtctggctttgcaatggtggtggagtcccaagatgacacagtaggcaagatttgattactttggttatgcaaatttcccctagatcttctattaatgacagtaacagcgcttcagagcttttctatgcattctctcatttgatgagcctgctttcaggtggagaaattgtaccattgctgaaaatagcttcgctgacagttagggcaagcttcattggtagcaagtttctatctggaaagatgtaggagaggaacactgactctggaagcagacgtgacctagttttgaaacctgggataaccacttcctatctgtatgacccgagcaagttactttccttctcagaactcctgttccacctctgtgcaatatggacagtactcctactttgcaaagttgttaaagatgggaactccagagtgcccagggaattgtctactcatcattgcaggcgtttaataacgtgtagccatttctggaatgggaggcaagaggatcgagttaccagtgaaattagtttggtattttcctagcttcctggttcccagatcctcaagaggctgccataatctctgtgaatttgtcctaaaatgacctgtataaataactgctttagacactggcttgtctttggtatgaaggaaaacattttagaatttttttggctggaggtcagtagctttcatccagaaaagaataatcaacggaaaaaaaaaaaaaccaccgagacgaggttatttttgttacagtcaaggaacaaaaagggatatattaaacttgggggaaaaagagaaggaaaactattattctttaaaaccgttataccatgcatcatggtaacatcttttttactgagagttctgcattagcacacttgttcacccaagtttgtgatagtttataggactgcctggtgtattaagtagaaatgctcaactttgctgtcctatttttttgatcatatccaaaaagtgtcagtgtttgaatatagttttattgccacttaaaaaggtaggacagttttattggcgtctactggacatggtaggaagagagctgtaatttgacacagattgtccttaacttgggtgacttaaggcaagtcacttaaccatctgagccttaatttcctcgtttgtaaattcaagagaataataacttctctgtcacatactgttttgtacagatcaagtaaaacaatgtgtgaaatgctgtaatgaagaagtccaatagtgtatgaatataaggttgctggcgtttggggaaaaatcatagttatagaagaaagactcctaaagggaagattagggttggaagaagatggaggaagagagtaatttaattccttaatggaaagaataaaataagagctcttgactttttttttttgttgttgttaggatatggggagaggtttctgcaaatatcttcttcagggtttacgaagtgaaccggatgtccggtaacagggttgcatgtcatgcaattgactgggtggtgatgactaaaattttaatgatgcgatctcatttaaagttgacaggctctgactctagccagatattcaggagcagaaacttgattcaataagaagggaacctgcagaggcagaaacttctgtgggttgcagttgtgttgagattacacaggtggaaatgttgcgagttcttgggtgatgcgatttcttcctgcttgccttaagtttcacctgcccaggtccttacttctgctcacagtgcagcacgaatttagatactgattggggattcagacacaaacgggatgctccttgcttatataacatcaacagaattgctggccacatcttgattatagaaactctttttcctggtgatcacacaaagcaaaagaatgaaaataatcaatctctttcaaatggagagactccgctgtgtcagccaccattggctataaggatgaactctcaaaactttttgtatcttgcaatataatgtcttccaactgcctttgattttactgtgtggctgtgtgatacagcaaggcagctgtggcttctaaattcagcagctaggtttgagaagcttctatcagctgagagatcatcagtacattccaaatggcattaaaaatgctgttacagctttatctattagcaaaggaagtttcaattctaagttcacgtacagttactagattgagtgtttgacaaggtagagagctctgtagtagatccatatggggaacatctcagtcagggtgtggagtcagatttttggcaagggataccatcctttcagcctgaaaagctgacttgggagctgtcagcctgtgtgcacgaggacctttttcctcccagggttagcgtcgccacttgcccagtgtttcttttttatttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctactataatggaccaccacaaactcggtgcttctatgctgcaaacctaagattataggcagtcataacacagtgttaagtatttgtgtatctaaacatagaaatggttcagtaaaaatacagtgttgtaatcttatgggactgccgttgtgtgtgcagtccattgtcatgtgatagtgattaagggaggtggacatttttgtgtttgcttatttccataagctcaagggtaaagcttcccaatcagcctttaggacagaggtaagaactggttggtggcctggagcctggatctggcctccagatgttttttgtatggaccacacaaaaatggtctatagtgggattttttttctttttttttttgtcagactacttgccagcatactaaaatcaggatattttacttaaatgtagatttatgacagttttgaaaaatcagaatgagtattgtagactaaatgtttatgtcttccccaaaaattcctatgttgaaaccctaatcttaaggtcatggtatttggacatggttgtgtccccactgaaatctcatcttgaactatagttcccatgatccccatgtcttgtgggagggacccggtgggagataattgaatcatgctgttctcacgataatgagtgagttctcatgagatctgatggttttataaggggctttcttcccttttgcttggcacttctcttactgctgtcatgtgaagaaggacgtgtttgcttcctctcctgccatgattgtaagtttcctgaggtctccccagccacgtggaactgtgagtcaattaaacctctttcctttataaatttcccagtcttcgatatgtccttatagcagcatgaaaacagactaatacaggggcctctgggaggtgattagatcatgagggtggagccctcataagtaagatttgtgccctgatgagaagaggatagaaaggtagctaactttccttaagctatgtgaatgtgagaacacagtgggaaggcagccatctgtaactagtaggagggccctccccaagaacgtgaccatgctgccaccttgaccttggactttaagcctccagaactgtgttaaagaaatgtctgctatttaagccactcggtccatgatattttgttgctgcagcttcagctgactatggcttatgtctatcaaggaacatagttgcactgaggttgaacagagctgttcctataggctgaccccctgtaggcaggcacaggctattttccatggtcagtttacctgcctgcttcctgtagaggcttgagcttggtttagagtctgcaatgaaaactgtgtgatgatattggactcactggctcatagccactgccacgcccttattcagtcttttgtgcaattaacaaacatttattgactactgagtaccaggtgctaagacttcagtgtagaaacaggcagggtccctgcccttgtggaggatacaaaacacaccaaaatgcagtcagcttcactgaatgacagagatatgatctgagaagtgtgtcaggcagtgtcatcgttgtgcaaccctcataggatgtacttacaaatcctacgtggtataacccattatacacagaggctgtatgggatagcctgttgcttccaggctgcaaacttgtatagcatggtaccgaactgaatactataggcagtcataacacaatggtaagtatttgtgtatctaaacacagaagtggtacagtaaaaatacagtgttgtaatcttatgggaccgccgttgtatctgcactccattgttgaccaatgtgttgttatgcagtgtgtgactgtaccagcagcttgatctttgtgcttctagagaacatttaaattgattcgcttttgtgagacagggtcttgctctgttacccaggcttcagtgcatcagcgtgatcatagctcactgtagcctctccctcctgggccaagtgatcctctcacctcagcctcctgagtagcttggactacaggcatgcaccaccattcctggctaatttcttttgtatttttaatagagatgaggtcttgctatgttgcccatgctggtcttgaactcgtgggctcaagcagtacacttgcctcagcctcccaaagtactgggattacaggtgtgagccaccacatctggcgaaactctgggtagtttctaattatttctgtatttctatttgtatttaaaagtacaggatactaaaatgttttttttttcttttttgagatggagtctcactctgtcgcccaggatggagtgcaatggcccgatcttggctcactgcaacctccacgtcccaggttcaagcgattctcctgcctcagcctcctgagtagctgggattacaggtgtgtgtgccaccacgcccagctattttttttgtatttttagtagagatggggtttcaccatgttggccaggacggtgttgaactcctgacctcgtgatcctcctacgtcggcctcccaaagtgctgggattacaggcgtgagccaccgcgcctggcaaggattttttttttttcatacttgaggaaacatctaacagcaaatatgttcttataagttaaaaagaacttttgctattttgaatgacactctcattaagtcttactactagtctctgatttttcttttttctttttctttttctttttttttttttttgagacagagtctcactctgtcgcccaggctggagtgcagtggtgctatcttggctcactgcaagctccacctcccgggttcacgccattctcctgcctcagcctcccgagtagctgggactacaggtgcccgccaccacgcccggctaatttttttgtattttttagtagagacggggtttcaccgtgttagcaaggatggtcttgatctcctgacctcgtgatctgcccacctcagcctcccaaagtgctgggattacaggcgtgagccaccacgcccggccttgatttttcttaacctttatttccaattatgcatcttctgagtaactataaagaaaagcaaaatctacagtaggtatggagtgagtgcagagtcaccatcagcttgaacaaatgtgtgtatctgtggtcaagtttaattgcttcttctgtaatttatattaatcacgcttccattgcttgccttttgttaatacgtatgcggccatgtgatgattttttaaaaggtcatccagtatcttgatgtccagtccatgcttataacctgagcagtttatgtactcttgagatggtatgtgctaaaaatgagtagctagtctgagtggcagccttacccattttattttgtgggcagatttcttttacagttctggctgggtttcttttagttggcttctttgctttgctcctgttacgacttagccctgtagctctgggctcttcgattctcacgtgctgatggtgtagctgagctctgctaatgctggttattaatctgacaatctataccagggaggttttataattgccataattcttatttgctccattccatttcccagcttctcaaatggggtggcagctgcaaagcacagtatttgaacatgaagtagagaatcgtcacttcagcttatgattttacattctgtcaaggctgcagggaaagcggtcatgtttctggatggtatttggatctacaaattccaagcaaactttttacttcttattatgtaaaatggaagggttagccaaattaagatctcaccatcaaccttgagggagtgacttctacatgccgtgtattactggttataaagctagtcttgtttggattgaagaatttaatcatatttaacttttcaaaggatgctttttaaaaaaccttatccgcgtgttatgtttaaactgagaagtacctgaaagtgaaaattttatttatttttactttttttgaaagatggagtcttgcactgtcacccaggcttgagtgcagtggctcaatctcggctcagtgcaaggtccacctcctgggtaaaggagattctcctgcttcagcttcccaactagctgggacaacaggtgtgtgccaccacgtccagctaatttttgtatttttattagagacggggtttcaccatgttggccaggctggtcttgaactcctaacctcaagtgatctgcccgccttggcctcccaaagtgctgggattacaggctcacgccaccatgcctagctgatttttgtatttttagtagagatggggtttcaccatgttggccaggctggtctggaactcctgacctcaggtgatccacccgcctcggcctcccaaagtagtggaatcacagacatgagccaccatgcctggcctgaaataatttcaaattaacccctgaggaacaaatgctcatgactttcaatgaatagaaaaatcagactgctagaacctccagactgcatgtcatgcgtagaagtagaatcctggggaagctagctcacaaaagcaagggagatacctgcaaggctgagctgagcttgcaagggaagaaaaatattagagagttgtcacatttagaaataagtgattccaaatttacagtcaatggactgtagatgccttccatcttcttaagagattttgtgcctcttgcacaggtattatccctaagatgtgttttcttcaatgtacctagactgtttccttaaagaattgcttttgtatggtacggctctatgtgtctgtgtttctcatgttggttaggagaactaacccttgtgacgaataagaaatggcaaacattgttaatgttgactttactagttgctcaaatattagcattggattttagagtcaacatgctagcaggatggctttattttaaaaccatgtgatagaaagctatctgctattattgatagcatttctggatggctgtcagaagtctttctttagaaatttaaccatatttttaatggtgggcattgcagtcaacaatagtacagactttgcaaagactatttttttttttgggtgcagtgaatacttcgcaatgcctgctgaattttacctattctgtaagtctttttgggaaccgttgagcccctcttctcttagttgcctttagcctttgtttttattatgacaattggtatgaaatttttccttttcattacttcttttattcagagcacacctctggcttatctcttcattctctgtttagtttcatattttactttaatttctgtacatcaatatctgccattatagtatttaagctcttggaaacatcaggcatttgttaacttgttgagaaaataaagcactccactgttgttatgagctgcttatggcaagtgaaaaactcacaatatttggccaaacttgggatcatttaggtgttgtttgcaattaatggcaggagatattttccttgttgttaagagtataacgttggttttagaaagcttgatctatgtttttctccatgttagatgtgaaaagaaccaggagagtgtgaggatattggtaatattgtcatatggtgatcccactgtggatagatacgcaagagagaaaatccagaagaaagcatttcactgaagcctggggacatttctggtgacaaatggtgctgatggcacagtgagaacgggagagggcagaagcaatgcacagatagaaagggtgtcacctgcgcattgaaaaatcccagtgccataacaatgcagtccctgcaatacagacaaacctgactcccaccattcctgtaaatgaagatggggccttgctgagaaatagaggatgcagattccaccctcaggcttcccgtcttgggatgcagagaaaactcacccacgtgcaacaactcaagagtcgttatttacctagcaaagtgttcacatgacagtgtttgaaatgtaccacgtgccttttcatgtttagtttagagcttgacactagagctctactgtggtttaccaagtgtgagggactatttctttctgagaaggaggggaagctttagtttccttgaatgtctaatagagtctgagtttccttttagaagcataaaagacgtacagtaggcagaatctggatttttaactatacagttgctgaagttatcttcaattcaaatcttctaaattcaattttgttaatgttgtttagatattattatagaagccagctttactgacttctgcacatttaatcataggagattcttccattctgtgaacttagatttcttttttctatccatgacatttatctaaatcaggctttcttttctttctactaaatttttcaattaccaataggctatgagaataattagactgacagtattactgaaaaaaaaacaaaacaacaacaacaaacaacaaaaaaaacaccttccactaaaactgactcaaaaagataatagcagggaaaatgacatgtcgatctgtgattccttttttacttgtcagtccttttgggagttgaacatataagcacatgtacctctatgtgacttttgagacgtctagaatagagaattcacctttgtagctggaatttattcagcatgcaaatgtgggtgggtgattgttttatagatgcctggtgttgaatgatgggcagttgtgataactatatataaaattatattaaagtccaagaggtgcttttatgaggcaggctggaaatggcatccgattttcttatggctttttcatgtccattttgatgaatctatttattacttctataatgagtagtacacatggttggttagccaagttattgaactttatcaaccttggctgaaattcacaatgcgtgccaaacttgttgtaacatgtaagaaattacatctgggctaaaaggttcaataatgattactcttataatggaatcttctacaaagcaagggatttcatgatatccctatgcttttaaaaaattattgtgatacagtgaaacaaggaagaacgtgtagctggaaaaatagtatttgcttgtaatatacattcagattcataacaggcttatttgattcccaggacagggtgagcaaaggatgctgtttcctgggtgtctgctttggtgttcattgagtcatgtctctctctttagaccttactggatctagtcttcatcatggggcctgtgagctctttcaaatctagaggacaaaacctaataaagtgctgtcatatcacatctgtttatgagtttcaaactgaaatgaaatgtgtagccgtgttattcttaaattacagagacttgaggaacgtagagctttttactctcactagagaaatctaagcacaggttggttcgttaacctgtaaagagatgtttgggttttaagaggtctatcaaataacacagtttccctttcccaagttactacctaactgagcagtaagaccacccattaggcaaatggaagaccaaaacatcacctgagtcattcatgaagctgatactggagaatatgtatagctgtgtgagctggtgggctttctaatcctgaccaccacaattagacagggtaatgggtcagtgctaggtcaggccagaccttcgcagagggcagaccccattcatgcagcatgttcaagacagtgcaggagagcagggtgtgtgctctctgtaagaggagaggagaggcagagctgcgtgtgcccggttctcaatcctggaattaccattcacataccattcacaacataagttggatcagctcccttgagcaggaataagtgagtggcagagggggtcagggatgttaacgcaaatggagatcccttcacccagaaagacacatctgaaatggagaagatgcctttttcctcctgcaaccaataagagagtgatgaaaattatgacgccttgggaaataagactgcaacgtaaatgtgtgtccaccccctagttttcttttggattgtgaatcctcaccctccgataactagacgtgctgttttgacgtctatgctttccagcttgccaattctggggcctggcacagtatctttcaccccggagtctcagtttcctcatctgtaaaatgggaaccatgacgtcagcatcacagagttgtgagaattcgacaaggtggaatgaaagcaactagtgtggtgtctgaccgcttgtgttagtccatgaggaatttccttacgtattgttttgtgtctaggaccaagttcttattttcttcttatggatgacttcatatatatgccgccacagagggaattaccgtttttctttgtaggtaaaaaggagctgggttaagatgcaccgtcatatgaaacagggaaaaagggtttgcttgggttttagattcctgaaacagtctgctgagggattctaaagttgttgtggtctctgttccactttgggagtttgataaaaattggcctgttttatttgacagctcttaggtagtgtgcaaaattgtcaacagataataaaagttttttgcaaagctatggctctatgtgctgtacttgagcagtatccatactcttaatagaattgatatatgaaagcaggtctttttccttatccgtttagacctaaatcttatccatagtgtgtggatatcacaaacagcacaagaggaagtgaaaggaacagagtgggtgagcaaaccattgttcaaaggaaacagaacctcgctcaaggaaaatgagaattcttctgatcagcttctataatggatgcaatgaggaaagttgtctagcagactgttcttggccaactgtctaaatggctcgctgcatcctcttcacgagagctgatggtaggactgtagaagagtcacaaaacatcacatgacaacgccagtccctctgataatcctgcaagagccagcccagttttgctgacagcacagtctgctgtttaattattgtgtgttcaatgacttacctctttttagtttaattaaaattatttctcagattaagagccatgctatgatgcttgccaacggatatttaaaacatgtaactgatttgttttttataatgcttcaggagaactcagttgagcagtaaagatgtgctcgtgatgtggttagctcagaataaggatgtgaaaaccaaaagggaaaggaggacaggagtgaatctggcacttatctttcagtggggcctgagtgcaaattcttcctaccttccatatgagagaatagggaaaattaaagaataaatgtctctgggtttaatgcaactttactaaggaatgaaagtccgataagaatccatatcttttgaaagaagattttttaaattccttatttttcctttctgcatggtcataaaacacactggggacagcccaccctgagaagtcaccaggcatctgcctgccttcagtagcaatcacccaactgctgtagaccgtaatcaagctttcaagaaccacgtgcagcacgctgcgggagagtcccagcgaagtgcttaatgcgccactccacggatgtgagtggggagcaagtgctcaaaatggggcttctgaattgcaatcatcatttggcatctctattacctacagctgctcaaagatgttccccccatgcaactgtttcttgcaactcctaacatttgcaacgaggcctctgatgcagacaacccgtttatacctctgggtggttgaaaccttcatggtttgttgtaaagaaaggtacacagtcccaccaatcagaccgtatctagaatattacgttcatttaggggtggcgcatagacaggctaaaggatggcaaagtcattgggtcatgtcctaggagcaacccttaaaggaagagtgaatggctggttagttggtagaagaaaagatttatgtaaattagttctctcagtagctatctaggagagagataatcctagctttcttcaagggacagaaccaggaccaatggacaaaatctgcaaggaggcagcatttaactgattagaattgtcgggggtggggttggcgagagggtgttgcttttctaatgattcacattgtataaaaagcagacagtaggtctggcactgttggctcatgcctgtaatcccagtactttgggaggccaaggcaggtgaatcatgaggtcaagggttcaagaccagcctggccaacatggtgaaaccccttctctactaaaaatacaaaaaattagttgggcgtactggcaggcgcctataatcccagctactcgggaggctgaggcaggagaattgcttgaacccaggaggcggaggttgcagcgagctgagattgcgccactgcactccagcccaggcgatagagtgagactctgtctctaaatacataaataaataaaagtagagagtaagttttctgtattgaaaatgttttaagagttctttgtcttaccttaggttcctccaaaaacagaaccagagaaaaagacatatttatgcataatttgggatgtgattacaaagagagggatggggaattcaggaaggaaggagaggcaatataaaaatgtgttttttagttagtcattactagaggcaactagtgctcaactccaggcactttaggaaatgcatctcatagctgtctgcctgcggaataaagggcatttatccaccggcttctgaccccgttggacaagggcgtcccataagttttgatgtcccagaattttgggtttgcacatgtgcaagtgccaagcaggttcttgtaggcatcccatgctgcagagtcagagaatctctaggatggaaatggggggatccatattgtagccccaggtgaggccatctggttgcatttgtgtcaagttggttgaaaactgcatggtgagcgtaaaaatggtttgagtaaaatggagctgtgagaatttgaaggggtgcatgagaggtgcccgatacagtccaccccctgcaccatgctcaggtctcttaagagtaagcagaatctaccacagtgtatccttaaagttaaaaggctctctgatgggactataaatgagtcccagtttgatgaattctggggctttagccttttctgctgtggtattagttttctggggctgctgtagcaaagtaccataaactgggtggcttgggacaacagaaatttattgtttccaagttctagaggctagaagtctgaaatcaaggtgttggtagggccatactccctttaaaatgtgtagggaaggacccttccttgcctctttcagcttctggtagccctagatgttcattggcctgtggcagggtaattccagtctctgcctccatctgcacaagccattctccctgtatcttttcacatcatcttccctctattactgtttgtctctgttttctgatctcctcttcttctaagggtgacagttttactgggtgagagcccaccttaatgccctcagtttaactcgatgacctctgcaaaggccctgtttccaagtaaggtgacattctgaggtactgggcttaggacttcaacatatctttttggggggacacaattagaccaatagcaactgtgctataaaagagatgttgctttttatcattgatgctatccagatgcatagcaatcattcaacaagtcattcgaaagaaataggtatttcctgagggtctagtatgtaactcagctctgctctaggacctggtgattacagcagtgaacaaagtgctcctgcctacgtgcagcttactttcttatggagcatgattttcagaagtaattgttcttttgcctcgttatcatcagacattaggaaccaaggggggattgcctgcttttggatcacagagcaagctgccttgagcaagtgagttcgaattgcaaaggtgtttaagcatagcttggtggctgcttagtgaggatgttgcagaggcaatttaaatgccgagcagggctttgggtttgtgatggttaaagtccatttccactgcggagatggtatgattgtacaaatggacaggttctgggcctctgtctgttttgtcaagtatacaacacttctgtttatctttaaagggaacaaatagtgttttcacaggtctctgcttaaataaaaagattctagaccactggatgtcaaccccaccatcccccttctttttttttttttttttttgcatcctgtactcctttgagaatatagtggaacctctggcccattctacaagggaaaaataaatgtattcctagccaggcatttgtgtacaattttgtaggggaggaaaggattgttcatagacactgaattaagaaatccctacactttatgggaattgtaatcattagtagcagttacgtagacatacttccattaaatacacatacttgctttagagagtgtgtttattcataaaaattcattgaataggattaggaataaaaatatgcatagaaatatttgttactttttcattgtaatggttttttttggatagaaatttatcagtgtgtaattaataaagtagtattgatttcagaattatacggtgctaaacaatggaaatttcctaaataactggcaggtaatggaaaaaaaattcagttactgacagcctgtcatagttgaatctaagagctaggggcaaaatacatatattctatgtagtttccatttctagaccctggatttctaaattcttccttataaaattttaaatttctttttttttttttttaaagatggtgctccctaactgatttccttcattttattatctcataacagatttgattttcacaatgaaggtaattattaaaatgcttcctttggtagtcaataaatataattagtttaagaaaactagaaatatttgttattagaattaggtgaacatctaagagtcttatttatggaagcaacatggtcaatatttatggaattgagttgaggctttgcaacactttcaacagctttttaaaaagcaaaatagttactgcctctgtggaaatagaaattacccacctattatgtaatgaaaaactaatgttggtttacttaaaacaaaactgtgtagcagtgtgttatagccacaggaactcctcagccaaatgttaagttaatgcaatgaaaacatttgtaaaaacattatcaagctgcaaaagaactagaaatgctagatactccctagtagctgggtgttcaaaaacacttgtcattctcacagttatatttgtggtatcttagtggtcattcaccttggatgtgattcctcaagtatgccagaaaagcatcgtcttgtgcaagtgttgtatttaggaagaactttgtgtgaaatcatgattgtgggtgaataactttaaataaataaatcgttttccttgatatacaatattgtgctactttccacagaaagatggaatcaatgctcttgactgtaatggaggtttacagtttttctaatttcttatttaggctgatctgagcaaagatgttcaaatttccacttatttaaacaagatagagtttttgctatgttgaaggaatatttttagcttagtaatttacttagaaactgccttattcaatattcgatgttaaatttgaactaaaacacatagcatcatatgacatggagtcttacattcacattttgttggactggaaacagaatcaacatattagtcatcttaattcatttaagttggctttctccagaattctagaatccaaaaacaacacatttgtcagttttacacacaaaaggagaggcaggatgtagtttatagttaaacatccagctttgcaatgaaaagccaatgtagctatagcacactgaatgaaattctgggtgaaacaaactgtgtaataagattttgatgcatattgaatacttagaaaatttgttttatatttgttttaatgagattctctttatatctgctttcatagaaacttgtaaattgtctaaaattaaattttctgtggttgtcatccacatgggttctgaacttgctgttataattattcacattttcttgcagtgaaaatctacagatcaaggtcatcttcacgtctttagttcttgttttgcttcaggtcagtttagaaccgaatgttaaaaggatattgtctattcgaagggtcagattgtggcacgtggaccaaatccagccccccgaggcccacttttgtaaatcaggttttattggaacacgggtgctcatcgtttacatatcgcccatggctgctttcacatcataacagcagaattgagtagctgtgagaccctatggccagcaaagcccaagatatttactgcatttatttactgtatttatgtttattctcttgccctttacagaaaaagtttggcaacccctggtttattctgttaacatgtttcctatataaggattcctctaataagttttcagaattattaagaaaacaaagctcattcctctaaaagaattggtatgtttttttttttttttttttggtggtggttgtttaatgaggaggacattataaagtattatatttcgtttccttaccttggttgccaggaagctcagaactttaaacattaaaatgtttaagtaaccagctcacttcacgtttcggatcagctttctttttcttaacacggggatacattttcactttaaaaaaaaatcaactttttgaagcataatttacatgttgtaaaacccatacatttaaatcatacacatgaaggtcttgacaagtgtgtacacacacataaaccaccaccccagtcaagataatagaatattcacatctgtaagaaattttccacctgccccttggctcaggcaatttgtcagtcttactactgattattgcgttattttaaaaccctgggttgtatgcaattgtctattacaagctgttttaaatagttttcggtagtggctggggcactaatgattaatagttgaatagcacagctggagaagttaagattcatttattctatttagtcttcagtacaaatttttaggtttccatgggagaatctgagatacagctcacatggagagccttttagctaatgtagcaataattaataagctggatagcctgatagcctgatgttttattagggtggtgcaaacgtggtttttgccattactatatatatatatatatacacatatatatatatacacacatatatatatatatatatacacacacacacacatatatatatatatatatatatatttttttttttttttggagatggagttttactctgtcgcccaggctggagtacagtggcgcgatctgagctcactgcaacctctgcctcccaggttcaagcaattctcctgcctcagcctcccaatagctgggattacaggtgcacgctaccatgcccggctgatttttgtatttttagtagaggtggggttttgctgtattggccaggccagtctcaaactcctgacctcaagaaatccgcccaccttggcctaccaaagtgctgggattacaggcgtgagccaccgtgcctggcctgccgttacttttaatggcaaagataattcttttaataattaaaatttgaaataattcttttaataagaatttgctgcttgccaagagctctgcagttattttattcaattttcctaacagctcttaagagtacatcttattattcccctttcacagatgaggaaattgaggttcacagaagttaagtctattagtttgctagagctgctgtaacaaagcaccacaaattgggtagcttaaacaacaaaatttattgtctcatagttctgtaggccagaaggttgaagtcaaggtgttggcagggttggttccttctgaggactgggaggagatacctgttacaggcctctctccttggcttgtagatgagtgtattagggttctctagaggggcagaataggataggtgcattaatatttatgaaggggagtttattaaggagtattgactcccacaatcacaagctgagggacaaggaagccagtttgagtcctcaaacctcaaaaatagagaagccgatagtgtagccttcaggctgtggtcaaaggccccaagagcccctggcaaaccactggtgtaagtccaagagtccaaaagctgaagaacttggagtccgatgttccagggcaggaaggatccagcatgggagaaagataaaggccggaagactcagcaagtgtgttgttccatcttctcctgcctgcttttctcttggctcgctggcagctgattagatggtaccaacccaaattgagggtgggtctgtctctcttcatccgctgacttaaatgttaacctcctttggaaacacccgcacagacacacccaggaacagcaccttgcatccttcaatccaatcacattgacactcaatattaaccatctcagtaggcttcttcgtgttcacatagtctcctcaccgtgtgctgtgtccagatttccccttttcataaggacaccagtcctattggattagggctcccccattatgacctcatttatccttaattatgaccataaaggccccatctccagatgcagtcatgttgggggttagggcttcagtgtatgagtttgggatggcaggggagcagttcagctcgtgagaatcgtaagattcctgatctgtttctcttccaagaaattgtttggtttcatgttgattttatctccttttccctatctgtctcaaagcactgaagaaaatcaagtcccccttgccctgataaggactttaaaatggtgtttgctaaaatggtgtgtgcttaggggcagctttgagccagataacaattctagttgcgcatgcttccataagctgtttactctaggaaggagaatctctgttgggatcttttggggagtacttgcctcccaagtgcttaggctcccgctgctgacaagaccctctgcctggcaagccgtgcaggttggaatcctctgttagggttccaaagccttcaccaactcagagctctttctctctctgtttctcttttttgaatttaaattgatcctagtcacaatgttcacattacctatgttggggatcctaccaagaccctctttttggcccagaagcagcagcggggtgaggggaatgaaacaaaaatttatagctgtcgagtctccagaagtcatgtaaaatcagcctcagctggaagctcctccgtgcatccctcacattcacacaagcaggtgcctgatcacagctgatggttagattacacgtttcctgagaggtatagatttcaaaattggtgtatttcacccgtccctcatcatggtatccccaaacaaaatgttatcaaatgaagaactccttcccagctctcccttctgagtgtctgattttattcaagctcagatggcttctcagatagcgtaaaaagtgatggagaatttcttttaccaattgtatgccctgtgggaacctgggtgctgtaatcactgaatatgttataaccaaaaaggtcaaactcgcaatgattcggtgtgttttgttccgtgcatcctggcatgtgaaagaagtgaggtaaagagtataatttacttccttgttttaaagctagcattgcccgtgccttccacgcgggactgttgtggatatttgaccactgcaagaaaactcacagaagcagaaacttagggcttgctttaaatgttatcagtgtgaattgagatggtgtcagcattatttttttaaagaccaaaacaacaatagtaacaaacacacacaagccactgttagattttacaaaactttaaaaagtaattatcttaaagatatctaagatagtgatctggttacatagattatcagagatacttttttttttgattatcagagatacttttaaaaaagcaactacaaggtaaggattatcctttaatttagtgtttttctattaaactcaatttgctttaaagttttttacattttgcctcttttttgtatgtttgagtaccacttcctaaccaatcacaataaatgtccggtttggagttggaggagtcattgattttaggcaaggtgatggtgagcccacagagcacagagttaatggaactctggccgttgatgtagcttcgaagcctgaatttaagtcatatttttgaaaagttgcgtcttaaaaagttactagcgatggagaatgaaaagtcaatttggacactttaaaagtgagcctcaaaaaactgctgaattttcccaacattgtgttttgagcacttccacgtgactttggtagcataaagactttagtcttttcaagaggcaaagtaatataccacttttcgcttttttaatggtgagagccaaggtcaatctgaatttttctttttctttcttcctttttttttttttttttttttaaaaaaaaaaaaggtgcttgaattagaaaggtagcacattgtccacatggacagtgcaggatggggctggctttttcatttctgagagctggcaatggaatgaaggtctttttttttttttcttaatttttcttttttaaacaattccctcctaagcatttcttaattgacaggggtggaaactatgttgccaagagggatcacagcccttttggtcattaagaaagtcaaggaacggggtctctttggatgagtgtgtgcgtgtagaatcctggtggctggcctgcttgctctaaatcataaagaaccctgtctcgagcagacgagaaagagtaacggaggcctcaatggtgaaaggaaatcctgtaccagctgtgaaaacaatgagacacgttcagtaatagaatatagtgtgcttacaaattcagagttgggttcccttcttctcttgaagtggctataaattaattcatcaaaataaaaaaggccaaacttcaggataaatctttctacttctaaacaaccagaaacactttggttgtcttagtagataggagtgtgagtacagaattatacgaagtgagaccatgggtgtgtgtgtgcacgtgtgtgcgcatgcctgtgtgtgtcattggttagttaacaaaaggattgccctctgaagaacatgaacttgggccagacagcacgtgtagggggtggaattatggagcaattgttactttcttgtattaagaagaaagggagcaaaagagctgtgtcttcttgagaacctttaaaagacacagaggtctctgcctctaaaaagctccattacatttttttttttaacaggaggcctaaattttttatgttttattttgtgctgttttatttttcttcctaaggttctcagacaagtttataaaagtgccatgttggctgggcagagtggctcacgcctgtaatcccagcactttgggagaccagggtgggtagatcacgaggtcaggagatcgagaccatcctggctaacacggtgaaaccccgtctctactaaaaataacacaaaattagctgggcatggtggcgggcgcctgtagtcccagctactcgggaggctgaggcaggagaatggcgtgaacctgggaggcggagcttgcagtgagccgagattgcgccactgcactccagcctgggcgacagagcaagactccgtctcaaaaaaaaaaaaaaaaaaaaaaaaaaaagtgccatgtatattttgattacaaaaaatttcatgcggtgttactttctttttattggtagagggtctttatgttttatttttttgagacagaatctgctccatcactcaggctggagggcagtggcaggatcgtagctcactgtaacctcgaattcctaagctcaagtgatcctcctgccttggcctcctaaagtgctgggattatactttgagccactgtgcctggctggcctttgtgttggacgttaatacagttggttctttaaagtttgacagtgaagacttttggaaattaaagaaaaaaaattgagtataacttgtaacggtcatggtgtaaagatcattttttactggttggaagtatagaagtggggttaaattaagtctataattgtaaactattgatgttggaagaacatagagagaaacttattcctgtggactggtgatcccatctcacagcccttacagataaatgtttgtaaaagcaaaggacagtgttaattctgagccccaagatgaaatatcaagtaaaagagaagaacatttgccaatgcatcactgtctgggaatggattccatacagcaggtaggtttatgtaatacagtagctgaagagacctcaattctgtgccttgatgggattacaccgaagggagcactggtaggctgttgatgaaacaggtggtatttggaccacttctccctctttccggacagctgcttagtaggtttagcttaaattatacacatgccaagcatgtacacatatgagaagcctatatctcgtaatatccacagagaatagatggcaaatcccatgatttgtatttgactgacagtcaagaccctgtggggtgtgagcctggtgggggcattccaggctggtttctcctgcctccaggagctgcttctagtgtgtgctcttaaccctaaaggaaggaaacactgtgtcttcctcttctctcatacagagcccttcccatgacaaatgtgtggagtgttccctccttttacgtaattctccaattttctggaccccagcttggtgtcctacaattcagttttgacactaacgacccagagtcagcacagaccccatggttgagggctcagtcctacaggatcatcccctacttcaaatgccagtagcaagttcaagattgtcaagtgcacttctgactcactggctacaaattggggttcccacgaccatctcctcaggcttgataatttgctataatggctcataaaactcagggaaatatttacttatgtttacctgtttatgataaaggatattacaaagagtacagatgaagcggtacatagggccaggcatgcggaggggatgtggagcttccataccccctcccggcatgcccctctccaggcaccacatgctcagcaatctggaagctctccaaaccctatcgtttaggtttttgttgttgttgttttgagatagggtctcgctctgttgcccaggctgcagtgcagtggtgcaattatgcaatcatggctcattacagccaggacctcccaggctaaagccatcctcctgcctcagcttcctgagtagctgggactacagttgcacaccaccatgcctggctaagtttttttgttttgtttattagagacgaggtctcaatatgtcacccaggctggtcttgaactcctcagctcaagcaatcctcctgcctcggcctcccaaagtgctgagattacaggtgtgagccactgtgcctctccatttaggattcttagagaggttttgttaccctaggcatgattacttaaatcattggccattggtgattaagtcaatctccagcccctcctcttcccccaaggcggggaatgtgggggttatcaattattcacaactctctaattgtgaataataaaagactctcccctcacccacattgctcagaaaatttcaaaggtttttgtttttttagacagggtctcgctctgtcacccacccaggctggagtgtagtggtgcagtcatagctcactgcagcctccaacttctgggctcaagtgatcctcccacctcagcctcttgagtaactgggactgcaggtgcatggcactgtgctccacaattttttttttttttttagagatgggatctcactgtgttgtccaggctggtctcaaacccttgggtttaagtgatcctcttgcctcagcttcccaatgtgctaggattacaggcatgagaccccatgcctggccaatttcaaggattttaggagctctgtgccaggaacctggatgaagacccagtatgtatttcttattatatcacaatatcacaaatccacagtcacatggtgattgtggtagtgtggggggcctgatggtggggtacacctgcttgaagtcaggctaccatgcccattggggtcctcccccttttttgccctctgatcttgtgagttccttaacattggggatcagtggtttttctcttacatgaaatgacaatgacactttatagggtttctgtagagaataccttagaattagttaatgtgtttcataaagcacatggcgtggtacccagccaagagtaacactctgaagtgctcctccttacctggacattacagcatcctttgtataaatcaggatgctcaggaaataccttgtttggaataggaataggctcctccctttttttctcacttgccttgattgctctgtattaaaattcataaaggcccatgaattatcaattagatagcatttggtttgttatttttagtttcttcctatagcaggcatgtatgcatgtgttaaaaatggaagtagcgtcgacattatgaaatgcacaagaagttttcctgcccccaaccggtaactctctcctgcagtaatcaatgttggcacctgtttaaccacttttgtgtcttacgtgcacgctgttcggtactttgactttttttcttaatattataacatggaggccaggcgcggtggctcacgcctgtaatcccagcactttgggaggccgaggcgggcagatcacgaggtcaggagatggagaccgtcctggctaacacggtgaaaccccgtctctactaaaaatacaaaaaattagccgggtgtggtggcgggcgcctgtagtcccagctactcgggaggctgaggcaggagagtggcgtgaacccgggaggcggagcttgaagtgagccgagatcgcgccactgcactccagcctgggcgacagagcgagactccgtctcaagagaaaaaaaaaaaaaattataacatggaaatgtttccttgcatctccgtatcatttctcctcattctttttaggtgtaacacagtattttgtcctattcatgcaatataatttatataacctaattgataaaacattttggttgattgcagtctgtcgtagataatgccgtactgaatattcctcccacatatttgcaagtctatttgtaggataaatttctggttgtggctgggtcaaagagcatgtccacttcaaatttgatagctatgtcccaactgcccccaaatatgttaagccatttcctatcccccatccctcattaatctatgaagttgcctggttgccccacatctttaccgacaggactgccgctcaatgtagttacccttgtagaatctgtctgcatgtgcctgtctaggaccatgttaattgtaatctttgggcatttttctcactcattcctaaccaggactgtcactggcaggttaaatgagaacttattcacccagcacagtggcagcactagtagccagcctggggtcagtcttgcctctcgagagatctcatgcagtcaactgggatttattgtacagctttacaaaacattacggcctcagccttgtactgcccaaagcatgcagatgccgcctggtgtattttaaagatattccacatgaactgacccgtttcccacttcttgagttggtatgttttttgattaatatatttgagatgtatttatgttattagggctatttaggaagctctgtagggatttgttgcttgctgtatataacacatacttttaaaaagcagggctggctatgacttatttttctctagagagacctgtgtagttttgtaagttcttaagatttggcagctgtggatcgtgtttagtaagcacgatctctaactctttggaactcagaactatgtaattgaaatggcctgggaggcaaatgtgatcattcaggtaatcaaagtaactacagaaacagaggtatggattagctagtcattgcagatgtggcattgagcatataggcgtggtgtacttcttagaacttcatctggaaatgcctgtgggggagttggatttcaagatcatcgtcaatgtcatgtcactgtaatttcatttacattaatcagattagtttggaaagtatggtcttcctacttttaggaggatataggagaaactcatccttaaagatagtagtctgttaatacaaaaacagtccccacatttgcattgtccccaaatctaacccaagctgaaagacattaggcctatcttcttgctttatgcataatggcagatctccagggagggagaggatgtgtgctggaagattctacaacttgttgattggttcctaaagatcgttttagtgctatgtttgtggggcggggctggagggggctggaaatcaccatctctgtggccttttaattgtgcccagttacaagtaacatttgtccccagtgtttcacaattataaattaataataaccacccattagaaattacgggtattgtaagccccaactcctttgggcgtcttaataaaaatgataattaaaaccataatttacagtaaatggggacactgcccaagtacatccacaatatggagaaaattaaaaaacttaaaccagaaggaaccttcctggcatcggggaaagaagctgcctttttcttagctcctacctctgtgggagctttgtcagtatttgaggggacagggttcccaccttcatgttttttgtgcctgaggattctgtgggcgactgtccccacctgtccaacctaccagtgagtctcatggtgtgcggctgcctgctccgatgctctccaccaccatgcccaagccatttctccctttgtgttccctgtctgggtaaacaacttgccaagctcaccagtggcccacagggcaccttggacacctagacttaggcagtccctggctttgtagattttttttgcttcctacatgattttctaatttataccttgagctgctcgggataagagggcacctcgtccatttctggctggtcacaaggccacagtatcttgagcgagtccattgtgaccactggaggtactgtaaatggataaaataataatatgaataataactcatagtgtttactccctgcctaaatccacaggctcccgctgcctacagaggagtcccacagttttcgcttgcttcatggagcttcatctctgttgtattcatgtgatttatttacacagagttgctccccaatccttgatctttttttttttttttttttttttttgccaagcaccctgcctttttgcttgtctgtttcgtctttatctctccttccagtaaagttcttggcccagaggttctgctgccactcagtgacatttgtgaaatgcaagggagcttgcaccatgggttcaagctcctgcagatccctgagcctgctacccttgtgcttctctgtccacgcaaagccaagtgctactgcggggttttccaaggcatagctagcatcctaatagtctcacacttgacatagtagggtttgacatggtttaaataaaatctcaaccagatcagtgggagatgttctttgagattcggtgattgagttgtgaacgtatggactgagggtgttttgtggtaaggcttgagtcatgtctgtagcaaggatgtttcctgaataatgtgcactgagcatcaagtgcctgcagtggcctggcgggtaatgccagcagcacgggtgatgatcatggtcaacatgaccaactagaaagcccaaaccccacctctagctgacagtggcttctcagctaacctgtcaccacgtgggattgggcccccagtggtgtaagctttttcagagaagctacacatctagcttttggacctgtgatctccccaatgttttaatgctggcaactaattcaaattaggaaggaaggaaggaagagaggttggaagggagagagagaaagaaggagcaaaggagaaaagaaaggagagaaggaggaagggagggaggaaggaaggaaagaaaaggaaggaagggaaagggaaggaaggaagggaagggaagaaagtatgggccacacaaaacaggtctgtgggcttgacttgtcctctgatcatcagtttgtgacctctgttctaaagagtgaaaactatgtaagatagtataagataagtaggtatttaaattactttgcaccttttccatttcatagaacttgaatgtttgtgttcaaagcttaaaacccaagacagtgagctattaagcctccatggccacgtcatttttctgattgcatctgatgtaacaagtgctagaaaaactgatgctgttcattgctttaaaacgtctttctttattttcttggtattattaggtttacatattcttccgaacacactcttgccatctccatgcagttaagctagttcaatttaaacattgtcataaagttaattttttataagatgaatcaggttattaaatttagtaaaccattgccttcattattttgcacaaactttggcactgtgcagaataggcttagcactactacatttagctaattaaactggccgtcagctgcagtattacaagagtgagggatgttattctcttgggttttatccaggactttaacagtaggtagcattattaagctttttttatataaaactccacactctagagatatggtttactataaaagtgttattgtccttcctgttaaactatcatcttttgaaatagccacgctttgtttctgttccaaaggcaattgtaaagggtaagaaaatggagttgtctattgcagcttttaaaagtagactagcaacgggtaatgcattgcttagataaaggaagatgtaagaaccagagtgtaatttcacaagacacagagacagatggcttacccgtaactacagtcaggaattctctaaaggagagagggtggaagcttgagcctgtagcctgttgctgctgtcttgtcagatgtgccctttctggtaataaaaagtcctttgccgtgggttattttgtcaagtgagatagcaggacttaacaggtttgtttgggaaaataaaatttgatagaaaaacggcgtgcttttcccccacagatttcttggtagcatcattcaaaactacagtgagcagtatctttgcaggattttaatatttattcattattataaaggaaggaagagggccatcgtgttgcagtttgaaacagcctggattgttttaaaatagtccagagctgcagcctattagcagtctgcaagaaccatttgtttcttcagcagatatttattgaatcctactgggtgctagtctggcgaaatacggagattggagggtgtaaggctcaaggagcttacctgagaaactggataaataaagctctgtactgggtgtggtggctcacgcctgtaatcccagcactttgggaggtcgaggtgggtgggtcatttgaggttaggagttcgagagcagcctggccaacatggtgaaatcccgtctctactaaaaatacaaaaattagctgggtgtggtggcacgcgcctgtaatcccagttgctggggagactgagacacgagaatcgcttgaatccctgcggtggaggttctagtgagcagaggttgcagattgcaccgctgcactccagcccgggtgacagagtgagactctgtctcagtcagtcaatcagtcaatcaatcaagttctggaacctgcctggccttgtgttatatcgatgctttctcaatctgttaaaaacgtagctgctattgaatgactaagaattgtttactctcatttccactctcttacatcttttttttttcttttaataccctgtgatgaaactgtgaagaaagatattcctgatcattgctttgacctggaaatttcaaagggacccacagtccaccattccgtccaagatcttctgggtgtgtgaagtcccgggctcccaaatgcagttgtgtttggtcactgtgttgcttgcatatggctgttggcatctcattagcctgattgatggggcagatcagtcagcaagactttgttcggtgcctgcccccagccagctgggctacaaaacctggcattttacttctctcattttccccaaatgatctaggtgtcttttgctcactggtgataaggggtgacattggtatcacaggtaaaaatgagtaaatttgagattattgtcgtcttgctttaaaggttggagatacagcttcaaaaaccttttactacccacacacccaaggggagtcaaatggatttaggtgttaaatacttcaggtttgaaatcctttgtgcattatttcagcatctgatttaagtatcagaggtcatctttaggtaataagtaagtattttggaatatgggatttggcaaaatctcaagaaataatttcaggttgtctcagcaatgaggttaaattgtgctccagagtccatattcagacaaacggaatggtggagcccgaggttgatttctttgaattctggttggtattaaagtcattcagccctcgggttaccattggtagcacatctaggagcaagttttaattttttagtcatagtgactgtgctggatttggtaggtcgtacgaattgggtaagaggcataggacaccaaggattttgcaaaaagcaggcaactaacatttgttttccacctactatgattatgttaggctctcaatatatgtttaccacttattccccattttacagaaacgataactgagtttcacatgggttcaaggcgtgaccttagatcccacagcttgtacgtgcttagaactggcagcaacacaagtgtgtccaacttgagttttcctctgtgctatgctgattttccttgagaagtattctgtataaatagactgttttctatgaagattaggcctgtgggagtgatatgaatgaatgaactttactaggctctttcacatggtgatgtcaggaagataacggtatgctgattttgcgtgcatattaacattatcttgtaaacaataatttatggccatttgacatgggtttggctgaattgcatagctgccttctctagtagaattgactactttgttattgtactgtactctatagggtcttccaccacagattacaaaatatggtattttttagtttagagcaatgggttggtgttcaagctctggattagactgcctcttctttttcctccctccctcccctcccctcctctcctttccccttttttgagatgactttaaaatatagattcatattttttaaatatacagaactttttcagttttccatttcttcttgtggcaactttttttgtagtgtttttctaggaatttgtcttttttacctgtattgtaaattcattggtataaagttgttcaccatatcttaagatcttctttgggttcataggatctgtagtccttttctttatttttcatttttaaaaacaactttattgaggtatgattgatgtacaaaaagccttacgtatttgatgtatagaacttgataagtttggagataagtatatacctgtgaaaccattatattttataagtacatgatacaatatgagcacagtactatatggtagatctctagggcttttccatctggcgtacctgaaacttcataccctttggctaatacctccttgtttctctctcccctcagccctttgcctacaccattctattttttgcctctatgagtttgagtgtcttagattcctcatataaattgtatcatgtagtatttgtccttctgtgtctggcttatttcacttagcataatgtccttcaggttcatccatgttgttgcaaatagcagaatttccttcattcctaaggctgaataatattccattgtgtgtgtttgtgtgtgtgtgtgtttgtgtgtgtgtcttccacatttcctttatccattcattcatcagtagaaatttaggctgcttccatgtcttggctagtatgaataatgctgcagtgaacatgagagggcagacatattgttgtgatcctgatttgagttcctttggatatgtatccagaagtaggattgctggatcataatccagcaatttttaattcttgtttcgttttttgaggaacctccatactgtttttcataatggttgcaccaatttacattccactaaggaatgtaagtttctcacgcataagggggctcttgtttccacaccctgaaccacacttgttatctttcattttatgatgagaaccaccttaagaggtgtgaggtgacatctcactgtggtttcaatttgcattttcctgagaattagtgacagtgagccccttttcatacacttggctatttgtatgttttctttggagaattgtctatttggttcctttgcttgtttttaaaatctgtggtttttttttttttttttttttttgctattgggttttaggagttccttatatattttggatatgaacactatcagttatgaggtttgcaagtattttttactattttgtagcttgccctttcagtgtcttgattgttttctttaacgtgcagaagctttttagttttacgtaacctcacttgtctagttttgcttttgttgcttatgcttttatgtggcataatgttgtccttttattcatccctgatattggttgttcaagccctctctttctgtctctgtctctctctctgtcattcttgctagccctttatcaattttattagttttttcaattgacagacttttagcttctttttttctctgtattttatgtttgttttagatttataagtttctcctttctccttttatttccatcgttctgctttctttaggcttaatttgctgggttattttcctaatgtaatggatgcttagatcatcttggatgcttagatcatcattttttctttctttctttttttttggagcaagatctcactctgtcacccaggctggagtgaagtggcatgatcatcctcctgagtagctgggaccacaggtgtgcaccaccacgcccaactaattttttgtagagatggaattttgccatgttgcccaggctggtctcgaactcttgggctcaagcgatccacccgcctcggccaccccgattcctgggattacagccatgagccactgtgcctggtcttctttttaatatatgtagttaaggctatagattttcttttaaccatggctttagctatactccttaagtttgtatatgtgtttgtaattaccgagtttaaaatatttctaactttcattgtaattttttgagccataatgtcttatttatttatacatatatttccagaaatgagaattttctgggatcttgttattgatttgtaatttaattccattgcggtcaaagagcatactttctaattttaatcttttgaaattcattgagacttgcttttgcccctgcaaatcatcagttttggtaagtattcttgaagtacttgagtatattttgctgttgctttcagtgtttatcatattcaattattttcagtttatcaattaagttgttcaagtcttctatatactttgtgtttgtctgcttattttatctgttactaagagggatatgttaaaatcttccattataattgtgaatttgtctatttattgtcctaattctgtcaatttttgacatatatgagaggctctattattaagtacatataaatttagaattgtcatgtattcttggtggattgaaatttaccattgtgaaatattcagcactttctcttgtaatgcttcttgctttagagtcttttttttctgaaattagtacagctatatcagatttcttttggcccgtgttatacagtataccttttctattcttttactttttttatgcttatgtttaaataaggtataaaacataatgtacattcttttttaaggacagtatatgtatatttatgttttcttcagtctgacaaactttttcttttaattgccatctttaggccatttatatttaatgtaatgacagatatatttgagtttgggtttaaatataccaccttattattggcttcctgttaagttattctatattcctctttcccttatttctatcctttctttctcttttttcttttcctttttcctttctctctctctctctctttctttctctttcctttctttcttccatttaaattgagacagggccttgctctgtcactctggctggagtgcagtggcataatcatagctgactgtgcccttgaactcttggactcaggcaatccctcgacatcagccttctgagtagctgggactaccggtacctgccaccacacctggctatttcttttttaattttaatttttgtagagacagagttttgctatgttgcccaagctggtcacaagtgatcctcatgctttggccgcccacggtgctagaattacaggccactgtacctagtcatcttctctcctttcttgcctttttatcattctgcttttcttctccattagctttttaaatttgtagagatttacatcttgcatctttgacttattaaaatctaatataaatcagtattatatcacttcctggagaagacaagaaccttaggatactttgcttccattactcacctcctaggttaagcattgttattattattgatatagtaatttttgctatatattttaaaactcacagatttcactcttaccatttggatcttaacatgtcgttaccctttatgttgctctttgttactttctgcatctctgggtttatagctaaggtcattttcctcctgcctgaagagcatcctttagtgtttcctctagtgtgggtctatacgtgacactaggtgtagtgtaggtgacaaacaaaaagcagctttcgtttgcttaaaatttttgttctctgcctttatttttcaaaaatattttcactaggtatagaattctaagatgaaagttttattttttttcagctgtggcttccatcattttcctgagaggtataactatcagtcttgtagctactggtctctaactacttctaaaactatctgcagtttttagcagttttactctgatgtgccttgctttgacatgtatgtgtatatatgtgtatctacacacacatacacacatacagatacacactcacatatatatttctgtttgcggctcacacagacataaatatatatatatatacaaacgtacatttctgcttgtagcttgcacatatatatatacacacacacacatacatgtagacacacacatttatacatatacatgtcaacacatacacatacatatttctgcttatggctcaggatacttctttttttggccgtgtatgcgtcattgattttgtaacattatcagccattctgtctttaaatattgcttttcttagtctatttcacttgttttggaactcagattacatgtatgtgtaagagcctgggagaatgtgtttcatatgtctcttttgtgctttgttttattgtgttatttttttctttttatgcttcactttggatttttttgttaacttattttgtagtttcctcaatcttgtcgtcagctgtgtcttgtattctgttaaactatatgctgaattcttctttactcttattactcttattttgtttaagtttcagaatatctatttgaatttttttattgtttctaattccctggcaaaattctccatcttgcctttttgttccttgaatttgtcagtcagacttattttaatcactgtttctgaataacttgattagacagatctcctgtgcatttatttccatttgttcccctctggcttttggtgaagttttttctttttgtatgcttagctattttgtttgaatgtctgagagtttatatgagtatttgaaataatcatagtggtaatttgagactctagataatggtatcttcctccagagaacattttctcttgcttctggaaattggatagatagggactgatcactttaatcaaactaggaattgaaatggcctgaagctgagtttccactcttgtgaaggctggactgtctcttgttattacagcgagggtataactctttaggatcccgacccaaggtttggtgtgtttaccgtggccctttcctggtgggtcctgagctcaaatttatgtctttttccttgttataaaattgccaaaagctcagcccatcttctcaggcttccaaccactatgtttggaaatgaaatatgccttgaaggaaaaaagctgccaaatgctggccttgcagtttttgcagatcttggcccccaaaattcttagtcatagtgcccttctgatgccttcaaacagatatgggtgtgtatgcacgtgtgttattttgtccatcttttctaattgttctcagtaggaaatggggctaagaaacctaggtaacactggtagaagcagaggtgctggcgacacttaccatagagtagagcataaagtccttatcgtgggcacaggatctggtcattattgatggttaaatggctggacatgccgtgaactcttctatgtcccagtcttcatctttgaaatcactgcatccctaggacaagttttctcaccatcacagtgttgacagtccgggccagatggttctatgttgtcaggggctgccctgttcatggtaagatgttttgtaatgcctggtgtttacccactagatgccagtaggactctaccccacaactgtggccactgaaaatgtctccagacatttgcttctgtcccctggggatcaaaatcacccctggttgagaacttggggtaatttaagtggtgctccggtaaaggccattcaacatgactcactgtgttgatgttatgttttctaacattgactttcctttaaaccatagggttcgaaaccgccaagtcttttgccctccatggtgcacatgtgatcttggcctgcaggaacatggcaagggcgagtgaagcagtgtcacgcattttagaagaatgggtaagtgcttgactgttgttgttttttttaattgtcaaatacacatgccgggctaaccatatggagatttcagtggagtgtgtaaagtttattgctcttggaatcatgtctttatttttaaagtcatcttcactttgtttgtcttatgaatgaaagcatgagcaagtccattattattcacgcatttgtttgtagttcattgtcagtgtcatctgctttattagtcaggggtttgagaatgtttcttcctttaactcatttattaagaaaaataaaacgtggtgaacgcccatgattgcaactaggagactgttatgcttatggttgttaagattagaaagaaggaggctttaaccctatctctaatttcttacttttctctgtctatgtagaagttgatgttgatacgtgtctacataaatatttactaagggcttgccttagtcttgggaccaaggatatagtattaaacgaaacagaatccctgccctcataggcttaccttctaggtaggaaaaatagaccataatcaagtttaatatttgccataatgtcagtaaataaaggactgtaaagcagaggaaggtggggggaatgatagcgtgagtgtgatggagtcatcagcagggagccttccaaagttgtgacatttgatctgagacctgaatgaagtaggggtaagccatgcagatgtcaagagaagtattctcttagcagtgagaagagcatatgctaaggctcagaggtaggcacaagcctggagatttcaaggatcatcagggaagctagtgtggctggagatgaatggagtgggtaggagaggtgctgttgggggatgggtatctggtagactctgagatagcggtgaggaagacattagagggtttgagctagagagtgatgcgagctgtttgatttttgaaacatcgctggatttcagaatgaagtccagactgcattcattcacttttcattcattcacatattcatgaagtgcacctctgtgatgggtgctggggtctactgttaaggacaacagacgttgccactgtctttgtagagctttcagcctattgtggaagacaaatttagtcaaaaaacacagatcttaatgtaaacttgaaaaagcagtgagtggtcctaggaatcagtaatgatgccagggagttgggagacctttggggtccccaaggaagaagtgattgaactaagatctgaagaaagacctgaagagggtggagaagggtcagatggggtaggggaatggcaggtgcagaggccctgggaggagggggaggaggagatagagcagcgtgtttgggagcagagcctgaagggggctgggtacaccctgtggaggccgtcttcatttttgaatgctgtgaaagatttcttgccatttgaagaaatagactacagtgtacttaagaaaatttttggtactctggactgaaaagtagtgaaaataaagaaaaggaagatttatttctgctttttcagtgtatttatgatgaaatatttgaaattcagtatatttgaaatgagcccttatcttgagctcactgagcttattattttgggttaaataaaaaagaaaacagagtcttactttttctgatcattttattgtctttctgactaatgttaaaaagtagtaacctctagtaggtgggatagtagcaatttttagggatgtattgagaagagtacaaatgggaatacgtgcatcttatttgaatctacacgcagaatgggaaggtgaaaaatgaaatgtgaaagtcgttcttggtccttctcttggaagataaacattatgtattcttccagaaaaaggttatctatataccagcaaacacactcacattctgttctgtactttttttttttttaaacttagtactgcaggagatctcttattagtgcatatagatctacttcattgttttaactgctgtataatattccatcatgtgcttatgctataaccagtcttccctttggtggccatttaggttgtttgcattgttttgctatttgttattccaagcaatggtgtttcacagttctctctttcttgcatcagtctttcttacgatatcatctgatattgggcctaaactatgctgctgtgagcattctttatttacgtatttgtgagtaaatgcctggggcagaatcttagcactggactccttgattcaaagggcatatgcatttaaaattttggtaacagttcccgagtcattttcttttttcttttttttctttttcttttttattttttttttgagactgagtttcactctgtcaccaggctggagtgcagtggcacaatctcgactcactgcaactttcacctcctgcgttcaagcaattcttctgcctcagcctcccgagtagccgggactacaggcacgcgtcaccatgcccagctaatttttgtatttttaatacagacggagtttcaccatgttggccgggatagtctcgacctcctgatctcatgatctacacacctaggcctcccaaagtgctgggattacaggcatgagccaccgtgcccgacctcccgagtcatttcttatcttgttgctccaatttccattcccactgacagtgtagacagacaactgctgagggcttgcagtgttcttgggactagcaggagggcgtgtcaaaattgtaaaactctgcctatttgatgtaatatttgaaactagaaaggtaaaattccagggacgctagtgacactatggtaacctgattgtacagtgacattcatgtttaaaccagtcttggaagataatgctgtagcacaactgtttttgcatcattaaatttatcctcttcttttctgagaacacaatatatatgagaacacattcatctgcatttatcctattttaattattgtttgatgcttagagcagaaattcctggacctgccccaattagcgatgagaccttgggtaagcctctggatctatttggagcctgtttcctcatctttaaggaaaaaggttggatggatgatgtcaaagacccactgttcagtctttctttcttatattttgagccttaattgggtccctgtgagtcaatttccgatgatagaatttgctgttttatagttttactctaacatgtagtaccttgagatagaccagtgatcccagactaagaattattcagaatcattcaccgtcggggacacagaaaaaggaaaatggaacagaaacaaaactaatacacgtggctccagatgtttaaaattagatttgataggttgtaggctgaagaaactcaacctgttcatcatctctcatcttttcacttgttctctctgtatgccattatattgtgttcctcattttcccaagatgatgattatggaaactcaaattttgcaccagaagctgtagttaccatttcattccattgcaccattcataccctgcagagaggatgtgaagtcgtaaggccttcttgctctggtgacatctgttaggcttcgtctctatatcatcccccaactccttgacccttgatatttgctggtctacttcccttcaggtccttcctcacctcacatctctgcgcaaggatttcatctggtatgtcactaaatattaccttcctgtgtttctcaaggtcaatttgatagactccaatttttcaagctgctggccagcttgagcgtattcatatgttacctacgatgaatcacatcagtgtcggggccgggaaggtactgcaacatattggcgcctcacgggaggctctcaaaatgatccaaagttttttgttgcagcaaaagctcattcagaagtctttgggccatttggctcagcggaggctgtcatgtgccaaggctccgtgggcattcttagctctgcttctggagataagagttcattcctccatcccaacttgttcttccctgcccattcttcctcttcctgccttcactgcacattccgggatcgccatgttctagaacattcatgtctgccttttagccagcagaatgctattctcacatccacaatgggacagctaacagcccccatttatcaaatccctgtcatatgctgtgtcaggcactttatatccctcatccaggaggatgcaaaaacctggtgtttttcttttttttttttttgcattttccagacgagccaagggatggctcagaagggtgaaggaactcacccgaattgcacagctggtgagctcagagtcaggctccttgcttggtccatctggcttccaaactccaagtctgtctgctccaccccatggcccatctttttaccatgtttagtatcaatgttcatactttgcagattttgctttcaaactctctagctgcggtttgagtgattaatttcaggatccatcctatttcttagaggaagccactctgatctaccctgtcgtctctttatattcaagatatcctttatagagctctcaaattacttttgggaagaaggagctatttaataaaatacaacttaagtgaaaacacattccatatagaagtatattaagaacctatatgtaattactatgactactaattatttcatgggaaaatgccctcctgctgagatgttttagatgctccaaagttagaagagaaaaaatgaaaacaattaaaacaggataacatggacagtacagaagtaaaccactgtcttaaaaggccaatccatttggcataattaaaaaaagagggaggagatggaggcacatcagcccccattcatatttaaataaagaaaacggggcagtggggcttgttcctatgttgtggaacagcacacagatgtgatctacctcattcacatccttatgtgaattatacactggtgccctcacctcttaagacaagcacctatcgttttcctgtgtattccaagaggccagtgtggctggtggaataagatgttttcctgttttcaagatgcagtggactctcttttatttaacagcagtgtctatgtgttaggaatccatgtgagttctctaagtctgggacaacgataggtgtgtctgagtcctgcattaccatggtttattctttcctttacccagtatctattggagttgggcttctgttgctttatttctcggggtctggcatatcccactccctgtcttgagatctcaggacctctgagatctcaggacctctgcatgtaaagaacaagagcttattaggtatcaaaacatacttcatgaacagctacagcaagacctcgacattccagtgtagagctcttgaaagaccccagtggggctctgagttcctccttcttctgtttctattagatttctaaattttagtttctaaattttagatccccggaacttgggatctaaaactctggtcctgtggaagaaggaggtagggtagagtgggagcagatggacctgatgtcatccatctccctacgttgtttgcaggaggaaaagggatgaggctgaggctgggaggcaggggcggtggattgagagagaggagagggattgttatgagtaaccaatgttcctcatgcctgccaggccctcactagatctgtttaacagagagtgcagaagagcttctgttggggactggccattagtatagcgaggggcccaataagtgttgtgaaacatcagcatctgctggacattgagatggccacaggttggtcagagagggctggtatgggaagaggggcaggtggctctcccttagagttactatttgactcacccctgacttcccagaatgtgtcttgagtctattaccctctcatatgggaggggtgacccaagtatgtttgtggcaaccaaaatgtctccaggcattgccagatgtctcttgggggtgcaaatcgtccccagttcataaccacggctataaaacatgctgtattatagtggcaaagattagaatcagatacatcttatgaccttgggcaagtttcttaacttctttaaacctcagtttcttcatctgtaaaatgcacatcataatatctctattcagagatacaggtggttctattaaacacatcaactctgtgtatataaagtcttaacccattgtggaataaattaagtgctcaattaaatgttagctgctgctattaataacaacaataataatattttcttcacgcatgaaagtgcaaagtgatgcttacttttcttaacctctccaactggctgaaagaggagctctagggcagatgtttatcagcctgatttcagtggagttgcaatgaattctttttctgtcttcatatgtctggactcctacattttaatggatgtgtatttagtttgttgattagtattttccagtgtagctcatattagcactcaactgtcatttgaaaagccatcttaactatttatgtgattgctttttcttttgtatttacaaagaaatacactctgcatatattttggaaagatgattaagggattagtcatcaggaacagcaagcaatggtttatatcaaaatgattattgagaaagcagagagatgaggggtaaaaataaaagatttattagccagaggtaatggaatgtgcatgttttagggagagagcgcatgctcagttgattgcaaccacacggtttgctgctgaagtgctgtaatgattcaggttttcaatagagttgatatcgggtctatttattttgtgggagtgaagggatagggatagtactgacagcattatgtgattgcagcctcattgattagcatcggaaataatgactttaacattattttcagatagggagcactcagtaccaaccattatattaggctcatgggctcaacattttgctgtgcttttcatagatactgacacctgtgttttcattttgttgttgttgttgttttccctgccgggaaactgccgcatcctgtgttttcatggcatgatattaaggaacgatgggtaggatgctgaggagtaaattgctcgcacttttaaagacttctgcaaaactccacctacttttaggctccttaaaattcagtgactttatgagctggtatagcttcactgtttgtgggaattccatgcaatctcctttgacactaaaagcttaagtcccatgatttgcctttgtggatggaaggccttggccttcttttatgatatatgtgttggggggaggcatgtggtatgtggggcgggtaaaatacgagcctcatgcctgtctaagctggtgacttggcttggaaaagatgatcattcgtcaacgcatcacaagtcacagggcttatctccattgttctgaacgatctgtagctaaacaaaaagataaaagctattaatattattaatagttgtagattaccgggaagagcgcatcctaaatcagccattagatttgttcctcatttctttgctttacaaattgtttttctgtatagtattggattttcaataaataaaggatgatataaacaagtctgcaaaccagcaagaactatataagccacttgctcaagtcaataagcgcatgctcacaaaggaacgtaaagttctgaagttcttctttggggcgtttgcaaaatgtcctattattgtcacctgcaggtggggggttggatattcctatttgtctttgtactaggtactgtgcttagcatttaacagtaaagtatttatattatgtgtgaaacccattgtgcagatgaggcagtttagaggctggaagaggcatagactttcccaggctcacacagctgggagataacggggtggatccaagatttgcagctggtgtgtgggtgatgccggaagattggcctttttcaaggacttagacaagtattgtactcatacattatttgcatttatttgtatgaatacttctgggttcctaatatgagggtacctaaaaagtacatccgctgcgcttcttgtaatctgagggagttgatgaacatgggccaaggaagctctttccttcgccttccgttccagacttccttttcgagtagtatatcgtgtatttactgttctacttcagttgcctatttgacctttcttgtcacaggctcagggaagattctttatcagataataaattattcatccccctcatagacataatcggttgctaaaatattctgagtttcctgtctccagaatacctaaaacttgtgcttggtacttatcctctaagttttccgtttcatttctcattctgaaaattttgcaccgacttagtcttgaatgttattcattgttctttgatcattgtctttgtgtcttctccttttttttttttttcctggccaccgctcgcagtcttgaaccgaatctttcaaactttatatccatgtaacctttgtataatgagggctgtgattaactgcagagttttaaagagtgaaagtcaagcataggtggctggctctgaaccatcactcccaataatgtgaaacccaaagcagatgcatcctttcattaatgtggggtcccctgagttcttattaagcaattttgacatagtttgaagagacggatttcatgttcagacagtgttcagccgccaatggctgaaaggcctgcttttggccacttggcatttagactccattatttaagaggggaaaaatatgcctgagactgtttttcatatttattgtgggacatttagagaatctcagactagcaggtgttagattaaacagaggagaaacggtccttgtggtgataaaacttccctacgcaaggacaagtagagaaacaactgtagatgaagcagccagtctcaggctggggcagcacgccctgcgataggttaaggtttattttagacaaatatttaaaatgcagctaatttttacatatgcagacgcaacccagtggaatagaggtagccccagctttggagtcatacagatctggggttaaatcccagtgtgaatactaactcactcggtgtccctgggcaaatctggtcatctctctctctcttttctttttttgagatagggtattgctctgtcacccaggctggtgttcagtggcacaatgatggttcactgcaaccttgacctcctgggctcaagtgatcctcccatctctgcctcctgagtagctgggactacaggcttatgccaccacacctggctaattttttttttttttttttttaatgtagaggaagggcttcaccacgttgcccaggctagtctcgaattcctctgctcaggcgatcctcctgcctgggtctcccaaagtgctgggattacaggcatgggccatcgtgcctggccttagtcatctctttgaaccttggctgatttacctgcagatgctaatatgactctcagattctggcacatagtaaagattcagtaaatggtcgttgcagggaaagctaacttgtccaatgcagatctgtaaaatatactcataaatcttgttggagcaatatttcttctttgtcttacttcgggctaataacaaaaatatcatacaatgagtggcttaaatatttattcttacagttctagaggctggaagtccgagacgagggtgccaaccttgttgagttcttagtgaggtccctctttctggtttttaagtagcctgtttcttgctgtgtcctcatatggtggagagctgagaggaattgagagagagagagagagaggtcgcactgtctcatgtgtcttgtaagggcactaatcccttcatgaggattccactctcatctaatcacctctgaaaggccctgtctccaactaccatcacatgggcaattagggtttcaccataataattttggagggacactgtattagtccattttcatgcttctaataaagacacacccacgactgggaagaaaaagaggtttaactggacttacagttccacatggctggggaggcttcagaatcatggtaggaggcgaaaggcacttcttatatggtgtcagcaagagaaaaatgaggaagaagcaaaagcagaaactgcctgataaacccatcagatctcttgagacttattcactatcatgagaatagcatgggaaagaccggcccccatgattcaattacctccccccgggtccctcccacaacatgtgggaatcctgggagatataattcaagttgagatttcggtggggcgcagccaaaccatatcagacacaaacattcaattcacagcattctaccccagccctccaaaattcatgttcttctgacatgctaaatacatttattacatccaaatatccccaaaatcttaactcattccggcatcagctgtaaagtctatgtctttttaatttttttaaatgatcaaagcactgggaagtagccacttctttcctcagcttcccaccaatgtgtcaattaataatctgactaaggtggccgggtgtggtggctcacacctgtaatcccagcactttgggaggccaaggcgggcggattgcctgagctcaaaagctggcgaccagcctgggcaatacggtgaaaccccgtctctactgaaaatacaaaaattagctgggtgtggcggcatgcgcctttagtcccagctactggggaggctgaggcaggagaattgctttaacctgggaggtggaggttgcagtgagccgagatcaggccactgcactccaatctgggtgacagagcaagactctgtctcaaaaataatagtaataataataataataataataataataataagaatctgactaaggttattaaccattaaggtatgctgtgctaaggagcagggggccccttccatccgtagagggcagaaaggtgcctatcatgtcttcagtgtcagtgccctggtatggagctagctggccttccacaggttctggagttaatgctggagagaagtaggggtgtcagagcctaccctgtgttcctaggggggttcatctggagctagtccctgacccttaggtggaagatgcagctatgcccaaggttctgaagaccctgtaaaaggaagccttagaagtggctgcgattgttttaaagtctgtccacaaattctttgataattctcctttcaagaagtagaggccagttctcctctcttggaatatgggctgtacttagtgactcactctccatgaatagaatttggcagaaatggccgggtatgactcctgaggtaggtcctaaaggcttcgtggcttcttcttgctcactctcttggatcactcaccagccaccatgttgtgaggaaactcaagcagacctgaggtgaggcccatgcaacaaggaattgaggccaccagccatgtatatgatcccccttggaatcctccagcccagtcaagccttcagatgactgaggccctggctgattcatgtcatgagagatcctgagtcagaaccacccagcagctaagccacttctgaatccttgacccacaaaatatggtaagataccaaatggttactgttttaagccactatgctctgggggaatttgtgatgtagcggtagataactatcacaggatccatggcctcaaggggagaaggatccttaagagagactggacagtgagttctaaggataagacatgtatacttacccaggaagctccactgtgtgcaaggaatcctaagttcccggggttgcatccatctcccaggtcaccttgtttgacctctctccaacacttttaaaacatacctgatcaggaatcaccccgctttggcataagttcctctctccccatgctgcccatcccatttctgcacacctcttaattagtaagttctccctcatattgaaggcagaatcttcctctgagcgtcttctatgcaccggccctggtcctgccctccgagttccactggctgcattctcatcagaacccagctaaaactcacgtctctcaaattccctaaataataaatccaaagttattgaagatattgggatactaaaagttggcagtgagactggccccactcatttctttgtaacccctgtccctctttttattattgaagcttgggatgcacttggtaaggctaggcagctggagagcgtgcagactcaggagccaagacctgccttgccttccctggagttaatgaatcagtgtgaatgaagagcacagtcttcttttaaatggcaggggaaccatgcacttatttaccggcaattctcagattctaattgttccgactacaatgcgtcctgtaaaccgggtagctgggagaaacttcaatgcatctttgtaatggctttgttgttgtttattgagagggactaattaactttgattattgcactaatattatggcactttgacagcccttcagatttatgactctgggaaaataaacaaatgaaatgcaggtgctggagcagaaagaataagttattactgaactttaattacttggaatgcgtagccaggagagaattagttgatgaattacaggatgcttaaaatctacatcaaattgcaagcaataagaagataaaaataaaaaggaaggggcaggaagggtgctatttttaaggcagggaaggataggatgcatttgcagtggtctccgtggtgtttcattgattaaactttgtggtctctaatgctgcagatatgtacatggtgctactcaaagcatggtccctgacctgcagcatcagtgtcacttgagagcttgttggaaatgcaaattcttgggccccaccccagacctactaggtaagaatctctggaggtagggcccagccatctgtggtttgcagttactccaggagattttgatatctgcagaagttgagaagcatggctcaacagttctcatgcagcttgctttttcttttataaaagggcgggtacacatttttatctttgcttatgaaaatcaaatgttttcccaacccagtttaccaagtagctcccaaattttcaagctattttaaaaattggctgaaatttaaaaattttgggcaattttaatttatccaacatctattacgtgctaggtggtagagtgggtgacacaagatagtctagaaggattttgctaatgaggtgatacccctaaactgtcatcgatgccagcgcctgggtagtgtggtaagagtgatactcccatgactcatgaaagatggtctccccacgtgctttaaagcaggatggttgcaggagaaagtattggtggactgtgaacagcccccatggcaagggtgcatctggagctggaggaagagcatccacagagtgtaagtagtttgtcctgggaatggagatgtcaggcttgggtgtggtgtcggggagagggcaggcagctcctctatgaggccagatcattcggggccttggattccagtcttaggagaatagactttattctctaggtcctggcagccatcactggctgagtctgagtggtggtgatacagtccatactcagtgactgagatagacagacatttgggctgaattagcgaggggagtgcggggtctggagactctgttggcctgttggccatggtcctgggcgcaaagagcagaaaaggacgagacggggactgaacagacttgcttagttcctgacattcaaggaagaactttaacgtccatccacggagcctcaaaggctaaaaataatcatccctttcaatagttcctgttgtgaggaccattaacaaattataagagaaagcattcctcacttgtagaaactccatgaaaacagacatgtgtttacttatctgcaaccctgtgttaggaggagggtgatgagacactttactgtttgaatcaggaagtgctgacagtgaagggaggagctcttcataattatacccggagagcaggcaagacagccacatgcaagtggcctggcctggctgggtttggtacagaggggattagggcagattcaaacctcactggtcccccgtcccagcacttctgtgctgtctgcagttactaagcacttttcctgtttaagttgttgctgttttcattcccgcaaaagctcagccagcctctagcccaaaattgtctctgtttattggacagttggaaatgtcactgtggccccacagaccttgttgtcaagcaggctgctacgcttttattctagagcgtctttcatctgatttcctccaccatctggaaccttctggattcttcctcttatgggtagtgatgggcactttaggagtaggaatacatgtcagtgctagaccacatcctttcatacccggaattcgcatagtgacatttaaaaatagatagcaggccaggtgcggtggctcacgcctgtaatcccagcactttgggaggccgaggcgggtggatcacttgaggttaggagttcgagaccagcctggcaaacatggtgaaactgtgtctactaaaaatacaaaaattagccagttgtcttggcgcatggctataatcccagctgctcaggaagctgaggcaggagaatcccttgaacctgggaggcagaggttgcagtgagccaaggtggtgccactgcattccagcctgggcgacagagcgagattccgtctcaaaaaaaaaaaaaaagtaatcattttagaattgctttctcttcgggatggtttacctcgtgtttagtctgtaaacgcggataaccgagagctggtcaaatgtttacatggggctgtggaccattttgtatcattggaggagaagccagggcacttggcaggggtgttcatgatgataatcaggtggctgggtggagtcaccatttgtggcatcctcaaagacttgccaacatagacatttttggggagacagaaacacagaaataattctgcagtgctttaaagaatctgttaaaaatcaagtttctttcagtcatgtatgatccattgggctttatataacttttagcctttgctttgcagggacagcaaagatgtgagcaaatttgtgcaaacctaatagggtgaaaaattgaggtatgaattagtaaagtcatttgtccttctggaaagagttatggattaacagattacatttgggtatattgtggttgtgaaaaggtaacattctcagattggaaaggactttctgagatcatccaacttaactttccccacttgacagacaagaaaactgaggcccacagaaggtaacttaggcaattaattaattatagttaataattaattctgcctgcagaacaggaatatggcccccaacgcttcatgcttaattggatggcttattaaattcttatttttatggtagtgatgatgatgataataataataataacagtagtagctagcattgttttccagtgctaagcactttaaatgcattaattcagttcatctttatgacaacactatgagatagctaatattatgaatcctattttcagatgaaagactgagtcttagggaacaaacagccgagagatgaaatgccacagggatgtctaggttcaaacagcaacagaggtgcgtaccatagggatgtggaagccttgcttgtcttgttcctcttggtataaccccagtgagtagcatagcgcctggtcaattggagggatttggtaaatatttactgagtgagtgagagggtaaaacagctgagccatgggagttataacttgggcagcagtaatcctgccattgtaggaggggacagatcggctggttagtttttggaaagcagaccagcagaagttgcaaataacttgttgtgttttcctaagtactgagctgtgtgaattggtttcatgttgatgttactgaagtctccccaattcatcatctaccttgtagcttgttgaagaaagagtccttatttacagtctattatgttaaacgtattttattccagttctttgaaaatgacccatcctgatttggaaaatctctaacttgcctggtcattctggagcagtgggagccgactgtgatgcagagtggactcataatccagcttgattttgagggacagaaacctgggcctttaggtagaatgaacagcttaaaaggctgcacctgagagtagggggcatatgggtaaatccagctgtacccaagagttgggggcatatgttagccctactgggtaaatccagctgcacccaagagtagggggtatatgttagggctagtgcgtaaacccagctgcacccgagatatggggtatacatgagtgctattgggcaaatccagctgcacaggagagtaaggggcatatgttagggctagtgggtaaacccagctgcacctgagagtaggggtatatgttagggcttgtgggtaaatccagttgcacctggcagttggggcatatgttagggctagtgggtaaacccagccgcaccggagagttgtgggtatatgttagggccagtgggtaaatccagctccatctgagatatggggtatacatgaatactagtgggtaaatccagctgtacacgagagtagggggcatatgttagggctagcaggtaaacccagctgcaccccagagcaggtgtatacatgagtgctagtgggtaaatccagcagacgtccggactgtgcttgagggtgtcatcgagagagagaaggttgatccgaagttagtaaaggctttaaaaattaaaaggcctgagatgatggtagggttttggaggtaagtataaaaaccttcttgttttctactacttaaagctgaaaacccagcttgggttggctttgcttctaatatccttcttcctttttgtttcataagtaattgtcctgaagcctgtcgagataaatgtatactgaaagagaaagacacagaggagagacaggcatacagagaaagagagacacgcagacacacgaaggggaggtggagacacggaggagggacagaaagacagagagagacagaaggagagagagagagagaacctgtctagcggtgtttttatgaggtttttagtgctgggctttgcatcgtggtgacggtgtgtgtgtgggggtgttgatcactgttttcagtgttctctgatcatttcttgcttagaaaggaggaaattagaattgttgagctatgatttgttttaatcagaaagaaattgtctaacataaatctcttcgtgagctctggaaaagcccctaaagcggccaggaaaaaaatatcaatactttgcaaaggaggaatgattgttccaattcgtggcttaattgactttaagccttaatgaaactaaggccggagcgggtggcacactccgtggctgggatccacagtgaaatctacgctgggagaggaggaatttagggtggtaatttggttctttgctattgacgaaattttctaattgactggggttacttaataccagataatatttttttcttgctataaagagagtaaatttgtttttttctgaggaacacaggaatttattttaaattacagctttttctattggaagcattcatttatgttggattattgttccctgagtgaaatttcactgatgctgtataattaaatatagatttttttagagatagtatatattttagatgtataagtggataaactggaggtatggaaggtctttatttaaggagaataaatagcccaccccatcaacatgatggcccttggaaaggactcttttagcctccgcgagttccttttccgcaccaggctccacttacgaaggactgcaaaaacttgctaacgtcatcagtctgaaaggattgagctgtaaaatgtgttatgggggcctaagcaacgcatctggaatttagccttcccaagttcaaatccggtttatgccacttgcgaaaaccatgtgaccttcacttgttcttattgcctcagtttcctcatctgtaacttggggatgatgacagtatttggatcacaagattgttgtgaagatgaactgaagtgctaatgtgaaatgttcatgatggtacccgagtacttgcggtggtacctagcgtgtgctttccaagtgctggcaaagaaaagaaaagaaatgcttggggctctgcctacctgtctaggctcctgtctggccattctctttcttgttccaaccatatcaaactcactgctgttgctaaaccttcctgtctctctgcatcttggcacagactatgtcctctgcttggaagggtctcagctaagcttttcctccccacatctgcctctgtatcctgtgagtctctgttcaagggtatctttcccacaaagctttcctgggcttctctttcctgtctcctgccctcccttccttcttttgttcagcacatcgctgtcaaccttcttctctgggtcaggtagagcactgagcaccagtgatatggcagtgataaagaaagcaaaggttctcactgggtgtggtggctcacgcctgtaatcccagcactttgggaggccgaggtgggtggatcacgaggtcaggagatcgagaccatcctggctaacaaagtgaaagcccgtctctactaaaaatacaaaaattagcagggcatggtggcgggtacctgtagtgccagctgcttgggaggctgaggcaggagaatggcatgaacctgggaggcagagcttgcagtgagccgagattgcgccactgcacttcagcctgggtgacagagcgagaatctgtctcaaaaaaaaaaaaaaaaagaaagaaagaaagcaaaggttttttcctcccaagaactcatggtccaagttttggtttttaaatatgcatctatgacagcacggatcacatagtgcattgattgtttgcctgtaggtctccttatttagtcaacaagcatgttttgatcctttattctataccagccgtcccactggactctcagcacatataggtatgcgagacgttgtccttgccctaagtgtggagacagacacgtaaattaatagtaataataatatctaccacccactaggggtctatgtgtgtatgtgttgggggcggtgtggctggggagggaagcaaggcctgtattatggcccaagctcaagaatattcgggcaagagcagatacaatgcctgtatttctcatcacttttgggtggcataggaccagttggttatgagcgtgaaaggttttctttgactttggtggtctagttagtggttgagaacatggattttggaatcagcccggtggaggttggaatcctggctgcgccgttctgtagcagtgttgtggatctcagacaaggtgttcctgcatatgcctctctatcttcctacaagaaatggaggtattgcatccccgaaccgtaggatgcttgtcaggattaaatgagataacagtgcctggttagtggcacatgctcagtaacacctgccaagtaccactcactgagccgaaatctcctgaataccaccccttcatgccttgcacatcctgggttctaactcattgaggtgcccccacctttccttcttcccatcaacaactcttgtgcccacgagggactggcctcctcagtgccacacagagcctcccctgagtagatttgtgtcattttcaaacaaagcatcctggctgcagtgttggattttgtaggatggtgaccgtttacagaaacctctggtccgtgagccaatttggagaaaattgaatcattctctgtgcctttcggcttgcatcctaaaagcctgcacaaacactttgggcaggcttcagcaacttcacatcaagggctcaattgcagctccaatataaaaacctcccccgttgctctctgtgtgtgaagctggattccatgcttggcacagacctcggtgctcacggtaatgcttccttccaccatatcagaaggtcctcagcagccgcagccacttaacatgctcggtgcttctctgtaggaggatttttaaaaagcaggaactgtcagggtcccaaatgttcagtggcacttcagccagaggtaggatagggattttgaagtgtttggagaagtgttttcatatttgaatttacggggatggggtgggctggggtaggcaagggacagactgtagcgattcgcttggtgttttctcatgatgccagagaaaatgacctcattatcatcatgctcacattcacctttgccaggacccctgtgtagaaataatcatgaacttagtgactgacaatcataagcgttttatgatttgtggaggatttatatgtgaaggaaaatggatgaattaaaaatattaaacagcttagccggcacccacatggatgaatcaccgagatctattttttccccgtttatactataaacatatggcatgaattttctgctctcattacagatgctgagagaaggcaaagacaaatatttatattacattcatgttttacagtaaaaacactgttcggtttgtttacacagttccactgttacagtttttatggtcggtaatgcaaccaccgtaaaagcaagtctgggttatatagcagatgtgataagccctcatactcagagagatgtctgggaaagaatcgttgatgtcacatgtacaggatcaacaatggaattatgtgttgggacagtctaagttatgctgtaataacaaccaacctcaaaatctctggggcttgaaacaacaaaggtttatttcttgctcaaactgtattttcatcatgagttgcttggagggatctgtgagatggggatctcactcagccaccggggcccacagagcagcctgcactgctggatgttgtgacagaggaagagagggatgtgctgaccctcgctctggctcaaaagtgactcctgccatctctgctcacattccattggccaaagcaagtctcagggccaaggagtgggcagtagtagggtgctgtgtgtgtgtacaaacccaccatatgtgcatagagggaggccgagaactggactatcagagaatagccaaagatttctttccacggtcatgtcaagcctttttgctgttatttaattgatgttctatttttaatgcaacatggaatcagaagaatatagaacaggcgtcaaagaccctcccgcctctgtaaccgcactgtttaaaattgatgagactctgtcttcattcgaagatgatctgataggaaggattcacagctttccccaagaatacaccacagtgcatacaaatcctcgaagccgcagaactttttcaagttgaactgtgaactgtgatttttttttttttttaagtaagtttacatgtagaagctcattggtagagagctttagatatattacttcccagggtggtgcatcctgtcaccatgaagtaggcatgaaatgctggagatatgcgttcattcaaagaaaataaaaaggcgcaattatgaaaagctctcaaagtgactttttattttattttttatttttacatggagtctcgctctgttacccaggctagagtacagtggcgtgatctcagctcactgcagtctccatctcccaggttcaagtgattctcccgtctcagcctccagagtagctgggattacaggcacccaccatcacgcccagctaatttttgtatttttagtagagatgggtttcaccatgttggccaggctggtcttgaactcttgacctcaagtgatccacccgcctcggcctccgaaagcgttgggattacaggtgtgagtcagagcacccggcctcaaagtgactttaacagcaacttaaaggcggtggctagctctgccccattcagtatggtagccactggccatgtgtggcagttgagtgcttgaaaggtagttagtccagattgaaatgagctgttgatataaaataacatgactcccaggtttcagacagtataaaaaaatcttaattaacatttttatattagttccatgctgaaataatatttgagacatactaggttaaataaaatatcattgaagttcatttaatctgtttctttttacctttttttttttttgacacggctcctggaaaggttaacaatatgtaggtgaccctttattttcatcagacattgccgacctagagggtaaccactggagaggaaaaaagtacaatttggtatttttgtcacaaatccttaattgctagaactcacagtttaacctgacagttgatcaattgatatcctttgacttgttggaattttattctttacattcgtcttttaaaaagctttattttatgccagatgcagtgcctcatgcctgtaatgtcagcactttgggaggctgaggcaggtggatcacttgtggtcaggagtttgagaccagcctggccaatatggcgaaaccctgtctctactcaaaatacaaaaagttagccgggcgtggtggcacgtgcctgtaatcccagctactgaggaggctgaggcaggagaattgcttgaacttgggaggcagaggttgcagtgagccaagatcgtgccactgcactccagcctgggtgacaaagtgagaccctgtctcaaaagaaaaataaataaaaagctttgttttaaaataagtttagattctcatagaagttgcgaagaatagtctatagtattcttcacaagggttctgggtacccttaacccagcttccccagtgatagtcacagcataacaatcaagtctgggaaattgacactggcatgataatattaactaactacagattttatccgagttctgctagtgtttgcatgtactcatttgtgtgcggctctctctgtgtgtgtgtagttctatgaaaagttataacatatatacatttggtttaccaacatcatagtcaggatacagaactgtcccatctccccaaagaaacaccctttaccttagtttttattctttgagttatatcttaaccaggttaactgagggtaattgtcttaggcaagttagtaccaaatgatgctcttggttccttgtctgtctttttgcccatccaacccacccttcacacatggccgagttatgccaaactttgcaagaggtgccaggtgggcacaaagaaaagaggactgcactcaaggaacttagtctttgaggccaagcacggtggctcatgtctgtaatcctagcactttgggaggctgacacaggcagatcacttgaggtcgggagttctagaccaacatggtgaaaaccagtctctactaaaaatacaaaaaattagctggccgtggtggtgtgcacccgtagtcccacctacttgggaggctaaggcaggagaattgcttgaaccgcggaggcagagattgcaatgagccgagatcgcgccactgcactccagcctggtccacacacagagtgagactctgagacttcgagactctgtccccaaaaaaagacgcaaaggagctcagtctttgaagggttacagaaacagtttcactagaaggtgtgacattgtgtaacagaaatcggttccttaacctgccaaagggaagaaaatagtgcggaatcttttctccaggtttcaggacccatgtctgttgtccttcctttaccttaacttcagcagggcaagaatggttcaagccacattagaaagcagttactttctcacccaattttaaaggagaaaggtagatgcggtgggttctagggatttcagtgacgtaacaggtgtttcccaggcattaagacctagtaaggtttccatttccattaggtattatggatgcattccaagaatttaattactataacatcacttcattcattgtaattccttactagagttatgagaacttgggattgtgtggtttcttattcaatcgattaaaaggtacttgctatagttttctaactagctatttatatgaaatttagtacttgtcaatatgtattaaatcaatacagttatatttatcaaagtggtgagaagagtttacatctgaacatagaatagattgcttgccttggccgggcgcgggagctcacacctgtaatcccagcactttgggaggccgaggcgggcagatcacgaggtcaggagatcgagaccatcctggctaacacggtgaaaccccgtctttactaaaaatacaaaaaattagccaatgtggtggtgggtgcctgtagtcccagctactcgggaggctgaggcaggacaatggcgtgaacccaggaggcggagattgcagtgagctgggattgtgccactgcactccagcctgggtgacagagcgagactctgtctcaaaaaaaaaaaaaaaaaatagtagattgtttgcctcagttgggaaaaaataaagttttaaggctctagaattggagtgactcagctttacttgaaaaatcccagaatagtaggaccatcatttagaagtttcgagacgataatattagggaaaaataacagcaaatgttacttgatagacactaaactctggggcatatgagatgacccaggctggaaaaccactggcttacataaaggtattgacagacccatgggtgttaagatccttcatggctactggggagaaatgacaggccttttgaaatcgtatcagtggttttccctgggatcactggaaataatacccctgtttgacaagatatgacacatgctctgttttaattctgcatttgactaacagaaaagattggtgaagatcagactctgctttaaagttattgaagcagggtacaaggaaaaggggaagggaatagaggctgcagaggagaatgggggaagggggcaggaaggtaaaatttggaggtgcaggcagagtcaaggtcatgcctgaggcccaaccttcctgttgaagctggtgtttgattcaagctgtggctgagaacgtgcagctcatctggagggtagagttgcaagacatgggttcaggtctgagccaagccagaaactggagaaagcgtggcttctcaagactaggaatacctagattccagaggtggcgtgggcatggggcacattgtgacaagttaacagcaagatcttcagagctgcagctcacctgtgccacgatggtctcctaggagccctttcctgctgtagtcccgccccgaggggtttcacttcccactgcctcttggtagccgtgggcactttggtgctctgatgatgtaacatggagattgtccttgtctccatcgctgtctttactggtgtatgcccatgaggtatgtcaaagtctgtatgtctttgtaataatgctggatcatttgtccaccttcagagacaactgaagacagttttaagtgaaaccacacagagggcatataccattgggacaagaggtctgaagtctatttttgagaaagagaagagatcaagtagttaacagccagtggctatcataataatggcacctaaacaaatccttcttttttattttatttaattaattaacttatttatttttgagttggagtcttgctgtgtctcccaggctggagtgcaatggcgtgatcttggctcactgcaacctccgcctcccaagttcaagcgattctcctggctcaacctcctaagtagctgggattacaggcacctgccaccacgctcagctaatttttgtatgtttagtagagacgaggtttcaccatgtttgtcaggttagaccggaactcctgacctcaagtgatccacccacctcggcctcccaaagtgctgggattacaggaatgagccaccacgcccggctcaaatccttcttacttttcctcaagaactcacttcccacccaaacctttcctattgtggcagctgttatcttgtccagcacatgtgtccacacttggtattaatagctccatcttaggaactatgaaagtgaggggggtggtggtaatttgcatgaactggtttgggccagttatggtctgttacatccttgctgaaatggttggtgctaagatgagcacttggcttaggccagaccagtccctagcctgtggagaaggggcaatctcttatctgaaggcctaggaggtgcagggatgtttatatgggctgctagcgcttagtttcctgccacagggagacagtaagaaaggtgacgtcaatctgagatgagagagagagcaaaacagttcttttgaccaccttgaccccgaccttgaaataaggtggaactaataaatcccgctttgtgctggagcaagttttggctgagtttctgtcacttgcaaccaaatcagtcctatccagtatacctagtgactctctggtctccaaaggctatgcctgctgggtactgagtgtctccccgaccgaccccatgatggctacagtgcacatcccttccagccaactctattgtgcacacatattcgtagggtgagttgggccccaggtagagtgattggctcagatcctgcatcctttcagggtctgactgtaatcacactggcatggcagggggaaagtgtattggatttcagagtcaaaaaccacttggtatgaaacccagctcattttctatgtggatgtccaacctgagccagataattaatcttggagatgacgctgcatacttcatcaagttgtaaagttgactgctgtgataatggagaatgctggacaggctgcttttcatgtcatgggttcgctatactttagttcccattatatcatcctgccaatccccatttgttgtttttttgggacccagggtatcagtcatctgatcattgtgtgactttctcaaggacctttacttgagtcttgcacctctggtccacaatgtccacataccagcttgatggtgacttgtgtcattctccatccccttgttaagagaaaatctactttatgagccctctttccaaccgcagtgttgaggactagaccaggcaagatgatgccgctggaccactggatccagctggaccgctagaccacagagcccctggagcctcccaaggccaagcccgccagccacacacacctttgtgagaattaagaaaagatgccccctcctcttggggcccacagctcctccacctgggcacccagcctggtgaacagggtgcaggctgggatttagccctaccttgcttttggaccattgagctactaagttggagcaacaaggcttgggaatttttctttgatcataggtaggaaaggtaaaaaaacataaatctgccaatagaaaatagcatcgtaatgagtttctactatatttgtttgggctttgaaaaatatgccgccacaatatatcaatgtatggtcccaacgttttaggaagttgcatttaaaaaatcttggatacctgttttgtacatattatatatagcatcccgtgtgaatatgttaattcctttttatgagtttcggtcttttttccctctcctatacatgattgctgttttatagctccagtttggtggaattaacatagatttcccacatggggaaggttttgggtgaggatttagaacaaggcaggttcttgatcctcggaagagattcttatctgagaggggatttgagaatggcattgcagagtgggaggcgctgctgtgtggaaaaatgaactggaataattattagaacagttctcagaatttacaggatatttgatcataggagtaactttcctcaggagtgatggatggaatgcctgtacttggaatatttttaaattaatctattttcattacattgaaagtatgacacacagagaacactaaaattggatgaggcactacctggaattatataaagaatgacaaagatgcggttatccatttattttctaggcaagttagttagcctctctgtgtttctatttctttgtttataaaagagggacaaaaataggacctattactatctaggtgacaggatcattcataccccaaacctcagcataatgcaatatactcatgtaacaaatctgcataagtacccccttaatctgaaataaaagttgaaattattaaaaaagaaaacgaaggccgggtacggtggctcatgcctgtaatcccagcactttgggatgctgacgcgggtggatcacatgaggtcaggaattcgagaccagtctggccaacatggcaaaactccgtctctactaaaaattcaaaaattaggcttggtggcacgtgcctgtagtcccaagctactcaggaggctgaggcaggagaatcacttgaacccagtaggcggaggttgcagtgagccgagatcgcaccactgcactccagcctaggtgacagagtgagactccgtctcaaaaaaaaaaaaaaaaaaaagaaagaaaacaaaaacaaataggacccatatccctggattgttgaggaaatacgtgaacatatgtggcacacattatagtgtctggcatacaataaatactttgtaatgttactggtgtcttcttaccgttattgtctcactggtgaccgtttgaaatgttgaagctttattgttacagataatggtggatatagtctcttccttgtttattttttgacagaatctttttttaaaaaagtttttatttgtttggtgagaatttacttgttacaggtctagtgctgttatagttgaatgttttgaattatgtaacttaagtgaaacataaagctatgacttgaattttgtggttagaaattttctcagtcgattgacaaggatggcgtattggccaccttttgccgcagtaacaaacaatcccagactctcaaggcttgcaaaaataaatgtgtgtttgtttgctcataacacatgtggctgagggttggccgtggctccacagtcacgggtgggctttcctgggctcagcttctcacagcgtctccttgcagggcccaggctgtaggagatgtcatcagggcctgcagagggcaaaacctcacagaggcttctgttcatacattgttgtacctcatgtgtgcgtcatattgtcatatatcaatggcagtagccaagaccaacagccaagaccaatgtattctgcccacaggaaagtgaggcaaaggcagggagggaatgataattgtgaacaaagaattcacttgaccaaagatggttttcttgatatggttgccacttacctttcagtaaaatagcacttcacaaatttgtttaatgttttatctcaagctcccagaagtagctaaaaccacgaacatacatgttgaaaatttcaaaagggaaaaaagaaaagaaaggcacatctgagtcaggaaaacattaactagtcttatttctgagaatcaaaccggtggtcttttcagtgatcagtcaccccattaaccacacatgaatggcacaagtaggaaatgcctgcttcaataccaagaagctggtcttatttagatctagtcttatatcattgaaatatcattagaattcttatggaaaatatgttttggctgtttaggggatgctaggggctggaagtgagaaggtttcaacaccatatgggtatgtgagtatagatgcttacaagaagaagggtagacttagccaaaactaatttgggatttttgtttgtttgaattgttggagggtggatgagagtgaagacatatccttttgaaacttaatttaatttttatttattattattattattattttcaattttttatttttattattattattattttctattttttatttttattttttgagacggactctcgcactgtcgcccaggctggagtgcagtggcgtgatctcggctcactgcaagctccgcctcccgggttcctgccattctcttgcctcagcctcccaagtagctgggactacaggcgcccaccaccgagcccggctaatttttttgtatttttggtagagacggggtttcactgaagtagccgggatggtctcgatctcctgacctcgtgatccgtccgcctcggcctcccaaagtgctgggattacaggcgtgagcaacttaatttaattttttaaaacaatatatgtctctttggagtcagggtgtttgttacagtgatgttttgcagacaggtttattggaactgcttggtaggtgataggtttttctttctgttttttaattaaaaaataagattggccgggcgtggtgtctcacacctgtaatctctgcaatttgggaggccgaggcgggtggatcacctgaggtcaggagttcaagaccagcctggccaacatggtggaaccatgtttctactaaaaatacaaaaattagcctggcgtggtggtgggcacctgtattcccagctactcgggatgctgaggtgggagaattgcttgagcctgggaggcagaggttgcagtgagctgagatcatgctactgcactccaggctgggcgacagagtgagactccatctcaaaaaaaaaaaaaaaaaagatttatgtcaagaattcacatttctggcctctcttaaaaatattggaagacatggcaataattatctgggactgaatagcagctgcttctttttgggacaggtgatcacccccaaccccaaacccctacccttaactcttctactcctttggatgttatccctgcctggtttaaccatcaaccctcttaactcccgatccttttaaacttcctctactctttttattcttagcacttagaacccactaacgctctatgtaactgtcttacgtgttccatttcttgtttctagactgtctccctccagtagaatgtgcgttctgctatacagcagtgctgtgtgacgcgatagcaggtcctttttaaacatctgttgaaggagaaaatgaaggcacacgtggccttgctgacatctgagtttgcaacttcttttatgccttctgctaactgggaccccagtgggcttccctgctacaccctctgaggttccccagtcctgccaagctgttccatccccagttccttggtgcctgctggtacttcaccctggagagcccagcccttccacttgttcagatctcagtctctcatctgggagggacagcttgagcactatgacctgtgtgaagcttttcccagtgctggcagactgactggaacctgctccttcattaaacctgacagatgcctccacctggcagttctaccctaagaccatgaacttcttgagggagggagatgtgacttttcatccctgggacccagcagctggctcacctcctactggttagtgggtgatgattggatggcttccgaatgaactcaggtgtcttaagtaccgttggtcctgacaccatggccaccttccagaaatttccacatgttaagattgcagatgcaggctggacacattagtgatttctaagtgctaagaaaaaaaaagagcggctcacacctgtaatctcagcactttgggaggctaaggtgggcgaatcaccccaggtcaggagtttgagaccagcctgagcaacatgacgaaaccctgtctctactaaaaatacaaaaattagccagacatggtgctgggcatctgtaatcccagctagttgggaggctgaggcaggagaattgcttgaactctggagacagaggttggcgtgagctgagatcgcaccactgcactccggcctgggtgacagagcaagactctgcctcaaaaaaaaaaaaaaaaaaagaaaaaaaaaagattgaacatgtggaatatgagacaaatgaaaaagattgaattccgttccaactgggcttttgaatttattttcgcacttcctattttttgagcccgggagtgcaagatgtaagctaagaaaagataagatgaaagtattgctctaacattctggcttccttctattagagaagaatgcaaatctttgccttatctcgatgatgggccccacttaaccctttgttttactgagagcacttttctgcagatgatcaagtggaatttactatgatggcctgtcaaatcttgaaataatctacctttaaggaagaaaagtttaactagatgattgtaccttttagccatatctacaattaatttgaatgtattgcaagctgtttaaaatattccattagtgaagaaggtaagcctagcttctggtaaatacactactaagtgtttatagtacatttcatattttacatgatttcctttataattctgcttatcttttcattctaattccctgaaggacatataaaagaacccctaaagagagtaattactgctgtactctttaaccaaggctccttttgcaaagagaaatctgagctgctttttaaagaaggccgtttttaaataaaaatgcaaataagctactttgtaaccacattaattacccacctagcctcttattaccatgtttgtattgtttgcaaatactatttacagtcgtgtggaaattaacattactggtcctgaggaaagattgtgttggggaggttgtgctttggaaccaattagggcgaaccttgtctccactgagactctggggaaaagcacagccttgcaatgtcaaataatagcattagctctgactgtacaggcagagtgctgtaattatattattggccctattttgcttctgcaatgaatttcattgcctgcattgtaaaatcagcaggtagcaaagtttctgctaatgatttaatgtactctctgatcattttggacaaaagtcatggtaagatccacaaggcaattttatcatccccactgactactgcctggtttaagcattttaagtgaagacaaaacatgattctcatctccttgtttcctggtgaattccttcccacacagaagagagaattacttgtctaatatataatttcaggcataaggagaaggtgatattgcattgcaaataatagcagttagtgggagttgagagccagctctgcaccagactcgtatcagccacttgacctccattattccttattccttggtacctctgcgccatctgtgatatcagatccttttttctgcaaggaaactgaggctcggcgatactaagaaactcagccagggtccgtcagctgtcaagtggcattgctggcacccagattgagggccatctgactccaaagccacctgactctttcccatataccacagtttctaatacgatattataccaagctttaatatgagcacacctcctggatgatgctgtaaattagttgcctcccaccacaccacatcaagtataatggatataatatgatttttcagaattcagctaattacctactgagctttacattttgtaacttttttgactgtccatcaaaatgtctttgggattaaaaatttttttcatatgttttgaggtcaatttgaatctgagtttaataaacgttaccatgaaacatttctcccatctttttaggaaatatctgtgaataaactcattttgtgatagaaggctgtgtgtttatccagttttcatcctaaggagagggggagaagggaaataatacttcacgtctttattgcatgccaaacgtttatagacattatatgatttcatcctttaataaccccatgaaaaggatgtcattgtcttcacttgacaaatgagggagatggcagtgcaatcaagacatactgacaaggagaggaggtgagcgacttgcccgaggccacgctgctgataccttggcagaagcagaatttgaaaacagagcccccatatgttttaactgctcattggaaactgactaggtcacatactcctcctccttccctgtactggtagtttttcttttattttttttttaaatttcttccattttctttcctttttacagcaaatttgtagttatggtggagcaaagggcagttttcactcctcttccctaaaactgtagtttaactaaaaagtggccactgtctcctggtagcggttggtaagccatccagtctctgcaggcatctacgctccaggtctccagtctgaggagtctggctcctggggcaggtgcctctgggggtctctgccaggcttgtctggtcatgcagctacttccagactgattcctagatcttgcatttttacataggacatccccagcattcaaagaagatcctgggaactggattcctaccagaggaattagaatgaaaccaacaaaactaaaaacgacaccctcccccatcccccgcatccgatacacatgcaaggtaatatttgatgtcagtaggaaaaaaatccagtgttataggagacaaaccatagcaagcaatggcctctcacccttcccttcacaccctccactctgtccacttgtttgttccttcaataaatactgatggagaatgggctctatgccagtgtttctctggatgttggctgcagggatgaacaaaggcaacttctaggagaaatttctgtttttgatgctctcgtggctgcttcctgtgtcttaatattgtgcttaaactgccacttcttcagctgttgatttcaggcactatctaatgacttttgctgttacgagcatggatttagctcatttttaccatcttccctagttgtatcaccttcctcccattatgtttgtaacttcagattttgtatatttcgcatatgtcaatatgtaaacattttatatatatatatatgcattcacacacatgcatacatatatgtaatggtatatatacatgtaagtttccatttttgctcaaattgctctggacagttctttgctctgggagttctttactccctttctcataagaagaggctgtttgtaccctgatcaatccctctacctcttcttttcccctttcacccgtaacttctgctacttatacttctgccttatcatggtccataacattcaccttccactctgtagccataattaaatctcccatgcatcccactttgggaggctgaggtggatggatcaccaggtcaggagattgagaccatcctggctaacacggtgaaaccccgtttctactaaaaatacaaaaaattagccgggcatggtggcacgtgcctgtaatccaagctactcgggaggctgaggcaggagaatcacttgaacccaggaggcggaggttgcagtgagcccagatcgcaccactgcactccagcctgggtgacagagcgagactccatctcaaacaaacaaacaaacaaacaaacaaacaaactaagaacaacaacgaaaaaactcccatgtattatctatggattgactgtaaaatatgagaagcaataaatatgttcatcactagggccatctagaaatttctaacccaagggtcaactaatctttccctgtgttgtatttcctgctctgcggatccggcatcatgacctttgtactacccaggaaagccagtgttctcatgggctcttctcttttttatgctctaccagatgctagcactgtggcatgccattcgctcactagcagcttaaagggtacaggttctaaatctccttagtgctactcacctgttatttctgagcctgcgtagatgatcttcttttattcagacgtctgtgtcacatatacatgacatcctacccccttcccataaaaaaaatcacatttgtgaatgtctctcttaggctgagttccagactccaagatccctcttctctcttgtcagaatccagcagctgatggcatttatgtctgtagatttcactgtcaatgagtcattgacaggctaagcaggctgttggatggagtgatcaatggtatgagggaaaacactaatgtatgcaagaagagccatttcctagtaggaaaaatatttatgtatggagccacaaaggtgatcgcttcagtagaaatcaccaaggacctggtagtcaatgtgcaacctaattttctttcaaaagctgtaggaatggcaagggaggaaataaataatgcatttctttatatctcctgttttaagttactgagtgtcgccaagagatttctaaggccagacattgagtcagctgtaaaactggaaggagcaatgtttgctgactgttgcctcagccgctgaccctgatctcctctgcacgtagtaggcagcttaaaaattcctcgcccgacttctgattttcacgtgactcactgcttagttgtctgggtttgttttaattcctttccccctgctgacagttctttaagtggatgtctataaaggttggggcattcgctcttacaacaataggaaaagaaaggaggaaggaataaaaaagagagaaaaggaataaaaaaaagtttggtttagatgtctgatttctctgagcctcagtttcccagcatgtaaaatgttgtgagggctcacactggtcttgtccaggtgcttagtagagcatccattacaccataaagtatcacaaaaatttttaatatcatcattattactgtgctttcccttgagtttttttttttttaaatcagttaatccacatactggcagatctgacttccttgttttaggccctggggaatttttgttatctgtagagctggattaattttacagtgtggtgcctttgcccaaggtgaacctgtctgtttatagaaagtgtcaccaagttctgtcttgggcccgtccactcggttatatgtgctggaccctgggtggaagcactttgcacgtgtgcattcacgatgggctgtgctggaggggaaaacaggcatcactcccaaattctattcatgcaattaaaaattcctttcatttttatttgtgagagggtatgggtgcacagcagacggcaaacagaagaaaagcttttgattgaaaggtaaacatttacttctgccttttaaatagacatagcaagtctctttactctcatggaagcagttataaggaacatagagctgaagagaatatgaccatttctggtcttttactatgctcgtattaatccaccctggatagaagggactgtactatttggaaacacctaaataaaatgtttttgtcttaaggtgttaaaatgtactcattaatgtggcagtgtattccttttcttctgtgatcgttgaagtagggaaggaatttcaactaagaaccaaaatgattgtctgttaagacacttattttttgagaagacaaattaatataacattattatgtggggaatgtggaaaggctaaggttgtattgaaaacttattaagcttatgagaatattgaaagcatgaggaggcatgaccggaaggtattaatgatttgggcttgattattctaagactgtattctaagtctaaaatgttgataactaagacctgaaatgataaatgtttggcaaaaccaaataaatgagtagcaggttgaaaaaagaggcaagagagaagtagatatttatagttttctaaaacaatttagtcccttctggaagagagtcctacctcagccatgcctaccaggttgtgtttgtgggattatttctgagtcacccttaagctcatctttacccctctcccagacccccagtcccctcactgggcattccttggattatttatttatttatttatttatttatttatttatttattgtttgagacagtctcactttgtcaccaagtctggagtgcagtggtgtgaccttgactcactgcaacctctgcctcccaggttcaagtgattctcttgcctcagccccctgagtagctgggactacaggcacgtgccaccatgcctggctaattttttgtatttttagtagagacgggattttgctatgttgcccaggctggtcacgaactcctaaactcaggcagtccacccgcctcggcctcccaaagtgtaatcctggattataggtgtgatccaccacacccagccttccttttgtttttgatttttcctctttaaactctacttgtaaccacccctttcctttcccaaacttttactagcttcttccatcctggacttgcaatctggctgaaaacctgctaaataagggaacaattttgacatggctcctgtactccccacaaacctagttgattccagaccagtaatgtcttggggacagtgttgtcccatcttcctttctaggctgggctcagattactgacgtggaagagttgttggtcctggtgcaacatgccatgaccatgaggcctctggtagaaaggaaggaatgaagggtggttctccaaacccttggcccatgcctcatccttctgttcccttccttttccaggtacgtagctggtcaggtttcttaaattccgtcgatctggctttatccattttaagccttaggttgttggaacatagctaagttggtcaccttttcaagaattgaatctcaaaaaagccatgtagacctcggttgtaaccatcacattcattgacttggttgttgatctgtttgtcagatcagttttctgtttggggaacatttttgtaagtgcatgtatttcagcttttaacattttaaaaataaaatttcattgggaaagaaatttcattcgactggagtaccaggaacttagaatgaatccatttgtcagcagtatttataccctgtctaaaagagtgtcctcccagttctctgtctctgtactgtgtccccactttaaaaaatagctcaacctctcattatatttgcaattttttgtttttttcattgcctggtgggtttttttttttttgtctttttaaatgctccatgtagaaaagaattcctggaatagttcttggaacagcataggtgaataaatgagcaattattttgtcctcagcactataactgatttgagaaggtcaaaacagaaaataaaaacatgtttcagtagtaccagttcctgcacaggctgtctgccaactatggaagtaaagggaatagaattaggctgtctggattatagtgggaaaacaaaacacaatcacatcctgcctcagcctatccttgaactggtgtctttagaaaggggaggtcaagtaaaggccataaggctggatggtggggaagaaagaggcctgggaacaggtgagaaactgcagagcctggcggagttcatttaacctcactgtggttctgttggacttagtgcaaaatcaagagacccacctttgcctgcccatcctgcaatggtttggggggccccaagtagatgactggggaagatgactgggaaactgcagcactggttcatgttctgggacaaatcaatattaagcaagtttaatgatgggtaggttcattcaaaagggaaatatgtttcaatggagaagagaaatttgttaggttgtataataaatattttgagtgtatttggatagaagtttatgacggaaaaggcaaaattctctgtgtctttatggggagatattcgatatgttttttcttggcagaaataaaacatattcaataatataattaggcaaacttgttttagttgacaagaagaccgtatctccgtctgcaagatgaaggcaagatcaagagatgtcagttaacattcttgcgaccacaggtagggaggagaactggggaggaatttatggataggtgagagcataaaactagatgcggaagggatgggggagcaggtaaaataatgaggctcaatgttcaagaaggtcttgggcaagcgcgtgctagttattttcctcactggtgtggtcgtgacagatgaatcacattttactctcctccctttctcatagtatgattacataaaggagaccttccctggaaagagccctgtgcatggcttttgagagtgggcctgggctaacagtgagtgtggaagcttgctgccttgaattctttccaattctggagagttgatgggtaacaagtgtgtatctatagtctgcttggacatggcggtgtggccactgacacgttgtcagccatcccctcaactccagggacaggaatggtgagaaggtggtgagggcacagtctgcccggagacgggacagtttgtactacctgtagcaagagcatgtctttgagagccatagcagctggcttcctatttggagagaacaagaatgtgaaaagctatttattaccagatgtgggcagaccctccagcctttttttgttcttttaaaccctaatctctttttaaaattttttttatttttaatgtttatgggtacatagtaggtgcttatatttgtggggtacatccgatgttttgatacaggcatgcaatgtgaaataatcacatatgaagaatggggtatccaacccctcaaacatttatcctttgtgttacaagcaatccagtcactcttttagttatataaaaatgtacagtttaagttattattgactatagtcaccctgttgtgttgtcaaatagtaggtcttatttattccttgtatttttttgtacccattgaccatccccacctcctcatcaaccccccactacccttcccagcttctggtaaccatttttgtgctctccatttctgtgagttcagttgttttgatttttagatccaagaaacacaatcttagatgcatagtaggtgcattctgttgccatctgcatcatgggactgcacaatcggagaggcaggaaggccctgagaaatacctgattacacacctgcgtgctgggatgagaaatatgaggggaggagagaaaagatgagcctcatattgcatagcaagtctgtgatggaagcaaagttagaccctgttgatttttatgtcttacctccttgccattagttaggtaaatttagaccaccatattttctaagatcagagaatagagaattttaaattctagattcttgccttgtggatgttgaaaagaacaattaaaagttatttgggatatccaatcagttaataaataattatgaatgaataaactgttttgttgaagacactcttatggcagacatgaacatggggcttaaatcagttctgacatctagaagctcaaatccaggaggcagaggagttggatattaaagaactctgtggtgagctggacaggatgacatgacaattatggaagttcagagcacatagcagtcttttccagtgatggggatggaatgtgggggtcatggaagactttgtggaagagttgcaagtagaattattactgttgaaaagagatggggagttaggtagacaaacagaaaaaatgccaccaaacaataagttaggatagaaaaactccacgtatccatatgtcagttggcccatctgttcgttcatacatcctttcattcttctatccatccaaccgtccttgcatccatctatccatccacacaaccacttattcttcattcatctgcccatctgcccacctacccatccacccttccatacattcatctagtcatccccatccatccactcatctatccacccatccatccacccatgaatctatccatccatctgccaatccacccacccttccactcacccacccatccatacacacttccatctgcctttccaattatccacccttccatccatccatctacccactcatctaccctttcatacatccatacacatccatctgttcattcatctatccatccatgcatccttccttcgttgttttcttccttctatccatctattcatctacccaccccacccacctatccttcacccatctggccatccatccttctacccacaccttccttcctaccttccttccttccttccgtccttccttccttccttccttccgtcctcccttcctcccatcctcccttccttcctcctgtcttcctttcctttccttccttctctttctttcttttgttccttcctttctttcctccctccctttctttcctccctcccttcctcccttcctgtctccattattaacttgctggtattttgtttcaccattgcattgtgtttatcaatagacgattaatggaagaagagaagaaatcaggtgaagtctttgtaggatctagaatgtctaggctaaggagtttgaaattttttatactatgttctattgggaaccatttcagggttttgagatatagtatgatataataacagctatgctaaattctttgaagttattggtggtggaatatcaatccagaatgaaaataaataattttggaaatgagcctgtcattgaaatatactttatttctcgttaaatgtcccagcaaaagtattttggttgttaaaataaaggaacaaccattagaaaggaggaggagaagaattagaaggaaaaaaaaggtaaaggtaaagtaccttggtattttagggtttctaagattaggaactttaaatgttgaccccattttggtctttaccttcaaaagacgggagaaagactgagagaagtttctaagctgatgctgctctactacctggagtaggaatgagaaaccatctataaatattacctttggtgtttccatcaaaaatttagaatttcaccctattctatttttaattctggtttaagactgaaggggttcttggtgaatacttttgtagatacaattaatagttatgaaaatcattactgattacctccagggttcagatattgggctgaatgtcttctctcaccatcagaactaccttttgactagagtgttaattattaacatattttagattagtcagacaactgcaatatttaaggaatacgtccaaggtcacacaactaaaagaagtgacaaagtacggtttcagacccttttagtcttttctgtgttgcaaaattgagataatgataatagctaatgatacctctcccttactgataattgaatgttttatgtgaattaaaaagtttaatctgcatagtgtttcatcaagatagattccttgttatcctcattttggagatgaagagactcaggcatgcaaaggtgaagtaattttcccagggccagagggctaaggaaagggagaattgggattaattctacattgtctactggtaatacctattgctcatttttaccagttaaaactatttaatgagcatttgcccactttctaaaaatatgatggtcttagttacccacatggacctactctatcccaggcagatgccacaaattattttgttttctttttgtatatatttatgctgtttcctcatttttaaatagtgggctttgatgactattcttctacataaattattacatatctgtatcatagaatcttaaaaattatttgattcaagtgtatacataattttcatatccctgatagatattgccaaatatttaccagaagtgaatcaagtagtttttctaccaacattatctaagagggcttgtctttttacatctttgtcagcactaagtattatctcccttacttttttttttttttggtaatctttgttactttgttaggattaaagtagcttctcattttaattttcactcctttaattgagaagcagaacgtattcttttttggtgacttgtttcagagtctctttagtttgaagatacaatagatgtagcatctgctatatccggtaacaggataacagtgcattgctgggatgatgaggctgcagtgggctgtgattgtgccactgcattttcagcctgggtgacagaggaagaccctattacaaaaaaaaaaaaaaaaaagggtctgttatcaaccatgcttttttattttattttattttattttcctgtttctgagttagagtctcttttgctcaggctggagtacagtggcgtgatcttggttcactgcagcatcaacctcctgggctcaagcaatcctcctagctcagcctcctgagtacctgggattgcaggtatttgccaccacgcccagctaatttttgtatttttagtagagacagggtttcgccatgttggccaggctggtctcggactcctgacctcaggtcatccgcccgccttggcttcccaaaatgctggtattacaggcatgagcctctccatctggcctcagcagtgctcttctggctagcttgatcatatgccaatgttttattccttcgtggagctcagagtaagcttgttttactggacgttttctataataaagctaggggatggcgaatcattctaattaccaaaaagctgtctttgataacaatgtaggagataacgaaggcagaaataacatttgagtaattctttgccattctgtctctgaatcttgaaataaatactcttgaatttatatgttcttggtcctttaggagtcataaaaacataccgttacatatgtatatgaaacggtgagaaactgcgtatttattaagagtcacgacccttaggactagacaaatcaaattaaatctcataaaaacctgttatggaatatgaatacgtggcactattttttcttttagggtgtctttattaattttgtcatgtttaatatgttgcagttgcaaacaaaggcataaatgcatgcgttcattcctaattaatttatgtaattgggttttataaatttagctgtttaggaagctgtgcataacacactccatttactgtgtgctgtagccaataaaagcataatagaaagaaatatagtttgaagctcacttcaatggtaaatatagattagttgtaaatgatatctttgtaatgtttattttaaattttgcagtgctgcagattttctgaacataccaattaatgttcttatttgaaataatgactagttaattactataaattctaagtgctccatctctgacaattaaaaattgtcttacagctttttatttatttatttattttttttagatctttccaaattatattaagtgcagcatctggggaaagaagaatgggaatggaaggagtgtgtttaaaatgtgggtggttttgtcaattcctattgggaatgcttgtatttgaatgtatatacatatgcatatttatgtgtaatgtctatttcatgctaaatagggagtgatcaagttgaaaaataagaaatgctgtttgaatttttaaaataggttataaattataacatgaaaatcaaatacaatgggtaaaaccagtaaattttaaataagtttacatttgttgtcgtgatgtgactgtgacgttacctgagatctcagcaaggagctctgcagcccgaaaagaccaactggaatgatttgatcagaaagggaatgggtattaggctgctccactgatactttatccacttcgggagagagagccctgttccttcttcatctagctcaagccaactgtcagaaatgcatgtcagagctacacaattctatccaaggcattaactgttgtcaagtctgttttttatgaatatgtttcaatataagaaattgtcttaggcccaaagtgaaacgtcttcctccttgactcatagcaagctcatgcaggtatttgaacattgttctgtataatatgtgcacctttgagaaatcccatgattcttgctattctttgtaaatctaataccttccatccagagagagagtatacatgtggagtcaattgggagtaccttttgtatcctctagtctgagccttacaggttaaaggagaatgttggatttgcttttgaaagtatgggcttgcggagattaaaaaaaaaaaaaaagaaaccttgaataatcatgtacaaatataaatactgtatgtagaataagtgtaatggatcacatttatgatgaaatatgtatgtctttccaagggtaagaccttcataattcatttataagttaccttctttctcttacatgtaagtagcagaatagtaattttcttcgttctttctgaagaattgccacacagggaatgaaaagaagaaaggataaacttttcttaaacagcagaatgttattcagagataactggaaaaaagtacgagaaaagccaaaaagaaaaaaaaaaattgtgggtcctggtgatgttggaaaaatgacgtgtgagctgaagttccagacgccgagcttcatctattttgtcatgttatgacagaaatcattacaagggtgataggtttatttataaagacttgcttcaatattcaaagtacatctattctagcattcctcattttgagccaggctgtggatcaagatgaaagaaaaattaaattgtatattgaagagctcttaattgagccatgctgtatttaacagggaagcatcggcttcaggcagtcgataccactgaggatttttaatgccctgcatcatgagactgtcagtttgctttggagaatgcaaacaggctaatgacaaagccctgcaaacttttgtagttgctgctggtctctttggaaggcaagtgctaatttacccacagttgaaacctgacacacacacgcgcgtgcacacacacagacacacactctctctctctttctctgtctctctctctttctctgtctctcataaggaactaaatcctgcgttttctcaccagagggctaatgacacactgcttagtcacccaaaacctgtttcctaaggagccactttggggcttgtttaaagtttttaatgtaaggcattatataatattagatttcccctgtttttccttaatcaatgtaaattcaattgcatttcagagggtggccaagtggcatttcatcatctctaatatccatttaaaaatgttaggtctacccagttataattctccaaagtagcctatctgtggtttaatatgttatctacattctctaaggcagtgttaatttccttttgtagttaatctatcctactaccaaatttagtatatttatagttaaagattctgttaagagctaagtgatttaagtacatctgggataaagtggccttggctttaactatgaaacaaattttctttatttcattctcttcactgataaatccatagtaactggaggcatttttagaattgtgggcaatttcagcctctaaagtttgattaaagatacttcagatattcctactgagaggctagagggctgaaaggaatttattttgggttctggccctagtgcagctcagtggaagagaacagacattgtgagtttaattcccacgctgccaatttcccacgagtctagggtgggtgttacttctcaagaaggcgatggtagaaccgctggagacttcttatggctgtggcaggggactcacacgtcacaaggagtccagaggcatggctttgaagagctcttttcattcattcttccttttgttcacttgtacatcaaatacatgctgtgggcctactgtgtgctgagcactgatcttgtcaggttcttggggaagacttcattgctgaggtgacctttgagctgagtgtatgagtgcaagagagagcgatcacacctgggaactgcttaataaagtccccggcatcttgaagccacttgcagaccttggcagttgctgttgctcctgctgctgctgctgctgctgcattgtcaagactacattgatgtcttggaaatatagaaaaaagaggctgctggactgtgtgcttagaatcagtgtgctaactctgttaccaacaccgtagagaagtggttccagaaggaagagttcagggtgagaatgaataacggagtggctttgcagtgggaacctggctttgcagcacagctaggattggagaagatcttcccagcagggagaagaactcaaagaacatgcatgaagggaggaaggttgcaccagtgggagggaccagaatatggtgtggaaagaacgaggttcaaatccaggctctgtcattaactgcccctaccctctctgagctgagtttgttttggacactggagataatgcatgttaacatcctggtagctctatttatttgctaccatggtacataatcatgggagctctatttatttgaacatcttcttttgttattatttggtgtatttgggaaaggcatgtgggagcagcaagcaggtgagcatcctgtttggaatgcagggccgggaactgccctgcccagtccagcctcattccagaggctagcacctggcctcagctgtagagctgctgggagcatttcagctctctgcttctttggcagtctagtgctgtcacagaaggaaagctcactccatggaaaaggggggattgatttcttctctgagggcagaggctgatcaatctaggctggtaggaatagatgtaacctcagaggaaacaatttgcattggcgaaagcaagtcaatggccatccccaaattcaaaaggacagggaagtgtaatcctactgtgatccctaaagcatccaggccccaggaatggtggtgatttgccagggggaaatggaggaacaaccccttctttgactacctctgtagtttatattggattctgcaaagtcccatgaggactgatagatgggctgtgtctgcatttgaattttgtagctgaaatgtgggtgagttcacctaggtccccttcatgacaaggtggtgagaaacattttcttgttctacaaatctgaattaggtccacgaaagagggtatgcagcatagagaggaaccaaaaaggacgcaagatttaggatagatattgccccttgggaggcctgcctggtctgcccttgataactcatgaacagtctggtaatgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggctgtgctttaaagtcattcatggatctggctgggcccgatgcctcacacctgtaatcccagcaacttgggaggtgggcggatcactttaggtcagaagttcgagaccagcctggccaatatggtgaaactccatgtctactaataacacagattagtcaggtatggtgacgtgcacctgtaatcccagctactcgggagactgaggcacaaggattgcttgaaccgtggaggcagaggctgcagagagctgagatcatgccactgtactctagcctgggtgacagagcgagactgtatctcaaaaaaaaaaaaaaaaaaaaaatctttcagggatccaggctgacctcagcaccatctcttacatgtgcctctgttctttccctaatataagggagcatgggggattagtgtctggcttaagcacttccactcagaaatcttgcttctccccacaatccattggtgaaagcaaggcaatggtcatgccccaattcgaaagataagtgcagtcctactgtgtgccctaaagaattgaagatcaggatacttatgagcagcgctcacaactgccatagtggcaatgcgaatggcatctatttttaatgtgactgagaaaataattggtcagatattgcaggatttttgtgggggagagggtggaaaagaacttacagattaaaaaaagaactggcatagcacctagattttaaacagaaggaaaagatgacattggggaccagagacagaaatttcacttctgtgccatgacaaataccagggagatgtaattgcaaaatgaagctgcaaatgtcttacccagggaactaggtgacaacctgcttggcttcatgaagaaggaataatatccaattaggctaagtgtattcggtgcctgagtgacaagccctggagacctgagggcttctggggcccccagggcggtttcaggaggctgtctccagacctgtccggggtgtgagcatgtcacgctgtggcccgcgcctcccctgtacagctgcctctgctcttctaagcactgaaatgagaggtgtaacctgtgttccagagtctgcgcctcccagccactggggcaggggcacctggcccatcagacttaccttgcctcccctgctgcccatgccctgctgcctagggctgggctcatgactgggtccacatcagctccacattgcagactgaccccctggaccctcacgtctcaggatccctatctccctgtcagtgctttgtcacccaaagtcaccgcagctcctcttgagtgctttcaagatcagaccgaggggtcctagttcaagctaattcctacctgtgcgatcactagccaagtactgaacctctctgaacttcaattatctcatctgtaaaaggtgttggtttgtaattgttcctacctcttagggcttttgtgagagtttagatgataaaccaccaagcaacagtggctggcattctgtgcacaatcgaagtctgctgctgtcagctctgtggtcgctgtctgcactcccacccctgtcatcctccaagtctgatctcctcccgaagtctcttcctggacctcagccctcagggattgcacctccctctgaatatgctgtcccttctaatcatgccatttagccacactgcctagcactttcttttttgaatattcgtgtcccaggtccctgaaaaagttgctaagcctgctaaaagcaaggcaaggcctttctttctttgtaaccttaatgcccagcaacgctccattcagtttgaccctcagttggcttcatactttgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatattcaagcagctttacagagactaccatgagaatgggttaaattaagaggattgtctttgctgtttagccaatatgggccaaagttcagtggtttgagacatggcggggtttggtagtagatgtaggatattgctggggaaagagtgttagaggatggaagattgcatgatatttctggctttgctctttgactgtgtgctgtttgtaaaatcacttaagtcccatgggtcattttcttccccatatcaagcacctgctatgtatcaggtgttgtgctcacgtggtgttttatgcacagtgtttcctctttgttaatcctcatgatgattggtatggtttggctgtgtccccacccaaatctcattttgaactgtaatctccataatccctacgtgccaggtagggacctggtaggaggtgattggcccgtggtggcagtttccctcatgctgttctcgtgatagcacgtgagttctcgtgagatctgatagttttataaatggaagtttcccctggccttcattctctttcctgctgctttgcgaagaaggtgcttgcttctgctttgccttctgccatgattgtaagtttcctgaggcctccctagccatgcggaactgtgagtcaataaacctctttcctttatacattacccagtctcgggtagtatcttcatagcagtgcaaaaacggactaatacaggttgggcacggtggctcatgcctgtaatcccagcactttaggaggccgaggcagatggatcacttgaggtcaagagtttgagaccatcctggccaacatggtgaaaccctgcctctactaaaaatacaaaacagccgggtatggtggtgtgtgcctgtaatcccagctatttgggaccctgaggcaggagaatcgcttgaacctggaaggtggaggtttcagtgagccgagatcatgccactgcactctagcctgggtgattccatctcaaaaaaaaaaaaagagaaagaaaacagattaatacaatgatctgtgagatattgggactgttcttattcccatttcacagatgagccactaactggctcctggcaggacagtgaataaggggcacaacagagacacaaacacatcgctaaccaatggtctcatccgtcagccacactgcctgtctcagcatgggccctgtgtggaccattccatctcaatttgtttctgattcttgtcaattaaataagaacagctgaaaagtaaaataataaatatatacataaaaacaatggggggagtaataatgataatagatacaattttttggtctttataatccccagagcctggcttaattattttaaagtaaatcaacactttgaacacttgcaggttagaaaaccagtggactgatggatgcgttacagccattgtttccaagtgtattagtttctgctggccgctgtaacacattatcaccagtgtagcacctaaacaacacaaatgtattgtctttcagttctgtaagatagaagtcctacagggttctccttgggctaaaatgtagttgttggcatttctttctggaggctctgggggaaggtcgttccttggccttttcccatgacgctagaggctgacacattcctctgctatggcctcttcatttttcaaagccagcaagattgcatctctctgtctttcttttgtggtcacattttaccaggactcttctcctgcttttttttttctacctttagggatctttgtgatttcatttggcccacctagataaccagggtcctctccctatttatttttattttatttgtgagacagagctttgctttgttgcccagactggagtgcagtggcttgatcttggctcactgcaacttccgcctccagggttcaagcgattctcctgcctcagcctcctgagtacctgggaccacaggcacatgccaccatgccagctaatttttagtagagatggggtttcaccatgttggcgaggctggtctcaaactcctgacctcaagtgatctgcctgccttggcctcctaaactgccgggattacaggtgtgagccaccacacccagcccctctccctattttaatgcgaggtaattaacaaccttaatttcaccggtaacctgaattctcctttgccacgcagtctaccatattcacgggtttcagggattaggacctggacatctttggttgggaaatgggcatcattttgtctaccacaacgtgagagcccattgccctgcatccacagtcataaaagtctgttcccttcctccctgattcttcctaacttctcctgcctgccttgcaggatatgtggagttatcagttcctagcaccactggccaaagcgaggatagctgattgcactcctactttcctgctggtggaaacagcatgtatataggtacaactctggtgtggggaaaatgctaaagatataaagtagaaatagcctttgtgtgatgtgagcagcagaacaaaaatcgagggtgccaaataatcgtatgaagtggtgaactgcctaagatggaatattgctgttcctaaatcctggctgtgttgagacatgtgatcctgccgatgagatgagagctgaaccactctcttctcccagatgctgggcttccgaccttaatagagaccgagaaacttaacagagggctcagaagagaaatctattgaaagttactaggtgccaggtgtctcggaaagtgtttaacacatgcctgagacgttaaaggcaagattcatgcattctttcagcagacagtttcttcacttaccggggaagggggtgtaatatatgggggtatagggataaataattctgtgtgctgtgcaggccgtggagactcatcttctgcacaggtcaagttctgaagtcagcatataagctggaagtggagtgaagtcaaatgaccctcaaagatccttccagacttcatgcccttggcaactcagtttggacactcatatgctggtttcttccttgtatttatgcagcagcctccttttccacaaaaagcagaggccaacgtatctcaccccctcaatttttttactttccctctccctccctgtgcttgcctttcttttcttttcttttttctttttaagacaggctctcactcttgtcacccaggctagaatgcagtggtgcaatcacagctcactgcagcctgtaactcccagactgaagcgatcctcctgcctcagcctcccgagtagcttgtactgcagatgtgtgtcaccatacctggctgatttatacttatatttatgtatgtgcatgtgtgtttatatatatatatttgtagaaatgggattttgccatgtttcccaggctgggctcaaactcctgggtttaagcagtcctcctccagcctcccaaagtgctgggattacaagcctgagccaccatgcctggcctttgcttgcctttcttaatgtctttgacaattcatgtaaatgtgtgtatgatgtaactctataggactaagggtgtgtgaggatgccaggaggctgttggttgacaggagtcatgatttgactatatgaggtcacagaaaatgctttttaaaatttaccgccaacccacaggaaaactattctccttcttctaaggaaaaaaaaaatgtcacgataaagcagctacattaatgacaggcacatcaaggttttaacgtgttctctagatttatgatgtgtagcgtggtctccattctagaaagcaaagtagggaaagcacgactttggggccagggccctttctggttcagaatgtccctggccagtgtgcgccgtgcagtgtggaagcacgcttcggtgcgcatgtaagtttacgtgctatctgtagggacagtgatttttattcattagagtttttgagtctaattgtttttaaactgccacttttgtttgttaaagatacagatgtctggccatagaggaaagcaaggtggatttatcgttgcaattagatgcttcacaatttgaaaacttatcacttaaattggtgaaatgtcacttttatgcaacttgatgtttagaagtccttggcgtccaggactaaagtcatgtgcaatttaacaagatcttggtgagataaaggaagttgcgcttgaggaaacattgaaacacaccagatggaattttccaattccctcctacatgatagagactaggtgaagggagatagaccacaaattgattttgtgtaactcttaaattaagtggagcagagttaaaaaaaaaaaatcactggatttgaagttggcctatgttagattactccaaggaagttagttaatatgttaatatgaatctagatgaacattgagtgttttgctcttcttgttaatttgcgccatctactaatctctggacaatggagaaaaagtcgtaggttatgagttttttatttatggacattaagcaatatctttaaaatgtaaaatgaagccgacaaaatgcacagccagataacaacaacaaatctaatctaaagtgacaggaagagactctcccagacatttttctctttaatgtaacatgactttaaattgatgcaaccccacagtgattgaaaaactctcagagcttgtctcctatgattacatttctgatctgtacaacttaattttttaactcggtgagtctcagttttgcgaatgaacagttctcttttgctttctctctcatattatttgggaagacattatttggcaaccaggcagataaagctctgttaccacgacgaatactgagaagtcctaaaacaataaagaccccaagaactcaccctggaatatgtacctccaaatctcttctcttttccttctctccttctctttgtttttctttctcttcctgttctcttgttttatcttgacttctctcgactgtggtgacggtttgcatatatctgcgattgtactgaaacttaccaaacattgtacgttttaaatgggcaaaatgtatttgaactatatatatcacaataaagctataatactcttttaaagtgtctcctgaatcattaccagtataattattctgtgaactgtattttgatgaattcagaattaatttaaaatggattatccccctgtagaatgggaggtaatgctgaatgattgtgaatgattgtgaatgtttgtttattcggggtactccctcaaatttcttatccagtggtgtctagaacatgttgggattttgtgtgatagtttcttgagttggaaattgcgtttctttggcctcccatgtgggtatcaatgagttttacatggtttaaaggccagttatgtgatggatacttctattaccttatgtctttctgatttcatacacttaaatgtacagtttttatcttccttcaaaaccttatttttccgagcaagttttatttattcactttcagtcattactgaagtgaataacaaacatataacaatgctattttgggtcatagctgttttgctaagtaatacttaaaggctttctgactatatttttaatttctcgacagtctcccatggttattttctgatcataacttgaaaatcaaagctttctgttcagtttaaccatcttttaaaacccagtggttttagcttgggtattaacctttaacatagctagcgaaaattgaacatttttatttgaaatatgcttaatgttgtcttgtgtaagacaaaaagtttagggacaagtgaaccatttacttttcttttaatgtggaaagcagtttacaaatgctggtatgactaacaagaatgaaaggaccagaatggcagttctgagctagaatgtgatgagtaagtaccaccatagttagcggctagggaagggaggttgttctacagagaaacatgcccatcatttcttctgttacctggtattcactctggcaatttctttttggactcattctaaaatcaggattaaggatatccactgagaagcttgcatttattactctaagcaagaaacttctatttaattttttaaccatttgattcatatgtatttagattttaaaatttcattttctcttatccaaatgtatcatatatctttaagtaggtgaatcttggagtagattttattatatatcacatcacagagttaagctcggttcatctggattttaaaaatctctacagctttgagaatgactttgaaacactctttactgttggagcttaaagaaaataaatctctaatgtcctctgtattaattcacctgcttggaaagttagagattaaaaggtttagtaggatttttatattttctataatttctatttgtattggagtaaactgttcgttgtatggagtggcttagctttcataaaacagaaagattcctatattgagaaaagaggaagaaggaaaaagtgtaatataaatacataaaacttcctctagctttcttgtgttatgtgtaaaggagttagtacgttactttaattgtgtactttgaagaaagcaatctcctatttccattaatggtggactctgtgggtagagacatggatatttttccttttataagaaaggtcttgtctttcctcagaaggcattgtgagcaaaataagggaagaaaaagagaagtagataagaaaaacaaatcacaatattgaagcaggacccgagtactatagccttcctcatattttggtatctggaaccgaggttgctaattaatgacccaagagctaagccttgtttgatgaaatgcaagatgtaatacacagattgccttggagtgatgtgtgattattaccatccattcatgtgtaatcccgtatttggaaggtttgtaatttgtttttgacacatttctctctgattttatacactcatgcatacaggtctcacctccctccaaaaccttatttccaaagcagactttgtttgtttggtttgggtaattcattgggccctatttgtcttccttatacataatctattttcttactgctgcctctgtcttccaaaccaagaatataaagaatgaagcctggggactggaacttaaaacttctgccgagaaaagaaagtcaaggcctgtgggctcctaaaacatcctgtggaattcgcctcagatgcccctccatttgcactggtatatggaggatgtttgaaaaccaccagaacctattgtgtactttggaacaatggcattttcctgcttgattgtgaagatggccgctggaaaagaagccaactcccagggggcacgaggggctaagctgtctcctgggaagtttgagggaggccaagtgttttccagttcatttccaacgcgtatttcttcagggccaagggcccagctgtgcctcattaggggtgagagtttggctgtgacacgacttaatagaaaaaaaaaaaaaaaaggagaagtccaactagctgagtggcaacagaacttgggacaacctgtgcccacagcctttcatgtcctgtaatgagtgtgccatttgctcactgggaggagaaaaaaatgacagtatgcaacagtcaactttttcctgaagaaagagagaaaaaaatacatattttgcagccgagacatcggggtacctgttaactttaggcacagcgctagtgtcagccctggaaagagactccctgtgaacagcactttttaccatttaatcagcctgtacttcttcgtatttatagccctggcgaggctggcccattgttacaagaggaaattgtgatgttcagcagtttataccttgggagctggaagcgtttctccatggtgaatttgtaatattaattggccatgtcagttcatgacaaatgtagtgacatctatttcaagtatttcagttttatggtgctgaagaagtgacacgcgctccagataagtaatctcacaaaagatcttcccgctcgctgtggagcgcctccagaacatgctctcagaggagatgcaaataggctcagggttcagggggctgtccccttccttttgctcaaggctcagaggggagccagaggaatgcagggagggacgcactccctgtcattcccctttcagtctcaggagattctggttgaagctctggcatggactttcctgcccaagaagtgtccttgcggtgatcatttatgtgatttgggtacctgctgcttgtaggctgtgactgtcagtagcagaaataaatatattgcctttctcactgtgtacagtggtgctgtaccaagggtgactctgcccatcaagggacacttgtctggagatatttgggttgtcatatcttggaggagaataggctgctattagcatctagtgggtaagagcaagggatgctgtagaacttcctacaatgcacaggcgcatcctacaacagagaattgtctggccccaaaagtcaatagtgctgaggctgagaaaccctgcacttgtgtggaccatgcccttttatgcttttcaaccttgaagcactaataggtcagagaagaatgccagggatgtgttgatgggtctgcaagaggttgatgggggatgcttgagctcctaccaagtggaaggtggtgtaggcaaagagaaggatgcataggcacattggacggtggaaggcaggggctgctgaatgatgtggcaggaaacatgcaaagtgctcagcgtccctgggcggtgcagagtcttgggaagcaagaggatggagccatcctttcagtttccagcctgggtttcccaaaggagagggtgtttgagttcagtggcagagagagtggggaagagtgttggagcccagctgagtggccacctttgtcaaatggagctgagaaatgattttcacatggctggcgtaatggcggagtttccaaaacagcagcacaacaaaatagccatttacatgtcaagactatattcatagaatccatatgtctaaggtggggaagttgtcattattcctgttttatagatgaggaaacagaggcccagatggagtaagtgactgctgaagtacacatgatttgtcagtagaaaggaagagaccaaaggtggcatcaactttatctttccttcttttttttgagactggagtcttgctctgttgcccaggcaggaatgcagtggggtgatctcagctcattgcaagctccgtctcctgggttcacaccattttcctgcctcagcctcccaagtagctgggactacaggcacccgccaccaagcccagctaattttttgtaattttagtagagatggggtttcaccacgttagccaggatggtctctatctcctgacctcgtgatccgcctgcctcggcctcccaaagtgctgggattacaggtgtgagccaccacgtccggcctgtttttccttctttgttaagtggaacaagtcatttttttggtggtcatttccaatatgtaattcctgataacacacgtatatattatctctttaaaaattaaaaaaaaaaaagccagccaaaaaaagaaaatggaagtgttcaagaaactgccttttttcatgtaatagtatttctgtgtcactaaatccttcaacagcattatttttaatagctgcccaatgtcctaatggatgggtgagtcatgatttacttaaccaatcccctgttgttggacatacaggttattcacagcttttctctattgtaagtggaattgcaatgaatgtttttgtagtacacaccagtgagtgattccttggtgcgcttggaagtgctggttccaagaataagataaggctttgagattaattgccaaattgctttcttgaaatattgaggctactattttccagtatcttcactaggaataagtaacgtttttctaaagctgagtagtaagagaaaggtagaatctaattttactgtgcattttcttgattattagtgaagctaaacattattttttattgatgtgttaacaatttctttcttttgcaaatgatctattaatgttctgtgactgatttctatcttggtgtctttacgtttgtgaatggtaagaatttttatgtgttcaggaactatttaaatgttcaagacattaacctgtggttatgtatatcacaggtacagtcacatcgcttaacaagggagatacattctgaaaaatgtattgtcggaattctgtcattgcatgaagatcatagagtgtatttacacgagcctagatggatagcctactacacatccaggctatatggtatagcctcttcctccagggctatgaacctgtatagtatattactgtaatgaatagtgtaagcagttgtaatacaatgggacatatttgtgcatctaaacacacctaaacatagaaaaggtacagtgaaaatatggtattataatctgatgggatcggcattgtgtacatagttcgttattgactgaaatgttggtatgaggtgtatgactatgttttctcatgacctctgctttttttgtctttaagtttttaatttttgttttacttttgtcttttaattttaattctattgcaaccaaatctatcagcctgtcttctatgatctctgcttttaattgttacgctttaaaaatccttctccatggtaacattatattgactcatatgtcttactggttgaacgtgcctatgtttgactttgaaatcattaaattcattgaggatttgttttgccatgaggaattgggtaaggatccagctgattttctccagatgagtagttcattgtcccaacaccagttattgcaataagttattccttccccaggaaatatacctgggctaattaagaaaactgtgcttcaatgtaattattccaccttaatgcatgaaatattaggttaacatggaaaaaacatggcatcccatgttttagtattttttccttatttccaagcagcacctctctttgaattatattctgttctctgtttttataatttgactcccttctattctacatctaaatagtgcattgtctgttttcactcaggactttaaaaatagttctagtactaattgtatttttattctaatactgctattccttttactggtacttctgcatcttaaaaaaacaaaacaaaacaacgaaaacttggcatgttggctcacttggtgaatgaaagcatatactgttcagttgtttattcttcagcaacatctgagtatcctcgagaaatgagtggaatgaaccgctagagatgaatagccttaagccctcaaagctgagccctttggggtaacttgctctaattctgccctctccagtttgagtttaggttaaattcagcttgcagattgcaccaagcctgatgcctcccagccatcaaggaaaagggtacctaacattttgaatctccattaatcttacagctcagatcctgtgtattaaatctcagcattttcagggatgtatactctggcagaaaaactttaatgattttttttttctgatgctgcctagaaaatattagaaagaagacccttctttcctttcctttcttgtcctgtcctgtcctgtcctgtcctgtcttccctccctccctccctccctcccttccttccttccttctctccttctcctcctcctcctctccttttcttttcttttcctttccttcttcttcctttcttcctttatttctttcttcctgtattattttcttgtatagctcaggtctcactgctttgctgccattcttgtggagaataataggtaacagaggtgtgcacctggcctcatttattgtcacactggataggtaatagacgccggcatggctatgctgtggttcctgctgatgggcacactattacaggtgcatgataagtgtgtcgtacgcaggaagtacgtttcccccagccttccctacctgctgagggctgctcccagcctaaggatttcatccagatagattcatagcgcttccagtaaatgcaccccttgcctttcaaagttgaaaaagaaattactttggacacaaagaggtgtttcttttgacacagcaggcatgtgaaaaaataagcaaaaaaacaagagggatttctgttaccattggcatgtgcttctcttttacttctttagttcacaatgccagtggttcagcttcccgttctgatcctcactgctctaatctcttcatctgtgcttgcaatcacagccacgcgggctcgcaatattaccacgaaatcattttatctgttggaatctctttcctgttcattactcttttttatccccaggtagacaaacaccctaagtttacctcttgcgaattgtacgctttaaggttaaggaattcgtagttgaataagaatgacttttcacataaatttaatggagttttatcttctgagccaaggctttatttaaggagtcttgggaggtaatcatgtgttacctgagactctccgcccataggatgtagttcctttccattggaacacatggggaccgagggaataaagaatgttttcatctctgaaaatatctctcattcttccaatcaatgctgctcttttcttgcatactgtatactgggaagcatttgtttcgatttgtggttaaatgtatgtgtccactggacttcagtatccaccctttgaaggaccgcaggagaagttgttcaggtagaaacatacaagggccggatgcggtggctcacacctgtaatcccagcactttgggaggcctaggcgggtggatcacttgaggcctggagtttgagaccagcctggctaacatggtgaaaccctgtctctactaaaaatacaaaaattagccaggtgcggtggcgcaaacctgtaatcccagctacttgggaggctgaggcaggagaatcgcttgaactcgggaggcggaggttgcagtgagtcgagtcgtgtcagtgcactccagcctgggtgacagagcgaaactctgtctcaaaaaacaaacaaaaagaaacataccgggagatctggttctattgaaccccagtgcagccatgggtagaattttaggcttatttatattccatttcaccacaagatgtcaccagggcaccacaccaacatggtctatggaccctctctctggcaaatagagttatggtcatcaaacagcacctgcccagggctatggggagaggaagctggttggctttgtcacaaatgccttgatgtctctttcctcccctggggcccatctcttccagcctttgcatagagagagaaggcaggcaacaggacacaagaagattttcccagagtccagggtgttctcttacccctgaaatcgtttcttcactggatgggaaggcaggcacccagggggagatggcatcagctgcataaacaatttttctcctcagtagacatttacatgagtcaataggaatcatattctctctttttttttttttttttttttggagatggtctcactctgttacccaggctggaatgcagtggtgtgatctcagctcactgcagccttgacctcctgggttcaagagatcctcccacctcagcctcctgagcagctgggaccacaggtgcttgccaccatgcccaactaacttttgtattttttgtagagacagggtttcaccacattgcccaggcaggtctcaaactcccgggctcaagcgatcctcccaccttggcctcccaaagtgctgggattacaggtgtgagccactgtatctggcctaggaatcatattctcttcactgaaacatttcagatgacttaaaaattcaccttgtagaacttttaaaattgaaactttctggtgaacatcattagttgacagatatgtcattgaagtttcatccttcttcatttcagagtctgctggaagacccttcatttaccactctctccttcctggaggtgtggaaatactctacctgggtgaggctctcgtggctttttgtgccaagtgtccgtaaacttcaacttaattgttttaaatcctttgtggtgattatgcggaaggtcaaatctaacaggaagctccatgtccacttgatgtgtacttacttctatttttgcaccttgtgttgtttgttatcctgaattatgccagggctggtttgtgctaagatacttgttatttgacctcataataccagcatgtcccgtttgtataaccctctctgtagcttcttccagcatgtgatcatacatctacctaacctctcccattggttgaatttaatatactagtgaattttccattgcaaagatgaggttacgaatcatagtgttcatactcagaaggactttataaatattttgcctttttgaagtatatacaagaaatgaaaaaaaaaacaggaataaataaaaagaataaaaagagccaggactagaacctacaattcctgactcttgatcaaattgcttttctttttaactctagttaaatattttccattctttttaactcaagaagcctttgtttttgttgtcatcgttttatgattaacttatatctggtcctttagacatttagattttttctgttttatctctctctatatgtatatctgtatatatatttatctatatctatatagagatatatatatatatataaaataatgaatgaaatggactgtttgcaacctcagatgtatttctaggacttagagtgattagcttgaggcgatggtagtttctgtttttggagtctctgtaggtctcagactcacagtctgtacttcttgttttgggggctaattaagtggacagtttcagtgttggtagctcatttaagccataaacatgcagaccatgtggaatcccattagtcaaaccttagcagagtgccttgatgagtacctccttttctttctgaattctattagttgatgctttgttctttctccccaagagccatatctcagctatttcttttcatttcttgtgtatagttcaacatctttctttctttttttttctaaacaggatctcactctgtcacccaggctggagtgcagtggcatgaccatggctcactgcagcctcgacctctggggctcaagcgatccttctgcaacagcctccctagtagctgggactacaggtgcatgccaccacacccagctaatttttatattttttgtggagatggggttttaccatgttgcctaggctggtctcgatctcctgggctctagcaatcctcccacctcggcctcccaaagtgttgggattacaggcgtgagctaccgtgcccgtgcccggccttacgtttcagcatctttcaatccatctaatacgcagtgccagggaaggtttgtgaaaacatttgaatcacagagtcacaaacagtgagaatagctgcagttatgtttgtgatgctctaatgaacttacaaaaggccaggcctagtatttcagctgtgtccatgatgtctctgatggaaatggacaggtaacatgatgtacacaagcatttgactgttgcatcctttgattgggccatgttcatgcagccagcctgggaaagcaattagtagttttaagcatgggaaatcatataaaagtaaactaaaattgcatttgaattaattgatgaacatgtttgcttgaccatatcctgctgttaggcgtcttcaagttaacttaagtggttgataaaactttccaaaaagaatactatcaactgctgagcacctgttgtcagagttgtgggtaattcgcaaaggttttcaaatggaaaagttgttttctcctgctaggaagcatggtctcagatccacttctaaggtcagtgtgaaagggaaggcaaattcactttgagcaggggaggcatgatctggaagataaagcagctaggagtatagactagggggctgatggaggggaacacctatcacaatatgtgttctcacaccaatggtatatattttccacacatttagattctccatgccactccttatctctttagtgcagaaaacggagaggaggttcagtattcttaagaaactcccatgattgctttgaggcaatggatttaacaggtatctttatcccttatttacgcactgactgtggtactgagtcatccctggtgtttctggattttattggcaatgccaagagagcaggaagactgggacgtgaactgacaacatttatgattctggcagcttgacatcacccaactgttctctttgtttggttttgcttcagacttagtttagttttgttttttaagggctggggtggaggagagggatttgctcttgcagttttcctttcaaaccaaactctttcaaagccttttgcaaactcttttatggattttactcactggttgagcaagagttacttatgagatgtggcttcggcattttcacagtgtccataaaaaaatgtatattactatgcattgcacatttgccacttagaatttctgaatgcaaattaatcaacttgcagctgtgactaacaataaaacacaggataatgtacctacagaaatgagggcattggaaatccgctctcaggtggccatcgaaaatagtcagcctgagtgttgctacctgttttccataattgtgtagctttgcctttccttagttaatctgttcaataaactcctctgcagaatccaaatgcttaaattcagtttctttttgtctttatggtgtttttcattgttaacgtggcatcggagtagctcgacttttgcatcatgataaattcataacccaagagaaggcagaaaacataattattatcaattgcctctctcctggaattgccattggctgagtggaacaaaatacgaacttaaggagtagctgattcagagaaatccagggtaggaacgggtcccatcttgatttcaatgtcttttttgaggaggccttcccattgcacttctcttcaagtttgcccagatagtaagttctactagacatgtcaattttttctgaggtctaatcttgattttttttttcctgcacaatatggaattcagtgtttttatttaatcattcagtaagtcttgactgcctgctatggaggttaagccctttactaagttccaaggatgtacctgtgaataaggcaagttcctttttatcattgtctttgcagtctattaggggctacacaatttaaacagagaatatatataaaatggtagaaagtacaagtaagtataccttattttttttaaaaaaatgaatgtggtatttcacccacagcctcaagaatcactttccttaaaattgccagagtaggaaaacttacaattgaagaatttcaggtatttatgggaaaaatagtattagggcaattgcggtcaaacacattcgtctgttcgttcaattacagcagtaaggatggaagtctaaagagagtttctacgtgatcttatttatcctgcatttataaatacacaaattcttgtacaattaactcagtttttcactcctttcttgcttgcaacttgtcaggtcgttccctccccagtagttgtgaacttctttatgctagcttcttccatcaggggctcacaaccagggactgtagaggtttgcagaggtaaatcttggtagataaggattttatgaaaagggagctcactgttggtgaaaaatccttgtttctacagattttgggtcaagataagaaaaattaacttttaaaatctgaggaatttggagattatctccaggggctgaatatatttttatgggagaaataaaatggatagttttaaacttgaatttagtttttcctaatggaggcccttttgaagatcaaatgggatctgtaaaaactctttgaaaaatgtagactgcttcttatgtgattcttactggtctattatttatcaagaaattaaaaaggaatgaatatctgtagctgtttttctttttctttcttttcttttctttttttttaagatggagtctcgctctgtcaccgggctggagtgcagtggtgctatttcggctaactgcaatctctgcctcctgggttcaagcaattctcctgcctcagcctcccaagttgctgggactacaggcgtgcgccaccatgcccagctaatttgtaattgtttgtttctaaaaggatattcagtgcttccactgtcttttagaagtctgtagaaggaaggccaagaaagaaatacccattattttggctgaagatgatcactttagctgaaaccagttcaggttcaaactcagacattggtgctattttcatatatctgaaatgttctgaaaagattactgacgatcaacatgctgaactgacatttcacagatatgcagatttattcatctctgttcaaggtatgccttttccaatcataatagccacgtagaggacattaaacaaatattttattgtggtaaaaacacttaacatgagacctacccttttaacaaatttttaaatatataatttattattattgttgactataggtaaaacaggacatttttaacgtgctgtggtggcctattggactttcagcctccctgggtgtatttcgctgtatatgtgtaccatgtcagcttaccctagaatttgaaacattttcctttgatgattaaattttttttttttttttttttgagatggagtcttgctcttttgcccaggctggagtgcactatcgcgatctcggctcattgcaagctccgcctcccgggttcatgccattcttctgcctcagcctcccgagtagctgggactacaggcgcctgccactacacctggctaatttttttgtagttttagtagggatggggtttcaccgtgttagccaggatggtctagatctcctgacctggtgatccgcctgtcttggcctcccaaagtgctaggattacaggcgtgagccaccgtgcctggcctgatgattcagtttttaccccaagatgcagtatgcctcagtctcactaaaatatgccaatatgttcttcttcttgaggatcagggctgatttcttctactgggaaaatgtatcccctgtgtttggccccagaggcatcagggtaacctgctctcttccattctcaaagcagaaacagtgttcctaacattctaagcctgggaataggatggcaggtcgtgggaccagcattttaattacctaaagggaacttattgattttagtccagaacacggtggggaggagttcatattcttttttttttttgagtctggattttagaataaattcactgtgtacatagctattccatctttaaaaacctttgtgaatgttaatatacagcctttataaatttgaggtataatgttcaaaatgctctaatccctaaattttccagtctaggttattatacttttatgactattcattttgatgtaggccttttaaaatcaattcctccctgttattacaatgctgctttatggtatttgtgatatatcatatgaatatacttgagggtcatgagaagttcatatgtgtgtgtgtagtgtgggccccagactttcgccataccgctggctaaagtggccatgtttttgtacgtctctgcagagcttacaagttattcaacagccagatttctattctgatatgcccttttagttttcaaagcatcgaaaaagggtaatctttagaaccgaagtatttggaaaactcctagacttgaataaggtatttttgaatttgaagagctaagaacccatcaaatcaaaatgctaataattcttccaagtcaaaaggtaactctcattttattatgcattgaccaccattcactttctgttggactgcttttggaaaaagaaccacaagtctctatttttaaaatagaggtacaatgataaaacaaaacaaaacaaaacaaaaaaacaacaaaaaaaaacccacacaggtctcatcagccaagggatttaaaaatcaaatttaacttcaaaaaactgaagttgatatagcaggatcttggagatgcagtttcttcacttttcttttttttctaactgagggattaaggatataaacccaacttcaaatttctttctgggtggtcttgaaaacttaacagtaggtcctgtaaagaggtgggggagaggaaaaagaaatcctttactctcatctgctggttttaaaatgagaaaaatacacacacacacgtaatgatgttcgtgatgttaatggagggaaatatcataaataattaagaatttaaaattattataaaatatttagtattattgttgttactgttattagtaggaaggggccttgccatgcttcctttcttcaaacagctcagtactttaaaatcgagtgtggctgtgtttgtcagtcgtggtttgtgttctttgatttgttctgcatgttcttcttttggagaggatgtgtcactttgccaatcttggtccttgctgttgtctggtggagggaaacaagcctgccaggccggctcatctgacccctggtggcagggagtggaggtgcactcaggatgctcttggggaatcataaaggaggttaaagaaagggacagcagaaccctgacaatccttgcccctaagcatggaaaagcctccggaccgggtctggagtgcaacagaggcccctgaccttgtctctagctctctgtctgcatcttcagcgtggcttcactggtttctaagtctctggtgtcttttgtcttttgcagccggcttgcaattgcctccttctaactctcaaaaggatgcatgggatgggttcagtgtagtcactgttgtgccttttggacaaggctttccagccaggccaccctgtttacaaggctgtcctcacgtcatgggcgctcatattgtccagactagatggtcaaggtgattgggggaaggaagtcacagagccaccaattactaaggaactgcccagagatcctgcctcactgggaacctgtgagtgggctggtttcccccagcagaggggctgtagcatagcaggtacccacaggagcctgggcatggcctttttctctaaagggctggatagtcaatatttttagctttgtgggctttatggtctctgttgcaacttctcaactctcctgttacagcaggaaagcagccacagataatatataaatggacggatgtgttccaataaaactttatttataggaacaggcagtgggccagattcagcccgtgggccataggttgccagcctctgactctggtgttcagatcacagactttggatgtctcatatctgaatctttctaatctcgtgatagggcaaggtaattaaaatgttaatacgttagttttctcactgtcaatgtgttctatgacatcatttatgcaaagcatacaaagctgagaataaagtctcagcaaatgctagtttcctggcctccttatacatacttacaaaggatggtgggagatagtttgagatttgaggcctctgaagaataggtgtttttgtgatgattttggcttttcagtttgacagttggctttgcttttttgacagacacattaagagcttcaagggtcatttcatggtttgtcctttccatgtcagggacacctttcacgtggccattttaagcacaggaattgccttcaagtagtttactcgtacgaacttgtctgtaatcatctttccccatttggatggtgggttgcccattttaattcaaggtttgtctaatgtgttagtgcatattcttggctcaagcaggataagacactagtaaccatgaacctgtatatcaaaaagcgtgactagagtttcatagttaaacatgtgctgaaatccacagtggacaccagagagggtcatggaatctgggaatggatgacttgtcccatgatgataatatctgtgttcctacggctgggcccggtggctcacacctgtaatcccagcactttgggaggccgagatgggaggatcacgaggtcaggagttgaagaccaccttgatcaatatggtgaaaccctatctctactaaaaatacaaaagttagccggtgtggtggtgcatgcctgtaatcccagctactcaggaggctgaggcaggagaatcacttgaacccaggaggcggaggttgcagtgagccgagatcacgccattgcactccagcctgggtgacagagtgagactccgtctcaaaaaaaaaaaaaaaaaaaaaaatctgtgttcttgcctggcttattgagctccatggtaaatgttcagaggctgcaggaatgattcaaagtctgactgatttatgtgcattgggcattttgttgatgtcattcagattaatgatggcactgaaaatgtgtaatggaaatgagaagtttgtatcctgcctgctataccatgattccaatttaagagggggtaaaaatattgcactttttaatctattgttttttgaaagagactgtttaaaacacgtaattttgctaagttatggctcatatcgtatttgttattttggttttgaaaaattgagtaggaagcaattgcgttcttaaatgacttgaacatcaaaggcaagtagtgtcttgttttaggagcagccaggctcctatccctctgatccagccaagtgctttcacttggtcccactctggggaatcaccagtggttctcactctgggagaggcccctggttgacctggaatgacctagaccagcagtcacaagctcctgcccatggacaaaatacagccggtacctctttggctatggcctgcaggctcagaatagttcttacattttcaatcatctgcaaaaaagaataaagaggagaatattatttcttgaaggaggaaaatgatatggaattctgatttcagtgtcataaagttttgaatttcatcaataaaaaatttgcagaaatttgtttttctctcctgttatgtaaatacctctgtaatagcctcggttttgcctcttggctcacaaagcctaagttgtttactatttagccctttacaaaaaaagtttgccagcatctgatgtccaacaacaattttcagtcttttttgtagctcccaaattctctcattaaaccagatcccttgagggaagcctggtttacaaaatagattaagtgatgtggctgtttggagcaggaggctgtggtctgagtcttgctggcctcaaccctcaactcacttccacaccttacctcctggggataaggctgccttcgtctagaaagtgcctcggttccagcttggaaatatccatgtacagtcccttttttgttattccaaaacccaaagagatctgaaaagcaaaaacaaatttattgtatatttatagcaaatttatttggtggtgaaatttgacttcagctttagcgtccctgtttctcctttctagtgtgaatgttcattttgttttgtttgtttttttgaggcaaggtctcacttcatcacccaggctggagtgcagtagtgtgttcacagctcagagaagcctcgacctcccgggctcaggcgatcttcctgctgtagcctcccaagtagctgggactccaggcatgtgccaccatacccagccaatttttgtgtctttgtagagatgcggtttctctaccatgttggccaggctgaataatcatattttcactgaagaaatagaaatgtcattgttataggatgttgccccaaaccccgcaaaggtattttgtaatatgcagtatatgtgctaaattactttttttgttgttgttgagatggagtttcgctcttgttgcccaggctggagtgcagtggtgtgatcttggctcgccatgatctctacctcccaggttcaagcgattctcctgccgcagcctcccgagtagctgggattacagacatgtgccaccacacccggctaattttgtatttttagtagagatggggcttctccattttggtcaggctggtctcgaactccggacctcaggtgatctgcccaccttggcctcccaaagtgctgggattacagtacctggcccaaaatacctttctaacatggaggaattaggaatactgaaggcatcggcccccaagggtttgatgtgctcttgtccccaaggcctgcagatttgcatcacctctccacttcgtggactcctcgtacctgcctgattccaggatgctctaacctggccacgcatcccccgtggattctcagctgttgtgtgtttcctcctcaggtggccactgtgtctggtgctcacccacattttggttcatcctgactttgcctcagcctccccattctgcatttctcccacggcttctcccagccctggcccagtgacactgtaatgtggactgtggcatcccctgagtctaagctgttgaccagctcttgatggacagatgctggcagagatggggaaggtgctgttcccttcctcctgggaagggcaaagaaagcagggtggtcctcccatccccgtgaggaaggaagagcctcattcatgctgagaccctgatggagaactgggtccagggataatgttttgtgttcctgctcatgggactggtgtgttattgtcaagggatcttacaggccttgcttcccaggcccctctatcccctctgttcttgcttaggcattagtgatttggttcttctagctttttttctttttttgagacagggtctcgctttgtcatacaggctggagtgcagcagcgcgatcttggctcactgcaacctccgcctcctgggttcaagcaattctcctgtctcagtctcctgagtaggtgggtctacagtcacatgccaccacgtctggctagtttttgtattttttagtagagatagggtttcacttgttggccaggctggtctcgaactcctgacctcaggtgatccgccagtctcaacctcccaaaatgccgggattatagatgtgagccaccacaccaggctggctcttctagtttttgaagctcacttttcttttttcctcaagactcacagggaatgggaccaggcacctgtctttatacattctcaaagtccatggtgacgatgccatgctccggttctaagccagttggacagacacaggcaagggaagctgtcagtgtgggtgtgagttgcagtgtaagggtagtgggtggaatagcgtctccccaaaatccacacccacacagaatcacagatgtaacgttatatggaaacagggtctttgcagatgtaattagctaagaatctcaaggttaaatcattcaggctttagagtgggccctaaatccaatgacggttatcctcatgagaagaggaaagcagggggcacagtggtgggtgtgcctgcaatcccagctactcgggaggctgcggagggggcatcacttgagcccaggagttcattgccagcctgggcaatatagcaagaccccatctcttaaaaaaaaaataacaccaaaagacaaaacagaaaaaggaggagaggacacagaggagaaggctctgtgaagtcagaggcagagattggagtgatgcgtctacaagccaagagatgccacggtcatgggcagcccccagaaacgaggagagaaacctggcacggtttccacaaggagtcacccctgccaacaccttggtttcagacttctggtctcctgaactgtgagagtcagtttctgttgagcttgtgctgatacgctagggcagccctagcacactgccacatctggtttcccggaggaacttcacagggtctttgttctttatctacagtctctggaagtctcagcagcctcctgtgttcgcaactgtcattccagagcagccgtctcgtgttatgcatttgcttactcataagcaaatatttcacaagaacctgcgagggccaggctgggccaggcaggtattgcaggtgcaaggatctatataagacagtgccctttagaagatccctgtctcattgagaagcgttgagtaaatgggtctctctggtcattctctccagaacatgaagccaaagggctgagagggagagactccaagaatgaattagtgtccagcaaggtatcgcttgtctcaggatgacaacttgcaatttggggatctctcaacgtcctgacctccatctcagtgggcatgttcctcacctggctggctgcccctgcttactgatgcagcctcctgtcacacggtactcacctctattcactgtattccaccaacactggccttgggagccagcagtacccccattgtacagatgaaagtcttgtgactgtcaacattaaaatgagaatgatattgacccatgatacttacccacctgttcagtggattcggtgtgccgtcagcatggttcccagcacatagtaagtgctccgtaaatgtcagcatctattattatcatttgtgtttttttttccccttctctgccttcctttctctccctccttggtctgcttcctcctgttgctatcagagcctgcctgcctcatccttgttccagccttgatggtgatgatgattgtggttgctgttgctatttgtttttttggtttgtttgtttgttttgagagggagttttactcttgtcacccaggctggagtgcagtggcgccatctcggctcactgcagactcttcctcttgaagctggggaagttcaagcaattctcctgccttaggctcctgagtggctgggactacaggcatgtgctaccatgcctggctaattctttgtagttttagtagagatggggtttcagcatgttgtccaggctggtcttgaactcctcagctcaaatgatctgcccacctcggcttcccaaagtgttgggattacaggcgtgaaccaccacgcccctcacgcgcagccactgttgctattgatgattattatgacatcattgctcagattcacttggctcagagagggcggagtcagagtgacccaggtggtcactgctccccttcttgtccatcaaatcagctgcctccaacagcattgcctggcagcgtcacgtagtagccctctccctcacaaggcttttgaggcagacaaatgccactgataaagcaaaagcaaatgttttgggtgaattccccatagctacactagatttgaggctgagaaatggaatgcctgtcattgttgactgaaaaatacagctctcctaatagagtcttggtgcaggagctgttagccttgccgccctgcagacttgaagaattgcgacgtcggcctaacataattttggtaactttgtctgcttctgcctcgggtagaaataattcagatttcactctccattttctttaatgggctaaacagccactttgtaatacctgtattttattagacataattctggatattgtttctgcagcgtttttgaaaagacaaacctgagagagcccagctatttaacttaagcaattttaaagttatttgtaaaatgatatgctgtcttttttgacccagttactttataaagctacattctttggcaaacattaacacaacttctccgtgtgtgggctaaataaatattcgggcaacactgattgagcactgccttgggtaaataattctctctccacacatttcctagtttataatgaggagttttcttcgtggtctgaccaaatgtaacattccattgaaaatgagacataaatccttgagtgagggagacgtggaaccagggtttgaggagggttattaaaaaggtgagggtagcagggtgacctcctgagtcccctgctctcccgagccttctctcctctctggaacccatggctaataggggacaggagagagcggaagcagaaagaataagagatatgaaagccagccgggcacagtggctcacgcctgtaatcctagcactttgggaggccgaggcaggcagatcacttgaggtcaggagttcgagaccagcctggccaacatggtgaaaccctatctctactaaaaataacaaaattagctgggtatggtggtgtgcgcctgtaattccagctacttgggaggctgaggcatgagaattgcttgaacctgggaggtggaggttgcagtgaactgagatcgcaccactgcactccagcctgggcaacagagggagactgtctcaaaaaaaaccaaaaacaaaaaaagagacatgtgagccttcccttccctctccccatcctagcctcctctcacccaggtccattcttccactgtcatcccatgatgctctcttgcattttaaagtttggaagcccttattcctttgttttgtttttgaaatacaaatatcaacatttttattgttctatagtaatacacgtttcttctatagtacattaaatcacaagaggtaatagtgtatctactaacacctatacttttgagtagtgttgagtgtaaatgatattttgaaatatctgcagtaactgatgtgatatgcaaacatctgtgatttcttttaatttttattaattttcattttttaaaaaactttagtttctggggtactcgtgcagggctgttaaataggtaaatgacatgtcatgggggtttggtatacagattcttttgtcacccaggtcagaagcatggtacccaataggtgctttttcggtcctctccctccttccaccctctaccctccagtaggccccagtgtctattgtttccttctttttttgagacagagtctcactctgtcttccaggctggaatgcagtggcaccatcttggctcactgcaacctccacctcctgggttcaagcgattcttgtgcctcagcctccggagtagctgggactacaggtgtgcaccaccatgcccggctaagttttgtattttgcgtagaggcagtgtttctccatgttggccaggctggtcacgaactcctgacctcgagtgatctgcctgcctcggcctcccaaggtgctgagatcacaggcgtgagccaccgcacctggcctattgttcccttctttatgtgcatgtgtactcaatgctcagtttccacttacaaatgagaacatgtggtagttggttttctcttcccgcattaattcatttaagataatgaagctcctgtccttgacccaatctccactctaccgtttgatgtccagtgtggactgcccctctgaaagcccttcactgcggcttagcctgtggtggaaggtgtccaaggtggctggaacacctcctgctgggggtgtcagtcttggctctcctgttttctgcctgtgcaatggtgggtaggtcccttgatacctcgtaacctcagcatccctgtgggtgataaggagatgataatagtctcttcccgatgggggttaaataaaataattctcggagtatgtgaagcagtacatgtgaagtgctcagctttgtgtctggcacataaggaagtggtcagtgtttaatgttagggatcatagatgctgataaattgccgtttatggcatatttcatgtattgcctcatttaaacctccttgcaatctgtatgactcctgctgatgatggggaatttgagactgtgagaggcttggcaaaagatctaagctgtgaagtatctggaataggattccaccttcagccctgccttaatgaagaccatggtcttgccacattgcatctccccaagatttttatggttctatttttagtcacgttggcctgcgttggtaaatttacctttcctggtccttttgagtaactatctctggaaaggattaagtgcagtgatcaatcagcagcaaagtcctggaagaaacccatttgttagtctctgggcctccccaggccttatcagggcttagccttcgagcagtagcaacacttgcacctgcagttactaattcctgtggaatgaagtaggcgggcccgaaatgtacagcccttatccagtgaattctcataggagcaaaaaaaagtgttttctttcccccttggagttctgtttcttcttaaaattagctatttctcatacacaatagggacatattcataaaaaagggaaaatactccaaagttgaaaaaaagattgaaaaagaaaatcctccaatatatatctactcttagcattttggcacatattcttacagtagtttcaaatgcccaggccattttgttttattttgttttgttacaattgtggcatatgtactcgtgatggatttgcttgttatctctaaattaattctcctcctgcaattcaaatattccagagatatgtatatttttaacacattgttaattatcccatatggataatagtttcttttctctcttaacattttaaaagcatgcctccaggttgttctagacggtcctgaacagtgctttgaatggggacatgttagtaaaccaatgagaggaaccacggtttagttcatcattctccttctaactgtatttttaggttgtcactaactcttttcagtcgtcatttccatggccacgaacatctttggttctaaagcatttttcccatttaaaattatttctatgggattgatttgccagaagtagaatttctaggtcaaaggtacaaacgcttgagaagtcctgatacatattaacttgggccagaaatctaccatgtaattgagagcaccttgagcttggcttcagagccaggatgaggacaggaataagtgggccttttgatttgaaatgttgagatacgaatgtattctagatgggccaaataaccagcttattttattttaaagtcgagtgaattttctgcctcactaatgtgcatgtcttcaaagacaagtagtgggaacggagtggggatttgtcatcccatagaatgccaccacatggaatcggtcctgaggcttctgaaagcagttccaaatttgaatgtttcctaagttagttcttgcggtacagcgcagacaatattcttcctcgacaatagctgagacccaagtgcctgggcgcttccaggtcataattaacctcttcaaaataagagcaaagaaaggcaggaaaaggtcctctccattccagaaaggagaacaaagagggggaattctaaccctcttgccacctctgttctcgtccgttccatattaagaagcattcaaagactaggatgccattttgcaaacgtctcattctccctgaatggtaaggctccacgctttagcacaagtggtacaaatctgccttccctcattcttttttgcagatcatcccgctccccacccctttctttatcatggctcatttggagcatctgtgcattttttaaaggctggattttctttctgttgccattgaaacattgcatttgtacaggagaactacttaatggcacagtttgttattacatggaattaaatacaacctatttaaatcatgtaccgtgaaaccaaagagctgtgtatggaaaaagcctcatataacccagtttgccaggtcctaactcccttcatacatatactaacatgcaaaagacctcctaccttttttttccccttctgtttctctcttggtataacactaccctgtttttgaaagtacttgtactgctaatatattctttaaagaagaggggggaaacctgttggtcccctcataaaacagttaacaggaagcccaaggcatctttcagtgccatttttggctgatgtttggaatggttccatcaatcactgctgttcatgtatagctggtttttatgtcagttaaaccatcttccatcaagttggtgaagcagagtcagggaacaagatgaatagcaaaacgtcttctgtggcatggaaaaggctttgcttttaaatgcccgtgttgatttcttaatattttcaacttcctcttctgaagccagttccccccgaccatcagtcatgagtccgttcttttaaccttgttcaggtggcgtggggcggtgtgtttggtggggagtgatgggtgcttgcctggaagtgcgagcaattgatcagctgatgaggggtatttattatctgtccctgactcccgagagaggaaataaatccttggaccccagagtgattttcggagccacaagaatgcaagatgtcctgtttccagtcagaccatagcagtatcagtctgtgcagttggaatcttgcatggggaggtgtttttatttcacacaagaaagaatggcacatctttccttgaaagatgtattttgtatatcttaatgtcagttatgtttacgtgtttgctgctcagaaatcaacaggatttctgcccttccccagccccctttttttcagcccttcagagaatatttgttgagtgcagtgtgtaaaatcatggcggtgccaagagggggtgtgatgggtgtggccgcccccctgccagcaggaggaatctgttttcactgacattgtttggaatcaccaagcatggtgatgataaaaagcagttaaactttggtcacttttattaatacttttaagtccttagcgaacaatgcacccgttattacttgcacctagtggacatggttctcattgctgctgcccacctttcttttttttgccatgggtgcaaaagatgcctctggggatcccagaggactcagcattggtaaggatgcagtcctaatcctgaaggagggtacagctgaccagggaggtaacacatgaatgcagctgatagggccagttggacccagatttcaactgcaatctctatttccttcggatctgttgcatctgctcaaacactagttctgcaatttcccaacacctgccccctgccccttataaaagctcatggttccatgtgactttccactcctgcgtctctggccttggggcaggtcagtccgtggatcacctcactgtcctagggatgctcttctggtccacactgtgcctaccttggatatggagttccacttgttcccttacctttcacccacctgtgctcctcacccaagcaggcattgatggaggtctcatactttactgaagatgtgaggaaagaggacacttatgtagaacccaactgcaggtggagccttggcgatccatagccctctgtaaagtggggattgaagcacatatcttgcaaggcttgggcattgattgcagggagtaatgtgtatatgaatcatcagctatgcaacataatgctgatgctaagtactaacattgatggagtgttggcatgagctgggcagagtgctccatcctctatgtgtgtattagttcattcttgcactgctataaagaaatacctgagactgggtaatttatttaaaagacacctttaattggctcacagttccacaggctgtacaggaagcatgatgctagcatctgcttggcttctggggaggcctcaggaaacttacaatcatggtggaaggcaaaggggaaggaaagcatctcacatggtgcaaacaggagcaagagagggagcaagggggcaggtgcaaaacacttttcaacaaccagatctcaggagagccaactcaccacacagcatacgtgctaaaccatgcatgagaaatctgtccgcatgatctaatcaccttccaccaggccccacctccaacgttagggattacatttggacatgaaggctgggtgcggtggcacactctgtaatcccagcactttgggaggccgaggcaggtggattgcttgagctcagtcgtttgagaccatcctgcacaatacggtgaaaactcatctctactaaaatacaaaaatgtagccaggcgtggcggcacatacctgtagtcacagctactcaggaggctgaggcaggagaattgcttgaacccgggaggtggaggttgcagtgaggtgagatcgcaccactgtactccagcctgtgtaacagagcgagaccccatttcaaaaaataaataaataaatttgacacgaaatttggtggggacacagattcaaaccatatcaatgtgaattaaatgacatcattcagtcctcaggacaaccctctgaggaagtacttatgccccccggcctttttttttttttttttttttgaggcagagtcttgctccatcaccaggctggcacgatcttggctcactgcaagcttcacctcctgggctcaggtgattctcctgcctcagcctccggagcagctgggactacaggcacgtgccaccatgcccagctaatttttttgtacttttagtagagatggagtttcaccaggccagactggtcttgatctcctgaccttgtgatcctcccacctcgacctcccaaagtgctgagattacaggcgtgagccaccgtgtctggcgtcatgccccgttttatagatgacaaggcatggaatggttaaatgtctttcccaagctcatggagtggtggcggtggaggtgttgtgaatgtgaacccaggaagtccgcctccagagctgcaggcattaatgcaaagctgcactgcctcacgaggtcgctgatgcactctcattccttttcctccagggactcctgcactttgccaggcgtgggccagaatgccactcgtattgtttatcttaatgcttagtgatagtagctacctccagtgcacgccgcattagcctctccaatgagtttctcctttattttaaatgtaaatctagagttcccttaatccccttaatttttagtacgtggctctgagggcagaaacattttcaggagcagcctgggctgagtttttaatgtggcagcagcctcggctggtttcagcatgcaggtgagaaggccgttcatctggaacttgggctacccaacagtgcaagtggggagatcagagcatggaaaatgtttttgtataaacttaggtggaccaaaatgatcatttcaacaacatttcggacttgattttttgtatttatatggcccctttcttcccaagaattgaaagcctcaaactagaacgtggcttttgaacggtgaacattccacaaacatttaatacagagatggctgtggggtgggggctgggggctgggggcctggaaggggagaaggggcaccagaaggagaaatgggaggaaagggcgagtgagatagcaaagagaactcagaaagtaataaagccctgcagtaatcagagggctgaggccaggtccccagtgagcggctgaacacacagtgattcaaacccactccagacctgtgttcttaatcattaccttcacctggagggacagacctggccttgggcaagccacccccactccctggctctgtgaccttggcagctgactggccctctccaagatcagtttcctcatttgtgtaacagtagtaatctccaatttagggggctgtatggatattaaatgagaaaacacacacagatcatttctttagcacaacgtctatctggcacattagcgagagctccggaaatacccatgccagggtcacaagctcggttctggagctggatggccggggtttgattcttaactctgctcctttctagctgtgtaactttaggcaaataatgtaacctccatctgcctttgttttttcctctgtaatagaaggaacaacaacgaacaacattttttttttggcaagattaagtgagatcttccatttgacatgcctggctaattggcagtgcccaacagatagaaactattggtattgtaaggactgcttattgggtacatatgctgtgccatgggaggtggaggtgctgtcatgctgaacccctattaacctcaataggaaaggcaccaggttcaagagctgaagaagacactcagagccaacagatagacatggggttttattaggaggttacatataggggagagagtccagtgatggcgggctggatagtacaactgcccaccttacatacagaaatggtccagtggcagtaggctggacaggatatccacctccctacagtccagtggtggcggtgggctgggcaggaaaaccataaccacctgcaaatgtcatgtggtttatatcacaccttcacttaacaccctccccctaacaacctctacctggcaatcttcatttaactccaaactcaggacctcaatcccctgtttggcctgtgttccacgggacaggcatggggcacagatgtctgttatatataagggacaaatctctgggttggtcactcctggattccccagcccggaccacacattcaggtgcatctcccacacaggatcattctaagggtatgcttacgttaccgctattggggtgtgttcaccctgcaggtgcagagatggcaaccgaggcagctgaggatcagggagtggaataacttgcctagttctggctcttcccatctaatgtggctgcactagatgctgttaggaggaggaggaagcctacttttgttttttacccagtttctgttcaaaggtcgtatttcatggtgcctcatcacagtatgttcttatatgccctggcaaacagaaggtgctcaataaatgctagttcatctggtcccttaatgaatactctggcttcgtcatcttccctaggctttggttaatttggtgccctcttttgccatttctgcaacccttattcattgctgtcaactgctcgttacacagcattgcctgtttcactctgtacaggtgccaggcgtctctcagcttctcctctctttcccatccaactgagcagcaccaataaatagataagaaacctgaaggtctacatcaaatcagcttctattgctgcaaaactcttctagctaacttcattctaaaagctgtctgaaatatatttacttacacccgagaagattcaaaaacattaccgctgaaccccgatgctttgggaacacatggtgtccttggccacttccttgcttgttaccttgtccaacagctgattggcatagtacagatgtagacatcaagtaattctatcgttaaaggattagtcagcctctccctactccccacccacttatctcagtaaggtttagtcaagaagttggaaattaatggggaaggaaggttttgggttatgtgtggatttcatttatccatgctatctcttccctccattagcatggttaattaagagttgtcaatacatctttgttggagtatttgattattttttcaacagggaagattagaatgaagtcttcagatctggcaagtgtcatgggacttgtaaagtaaattgcaggttaagccctcattttgatctctgggatgagagcaagcaccgtttcattgacatgtcatcagctatgatctgagggagcacacagaggtgccctttggggaaagaggggcatcttgcacttgtctcccacattgaaagggtttattgcacagtgagtgtgtgcaagtgaacaaatagcagatgggttagaatggacagaagctagctctgagcacctcctgatttatgctttatttaaaaaaaatcatatgtatgtatatgtgcatacacatacattgttttgtatatatttgtcagatggaggtgtgtgtaaacaaataacagaaatgagttaaaattgacaagttagcttggtaaacatcttgatttataatttattaaaaactacgtgggtatgtatatacatacagacacacacacttcttcaccacctgaacaaaaatcccttttgaatcatccttcttgccttccaaacaagtacactagcaaacacttttcccagatggcaaatgactatgcccgttaggcatttcttttagcatttgtgttgacaatggcctttatttttccttctacttaagggctctcacgttctagaatacatcttaccagcgattaattatgccttgagattgccaggagacgtagacgagcttttattgttttagccactgaatatacctctagataacacaatacatatttacagtgacaagctttgtattatttataggattatagcaaatcatcaaaaaacaacccaaaaagggccacttagaccaacatccttatttctccctcggcttcagcattgaattatgcatgcattacaaatggcaataaggagtaaaggtcggtttagaacaacacagattgcaaaattacaccatttgtttaaacaacattcattattgattattcagcataggggctgatagaaacgcaaacagtggcagtaatatcatctatttacgtaggccctttataaatgtgggaccataccctctgtttagatcggaacaattgttcaaattttccagctctgttttgcaagaaagtaaagatgaatttggcatctacttccttgtgtcttttaatttttgaaagatttttggtattctccctatatcactgaagagagggaattggggttcagatggattaagtaatttacttaaggtcctgcttctaaagttataagtactctttccatcatataacacttagcatgtctgaagccagtaatttattaataatagtaatgataataattataaccatatctaatacatattaactcttattttaccagtccatgcacaaagtgttttgcatgtgcttcgactttcagcctttacagaaaccctgtgaatagacattattatgatgttcgctttatagctgaaactgaggtgcaaaggagttaggtaccctgctcaagatcactgggttagtaagtggcagaactggatgatggaagtcatcactgtgttccagtatctgcagaagtgtcacacttttgtgctttgaccgtcttctcatgacccatgaatgccatgatttcacaaacctgttcaaacagtattggtttaatggttgattcaaatgggtgttccaaagatatcgtaaatatatttaggatattagaaataagatatttaactttactaacataaaccttcaatttagttttaaagagtcttagagcagcataaacaacatgactttcaactaaaatggaatttactaaataaaacccaagagattaattgtaggagctatgtcctggtgacttgggaaagaaaaatgtaaggtggtaagcttacgtacatgctttcggcatacacttcccacctccagcctcgcattcccctggtacaactcaacaggcatttcattttgccttacaaattgagtgcaaccgggaagctcatcgcatagctgcttactcagaaaatctggtgtagtggcttagctagcataacttttgagaggtctctgtgtgatggtcttttttaatgtctttcgtgaagaattcttcttttttttttctgagacaatgagttgttctgtcactcaggctagagtgcagtggcgtgatcatggctcactgcagtcttaacctcccaggctcaagcgatcctcctgcctggtaggtgggactacaggtattcaccaccaagctcggctaaattttttttgaaactatttgtagagattggtggcagggttggagggcaggtctcattatgttgccagggctagtctcgaactcctgggctcaagcaatcctcccacctcggcctcccaaaatgttgggattacaggtgtgagccaccacacccagctgaattcttctcttgatcattaatccccaccccaccccaccccagaaaatccatgttatctttttgcttagaggttcaccacctctgttccatcacttttctttttcttttctttcttgtttttttttttttttttgtttgacacagggcctcactctgtggcccaggctagtatgcaatggagcaatctcagctcactgcaacctctacctcccaggctcaagtgatcctcccacctcagcctcccaagtagctgggaccacagcctcctgagcacccgggtgcatgccactgccaccatgcctggctaatttttatattttttggtagagatggggtttcactctgttgcccaggctggtctcgaactcgcaagttcaagcgatctgcctgcctcatcttcccaaagtgctcggattacaggtgtgaaccaccacatctggccaacttccctttctaagagccctcttggggctctgatatgcacctctcatacctcagccccagtcagggttgttgaaaacccactgtctgcccagaggctgggagcacatcttggtctgcctggtatggagggctgggaggaggattgcaggaactgcttaagaggcctcactttgcaagagcagttcaggatgtgtttccagcacagtttccaacatgtgccacccatggcttcccctttcatgttcctggcctttatgctaagttctcacattgttatttttacaagtcttttccaaggcctctgattttctagaccatttaatgtttgccataacccataagggtataactgtcttggcacattcagatcccccgtccccctgctgtccttctagtcagtttctggcacactatgtttatgagcttacagaacagctcctaggttttcttacttccaaaacagtgggcaagaacagctaccttttagaagcaggaaaaaggaacataatgaataaacctaaaggatttaaaaacttggaagacactaagaaactatattgccgagaaagagaaatgtaaattccgctggataaattagcgtttgcggttacttctctctttgttgcttaagcagaggagaaacagaagtcatagcaaagagagaggtagctgcaaaagctaatttatccaaaagaatttacatttttctctcttggcactatagggggcatgtttactctcctgatgtcttttggggaaggcgaggcacaaaagaagggcatcttcttccttcacacacacaccccacttaggaaaatacgtacacttgagatgccagagacacacccaagtagaacacatcccaagaacagtcaataataataatacccatcatttattgaacatccacaatagccagacatttttctagttcttataaatccatgtactcctcccagtagctttatgaggtcttattattctcattttattgatgaagaacttaaagttcaaagaaaggagtaaatcacgaccaggcacagtggctcgcgcctgtaatctcataatctcagcactttgagaggctgaggtaggtggatcacaaggtaaggggtttgagaccagcctggccaacatggtgaaaccccatctctattaaaaatacataaattagtcgggcatggtggcatgtgcctgtagtcccagctgctcaggaggctgaggcaggagaatcactcgaacccgggaggcagaggttgcagtgagcctagactgcaccattgtactccatcctgggcgacagagcaagactccatctcaaaaaaaaaaaaaaaaaaaaaaaaagtaactcattcaaggctacacatttactccatgaagtgagcacacttcagacttccagtcttgtgtggcctgtctaccacaccatgagacttcatgtctctcctaaatgaggagaaccaaagctggaaattgtcaccccctgtcagcccacagcactggtttctaaacctactggcctctaccgcttcacttctcactgtaatctctctgaccctaccttccagcttctcttgagaacttgactcttaaattcattggtgagaaaggaaatttttgctccaataaactgggtagctcagtccaggagagaaatgtactggactcagacttggaggacagagctttgtgaccctcctaggcaatgtaatgaccctctcctggcctcaattaactgaggccaggagagggtcattagcaaactgtcctttgctaaatgggactaatgggaagaatagtgtctgccaaataaggtggttgaaggattggatgagactgacatttcatttgcatttagtgaatacttgttgaatgactgaatgaatggttgatgtacagaaacatgaacagagagtagagcagaacattggtgaatggtagtagattgcctcagacgcccccctttagaatcacacaagctgtcatctgtgattgcatacctgtagaagtctctatcatttcgtagtctatgtaaatgttgaccaactgagttgttcagtgtacagactgaacaaccatacagggaatccctaatctcctgcactgtgagtcaaagagtcagacaggtctagatgcatttgcttcaggtgaggccaaggcagtctactcttaatggcacattaggctttggacttgaggccgtgtcttttacatttcgcagcaatcagaaggaatggggtcgccccatgaacttcttaaccacatacaggctcgtggcgtggggtcttcatctggctactagattgtttaaagaaggatttttgtgattcttctaggctgacacattgcctgtcatctgttgtttttctaatcttctagtaaacatttggaaagtgaaggtttaggcatgtatgtttctcttatgtaggaaggggaaataaggccatgagattgcatgagttttctttccaagtttgtgcagatctgcacaatgattgaaatatttgcaacctgtagagcagcagggtatttatttggcagcaaacagtattgatggattcggggaatgccatttgacagttacaggctcccgtgaggcggtgcaggctcctccgagccagggatggagctggggattgagtgacacaagactctttgggtatgtctcaaacaatataaatcaccagcaaaatctcactcctacaaggagaacctgcagggagctccgtgggaggcactgctgtttactctcctcattccccactgcaaccacgcaattaaaaccaaggaatggaatctgatgtctaccgcagcggttttttccatctccattccttctgcattgggaggcttaaaaaaaagaaaaattagatcccagattctttattcttttggaaggatttgaaacgattatcactcatgctctgctgctttgaatggaaaagtgatttgataactttcaaaactcttagccttctaagacttagattctggtactatctcatttatgtgacgtgggacaaatagccactctcttgcataggattttcttttctttctagaaacaggaactgagtatgtttccaatatttttttatttctcctaaaaaaatcagagactatatatataaaatctcacaaactttgtttcccagaaaaacaactatatttaaatgcagctcatactgtatgtaagtatgatgtaggaaaatctgttaattgtgtgacaattatgacttctgagctgctcatttattaaaatattctccctataattaaaaatattttatttcggagacatggctccattaattgcacatttcctaatgaagtttgaaggaagatttaaaaatcatattagccacttgtacaaaaacaaaccagtcatatcatagcattaataacaaaaaaattccactgtttatttaacgtaccagcaaattctaccgtatattgtttgctctccgtttggtgggactaaaaagggatttaaaaataggctatatacactgaatgtagtttcactggaagatttaatgccaacatgttcttttttggtattaacatattgcattggtgtgaaaactaaaatgccttcagcgatgatcttttcctttggaaaactagattcccactcggatgctacgaggggtaatctgtgctaagtttatggtgtgtctgccagggctctgctttaaaaaacaaaacaaacccttttggaggccttgacagttccatggaattcctaggaacagcctagaaggtgaatgatgcagcccagttgtttttattctgagtttggcaaaaatgatagagaagaaaatgtacttttatgtgttcgttcgacagttaaagagtattccagattcctccctccaaaaaaaaaaaaaaaaaaaaaaaaaagggcatattccctagccaaggcccacatggcttttctttactttaagtactcctcatattatcttgaccttaaagtttacagggtaaaagaaacatttatggaacagttaagaccagttagaacataacgacttgcctcattatcacactccacaaatctccactttacagagttcacttccctgcctgctttaaacatgtgtttggcctgcaaacagtgttactagtgctcgcatatggaaacagagaacttctcattccttacctcagacgtgccaaaaataagaatctttaagaactcataaagtaatttagcaccacgttaataaaagaagcaccattttgaattagttctgtaagtatgtgtttgagttagaaatagagttttaaaaaactgtctgttcatatagttcatctgcttaataagtaagcagctctttcaaatcaccaagctcaaataaaacaaacaaataatgggacaattggcaaaactctaaaaagtgatacaaaagaccaagggatatttgaaaaatgtttaaagttattagcagagaagacacaatttagaagagagactgtattccattttatttttatttatatttatttttgagacagagtcttgctctgtcacccaggttggagtgcagtggcacaatctcggctgactgcaacctctgcctcccgggttcaagcaattctcctgcctcagtctgccgactagctgggactacaggcacacgccactatgcccagctaatttttgtagagatggagtttcaccatgttggccaggctggttttgaactcctgggctcaagtgatccacccaccttggcttcccaaagtgctgggattacaggcatgagccaccatgttcgaccccatttttataaatgtaaaattaacttaggtttaaactattaatacacaaggttgagaagtatagaagtgggcattctaatatactgtggatgggaagaacaattgattttcatagttctgagatataatttggagatctctatcaaaagttttataaactttttttttacctaggaatttcatatctagaaaaatattgtaaaggaatatttaaagatatatccacaaatttatgtacagtgatgtttatgcttatattatttatagacttttaaaaaacttaaaatatttaacaattgagttattttatgatgatctaaactgcataggataaaatcctatgcagtttacagaaatgtaaactaagtgcttcgttaaatgaatcctagatcccgtgccttctgactgggtgagacctcccagcaggcgttgccagagaacttacacaggagcgtttctgctggaatcagctcgatgcctcttgaggacagagactcccagaggaaggagcaggcagccatccttgctgtgctgcagcctccacaggtgacacctcctggtgtgggagggacccaggtgaacagggtctggagtagacccccagcaaactacagcagtgttactgggaagaggggcctgattgttaaaagagaaacaaacagaaaacaacaacatcactaacaaacaagttcccacaaagaccccatccaaaggtcagcagcctgaaagatcgaagccagataaattcacaaaaatgtaaggctcatttacattacaggctcaggcctgtaatcccagcactttgggaggccaaggcgggcagatcacttgaggccaggagtttgagaccagcctggccaacatggtaaaaccctgtctccactaaaaatacaaaagaaattagctgggcatggtggcaggtgcctgtaatcccacctacttgggaggctgaggcaggagaatcacttgaacctgggaggtggaggttgcagtgagccgagattgcaccactgcactccagcctgggtgacaaagctatactccatctaaaaaaaaaaattagttatctctgccctttgggaggctgaggcaggtggatcacttgaggtcaggagtttgaacctagcctgggcaacatggtgaaaccccgtctgtaccaaacatacaaaaattagctgggtgtggtggcgtgcctgtaatcccagctattggggaggctgaggcaggagaatcactcgaacccgggaggtggaggttgcagtgagccgagatcacaccactgcactccagcttgggaaacagagtaagactccatctcaaaaaaaaaaaaaaaaaaaagttattgattaaaatttaaatataaattacaagtaataatgaaagtatgaaatttttattgattcataaatatttggttttaatcaaatatgatgtgaagctttaagtgaaattattgatattcgaagtttttttttgaatgtttaaatcatttcacattcacattttttaagtaaaatgaaacaacttgacattttagcatagaatgtttatatggtggccaaaaaagcagattggtatcatgctttatgtgtgttcattctagtcctgcacgtgtagaaatgtaagattttaatgtgtggtaaggtagatagatagatagatagatacatacatacatacatacatacatacatataaaattaggtaagaggatacttttaatgtatggtaagctatgattgcaccactgcattctagcctaggcgacagagcaagaccctgtctctaaaaataaataaataaataaataaataaatattttgtaaaaggtatcatagctgtataaaaagaaaagactaaaaagaaagccactcaaattccatttctcttctgcagatttttttttagttttgtatttcatctgtgattgactgtgtatgtatttttgcatatatacctgcaagcatttgtccttttaaccttaggaaaaaaagtctgattgcaactacgtgtttgggaatcagggagactatggaagaacaatctcagatctcagcttgaggctccacttgcaatatcacaatttctaaaacatgttgtatgtgggcccatttgccatgtgtgtgtgtgtgtctgtctatctatctatctatgtatctatctatctatctatatatatatatatatatatatatatatacttataatgtggtgggttctcgaatcacagttgtaattcacatttttctccaccaattctgataacttgcattaagaaattgactgtgtaagttaaattttagatcaataatgcaaattgcaagacctagtacaggccaaggcctcattatatctgagtagggctttaagaaagcaagaaagaatcgcttgaacctgggaagcggaggttgcagtgagttgagagcatgccattgcgctctgctccagcctgggcaaaaagagtgaatgaaactctgtcaaaaaaaaaaaaaaaaaaaaaagaaggaaagagggaaatatacatcctcctatccagggtgaattacaaatagtaccagttggttgtaagtggatttaaaattactttttactgctaatggggcatctgtcttcattcaacaaatatatttcggtctctgttagatacagtgtatctctgttagatagagagcattctgttagatacagagaatctctggtagatataaagtattctgctattctgatcttcctgttagaagatcagatttacagaagtctacatttgctctcaagggaccttcagtctgtttggagcaatctctttattaatttatttattcagtaaattttattcagaaccagctatatggcaaaccctagtccttatgctgaggtttcagagatgataatgggggcagatgcagccattcagttgacttcctgtggacaccagagatgacaggcccctgtccccagcttaccatccagcatataaggcatatatgcccctttccatgaagtataatctaatgagaacagttggagaaggtcaggcaaaggggacaggacaggaactcaggaggaggggatatttagacttacagacctgccctacctaaggtcccacagatggtctgtgatgacagatagcccctggactgctaagactcggatctttaaatataggcccatctgggctgtggggaggtgacagcctgagaaaaagtcattcttagatgcccttactctgttgatcataaaagtaggagctgaaattctcatagcctgagaagctatttgcagcattccctgagggctttgaaacactatcaaacaacaaggagagacaaaacagtttttagccctgctcaactctcatgggcttgccttattttttcagggcatgctctgtctccatcccttggctctgctttccttacattggtcttcttgggcatccgtcttccattccacagtgtagcaagccagaagctgggggaaacatggtgcgtgcctgtaatctcagctactcgagaggctgaggcaggagaatcacttgaacccaggagatggaggttgcagtgagccaagattgcacctctgcacttcagagcgagacttcctctcaaagaaataaatacactgtgtcctctcagcaagaccaggacaacagtgattctctttcctcaaagttccaatcagtgcccagggcttcatgcatattggacagacctgagtcatgaggccatctccgattggtccatccagggccatgtgctcaccccttaattcaggatgtggggtccggctcccctgaagtgcacagagaagaggggttgcccaaaggtgaatggggagaaggggatataagtgcaggacaggtaagaacagcaaatgctcattaacaccatgcagtgatgaaacgcctcttaatcaacccttgctggctgcagttgatttgttacttaccgtgaggttatcatagctttgcagagactttgtgatggggctgtcaacagagagaaagagagagagagaaagaaaagaaagaagtgccaccagtccattttgttccactcaaatgtagatcgtaatttttaggtttgtaattactgatgagaagaatgcctgagccagaacttcccagagatttatctgccacttacctggagtaagtagaaaggatatcagttttccccagtacacctgcctccaatgaagccaactctcaggctctagaagtctctgccttgggatggattcaccagtgtgcttctcaggctggccagtgtggaagcagccttgctgtatttcatcctttaaaaatacagcctgcttgccatctcacgacttttcccttaatgcaacaaagaaatatgtgtttggctgtgaaatctttttttttttttttttttgtttttttgctgtggagcgcaaaatgttcatttatctctggatggtttgtttctggccacctgccctaagtgtatctgaatattgtaacggtgatcacttcttgagtcttggtcattacgaagtgacatttggcatgaatttgctcatcaccacagagggccccagggacccacttgggagaaggtgagttatagcccacaagataacatttctcctggtgactgtcctgaaagcctactttgggccaccacatcagtgtgttgggagatgagttaagaggttttattcttatacatgcggaagaattatgccttcttgagccatgctcaggagatgtcagccttttccattgtctccccgcccccaccgccagccctgcttaaattatcccctctttttaaacaaaatatcctaatcttggaagtggcatatcatgttccttcttttttaagagagaaggagaaattcctgcagatcatcagggactgaggctaactgaagctttggaatggatacagtgctactctcagctgaaagcacaaatcacttccatcacgtatatgagattcctcttgcagcactgcagaggggtgataagcaagagttgatcgatgacagaacacccacccaatttcttgactcattcttcaacgggcagggtctatacatgtggtatggctgcaatgtttgttgataacccctacattcacaaaacgggcgcatgggaacttgtttgctgccttctgccatgtgaggacacagcaagaaagcacatacaggaagtagagatggagccctcattagacgccagatctgctggtgccatgatcttggacttcccagcctctagaactgtaagaaatcagtcagtatctttgtttctttcctttctttttctttttctcctttcctttctttttctttttcccctcccctccccttccctcccctcccctcccttcccttccctttctttctttctttctttttttttttttttttcagacagaatctcactccgtcgtccaggttggagtgcagtggcacgatctcagctcactccaacctctgcctgcctggttcaagtgattctccttcttcagcctcccaagttgctgggattacaggtgcatggcaccatgcctagctaatttttgtatttttggtagaaacggggtttcatcatgtaggccaggctggtcttgaactcctgaccctgaggcccaccttggcctcccaaaatgctggaattacaggcataagccacctcacccagccaagaaattaatttctgttgaatgtatgttgttatagcagcctggatggactaagaatcatgatgaaaagttgggttgctttcatatttagaaatatcttggaacgggcaggcgtggtggcacacgcctgtaatcccagcactttgggaggctgaggcaggtggatcatgaggtcaggagttcgagaccagcctgaccaacatggagaaaccccgtctctactaaaaatacaaaattagccgggcatggtggtgcatgcctgtaatcccagctacttgggaggctgaggcaggagaattgcttgagtctgggaggcggaggttgcagtcagctgagattgtgccgttgcactccagcctgggcaacaagagcgaaactccatgtcaaaaaaaaaaaaaaacaacaaaaaacacgaatatctttttttgtcagctccatgagggcacaaagttgtatcagcttttttttttcacagctgtgtcttcatcctaaaatagtttctagcacagaacaggactcagtaagttatttgtcaagtaaatagactccttaataaattgtctatcctgtatccagtacaatgcttggcctaatatacatccagtttcatttaatcctcaaaacacattgatgaagtgggtgttaatccctattttacagatgtgggaattgaggtgtagagctgttgaagaacttgcccagggttgcagagctctttcacaggggcagagcatgggctgaacaccagacctgtctcacactaaaggtgaaacaatttcccctgcatcaaactgtctctgatatgaagggtctacacactgtggtttgaaggtcagatgtggcctgtcatgtttttgtacagcccgagagctaagaatggtttttacatttgtaattgtttgggggaaaaaaccaatagaataatgttttattacatgtaaaaattgtatgaaattcaaatttcagtgttcataactaaattttaaaaacttttattgaaattccagagagatctgaagtagttttattggaacacagccctacacaccttcatttataagctatctgtggctacttttgcactatgccagcaaagttgagtagttgggatggagactatatggcccataaagcctaaaatactctctgctcctttccagaaagcttggcaacccctactatcatctccacgtctgcctttgttcttcttatttgtcccttccctctgaaggcaggatagcatagggtgaccataagactctctggaactagcctgcttgagtctagtcttggctctgtgctgactacctgtagggatgtaggtgagcttttttatttttctcaacctcagattcctcatcaaatggaagaaataatgagtatccactaccttgggttgtatggaatgaaccaagttaacttagctaaactcatcgcttccaacatcgcctcctatgtaataagtgcttgataaatgcaagttctattcttctattctctctctctctctctctctctctctctctctctctgtctccctctctccccctctctctcatagtgatatggtttggctgtgtccccatccaaatctcaacttgaattgcatctcccagaattcccatgtgttgtgggagggacccaaggtgaggtaactgaatcatgggccccagtctttcccatgctattctcatgatagtgaataagtctcacaagatctgatgggtttatcagagggttttgcttttgcttcttcctcattttctcttgccaccagcatgtaagaagtgcctttgcctcctgccatgattctgaggcctcctcagccatgtggaactgtaagtccaattaaatctctttttcttccatgtcttgggtatgtctttttcaacagtgtgaaaatgaactaatacacatagacacatacacacatgtacccacacacacgtaatttttgtatctaagaaaggggagaaatactttttagttgttctttctgcttcatttatgtgtggagtgcttaatgtggtcacacggatattaattgcatgttttcttgttttataattaagaaataaaaatgaatcactctgacttttcgcttcattttctgcatttgcacaatttggatattttattttgtagtctattaaaatgtgaaagtcagtgtaaagtgtcagtagctttcatgagtgttcttaaaggaaggccatctgattggaatgcattgtatctgtccttccctcttgctggggtcagcccaggactcgaggggaatgagcccctgaggaaggctcagtccttggcagcgaaatccaggcatggaaaccaagcctgagacatgagctgcaggacatctgacactgtcttttaagagacctgcctgtgaggtcctcatcctgctccctacactgcttcagatccacttgtccacttgtagtgagggatagtatctgttccacctgattgattgattgattgattgattgattgtgaggcagggtctcactctcattgcccaggctcatctctgcctgccgggttcaagtgattctccttcttcagcctcccaggagtgccatggtgcaatctcaagtcactgcagccttgactttccaggctcaagtgatcctcccacctcagcctcctgagtagctgggactataggtgcgtgcccccacgcctggctaagtttttgtacttttagtagagacagggttttgccatgttgcccaggctcatctcgaaccccttgactcaagcgatctgcctgccttgtcatcccaaagtgctaggattacaggcgtgagccgccgtgtctggcttgctccacgattttcctctatgaattccacctttcccatggtgggaccaaggctggaagtacttcacaaaggctccatttgaaaagtggctacaaataaaagggaaaatatagtattccttaaaaaaaaagtagcattctatttttccccattggtaagtagtacaaatttgagaaagtgtaaatttgaattccttaataatcagatctctgcaatgtgttttgcttttatcatcctgggttgccatcttggccaagtgtagattattctgctcagggtagccatactgagatcctggtgtgcacaggaaaagagctaacctttgtggatgaaattgtagagtcactacctgcatttgctgtagctcttacaattattttatttttggaagacatcgagagcatggtccaaagctgcataggttgcaagtgggtagaggcagaatttctctccaggcctggtggattctaaagctgtttactcttcacccaccatttcctaggtctggtttcttggttaaatacgtggaagagtggatggacagaaagacagattgatcagttctccacaggcttccccaaactggccaggtagaaataagctaagcaaataaatgacttccccattttataattttctgcaagtcacataagccttcatgttgtttatttcttggttttagatttttttaattataaaagaacattattatacattatttgaataattttttaaaattatagagctgtctaaaggaggcattaaaaaaaccctttctattccttcatctaattctatccctctgaggcaaccatgattagtattttgtacttcttgtacatcctccttcatgttaatatagatgtacacatatataagattttgttctcattttctgaaataagtggacacatactccaccatccccaggtagtgtacagtgtgtgccctttcaggctagtatgtacagctttaaatcattcctttacagagctgtgtaatattccacaacccagaggagcagcttgaagccagctaaagtatgtatatccaagtggaattaagagcttcatgcgtagtttcttgattttgattaagaatctttcttaatagatatgtcagacgtgactttatgctgcaagacatagcataggtagaaatttttatgtcacaggtgggcctaattaaccttgattaatgttctgcaaacccggatagactggagactcagaaagggacgcaaaagctagtctggttcccatgttagtccctgctctgtgagcagctgccacacagtcatgctgatggctcctgcagcagccattctggtttgactgtgctcgtgctgccctgtgacatattgtttaacacagtgagttatgacacagggagcgaaatcaagacttcagccaccgatttaacaaactggtgactcggagatcagcagtccggcattgccatcctcatcaaaagctctatctttatctaaaatttattagccaacttcaaacctgtttgccagctcactaatggaagccttttgaatcaatttgctcctctaatttaaacagcatttcaatgtatattgtcgaagcagaaaggagttgcagcttctggccagtagaattaattatttattatccttttcataaatactttccgaggccgacataactgaaaattgctcaggctgtttgaaaacacacacacacagttttccagtggctaatttgaaaaatgtcaccgtattagttttcatttacatctgtcaggaaacatatctatacataaggaagttttttttttttttttttactttcaccaggtatttttttgtggagtatgcatttaattcacatttacaaattggtttctgtttttaactaaagatactttttcagcagaaatgatgtgtatgatgtcatatctaacttttgatctcactggtatttgatgttaagcctcaaaatcatcaaattttttttacggcactgaaaaaaatacataaatctgcttgattggttcatagaaaaagacccctgtgattaaggtaatgctagtttttgcattttctcctagctgtcattggttggacacagtgatcctcgggtctcttgtgttttcacatgtcttgggaacagaagtgctggcagctttggtttcaggccatctttccaaggaacgttgtctagcaaagaaacttgcaaggtacagatagtgtctccctcaggagcagaggacaggatggctttctttccagtataataaagacagtgcctccttccaggacaacggtttggcagatttgcttgataaaggttggggtttctaagcttggggctcctcagccatgactgaaacgtactatgagcacggcatctaccgggctgttccacatcctccctgtgggactaggggccagggcaatgggaatcagtgcagaaataaagctcatgctgtttgctctgccatgagtaacgaagtcctctgtatctgatcctgggtctcctgttttctgctagcttcctcaaaacttggtagctaactcattaacttacaaggaagagggtgaacgtgtagacccttcacagtttgaaaaatcacctgatcaataactgagattatgaaaaggtaggaatgaaccaattatggcccaaaggctaactccagccagtagccttttatttatgacccgttaaaaaaaacaaaaatgaacaaaaaatccaaagaaggctgtgtgccagagacgatacgtggcccgaagatgaaggtacttaactatctggcccttcacagagaaaatgtgtcaaccctttcctgtttgcgttcaggtcaaatagttgcattgaaaggcctcatcttacaaatgaatcaatatttagtggtttgaaaatatgttgtttaatttggggcgattcaatatcaaattaagatttttaggtttatttatcgatctttagaattacatcaacattaagctaattactttaaattgtgtttttaagtaaccaagaatacatctgtggacgctgttctgtgccatcttgagtcacgtttttaaaacaattacctttgatgatttcgtatgttatcccattcacagatggtttttttcgtccacctgagtttcaaatctgttgtagtcctggaaattttgcttaggttgaaggaatgagtgcgtgtatcttgtcaaaggaaatcacaagcccatgtaaactcgctcttgcttccgtcacctcgtgctttgaaacataaccacagtgtgctgaggtttcacattgttacatcctacaagcgtgcttacctgcatcaccttgctgggctgtttcagcattggaatatcactgggaatctcaagttcccaggagccaaccacgagagcttcacagctcagaattttcaagatgtggatgtaggcagggagcctatgtagtaattcaagtaagcatctcttcttcttgttttccttataggatgatagaaggtcagtgcttgttcaccccagtgaggtggagcctctgaggtgggaggttttctctcatccttgagtttatctttacttcctggtcattatgcaagttaatttttctagcagtgaaaacagtcacatgggactctgcccagcgagggcgttgggaggcctggcggagaagcagttgtagcatcgtccagccttctctacctaacaagggaatatgtgaggtagggtaggacattttggtagcagtcacacagcccaaagagcatggtgaatttaattagtctgccacacctgtatggccttacgttttccgggataacttaacaagcattgtgtgcagccaggtcaggcagatggaggttctaatccaggctgcacacctcatcagccaggagactacagataagtcagccaaacttttggagtaacaagtagctcatctgtaaaacgtggatgttccaatttatgtatagccgcataatacattaccccaaaacttagaggcttaaaacaacaaccattttgttttatcttgtgatttctgtaagttggggctcagtggagtgactcttctgccccttgtggtgttgactggggtcagtcagtggtgctatgctggaggatgaattggactggcacttcagctggtccaggatggtcacccatgggtctggcactttcacgaggatgactgggatgcttggctcagctgagggactcttacccagagccctacacatggcctttcctgcatggcagatatagggccatcagatttcttacatggtggctcagggctcccagaggattccaaaagaaagtaacaggaagctgccagtttcttatggcctggcttaggggttggcacagcatgactgctgtggactaagcagttacaaaacccactcagattcaaggggagcagacatacacctcactttcttctggtagaagtgacaaagaatttgcagccatctttattccaccacagcaggtaataatagcatctccctcattacctatagaataactccaaactttctgatgattaagtgagatatcatgtaaagtaccaagcaccttggataggcaatgggaaatgttcacaacgttcccatttttacctataacagcagtagcaataatgctaatagtaatgatactagtaataaaatcaggataatgctgtttttaattcaccacactgtatgccatttgcttaaaatcagaaaggactcatcggtaaggagtagggtggtagtatcattttggtctgcctttcacccccacaagacaacatccttaacagcagctatgttgaaggtttaggagtgcttgtcattagggtctcatttccaaaatctgggacataataatagatggttactgattacagggatttttgtttgtttatttgtttgtttgtttcttcttgataatctctttcattcatcattccttcatttccactcttctaattctgggcattatatctttgtcagagatagagtcttttagctgtttcttcacctcccaaatccttctcaagtctgttctccgcctgctgtgccttcctatagtgtagctccaattgccttcatccttagaagacctttaatgatatcctatgccaaacttcctagcctccacctgtaccctgaattggccctagcctagttgtccaaactttatccccaggtggttgaactttctaagtttccccaagctgatcagtgttttggggtggtatggaactcagaatagatcactttttttattgactaactctgaccataagtatgcttctgtgcgagcctgacctccacggtaccaggcagagaacaacatgtatgcagagaactcattcactcaataaacatttattaaatccaagccatggggatccataggaggaatttagagcagagttgtcgaatggtcagatttgcctttcagaagaccgttctggcagccatgtgagaaaggagggtggggagacctgctgggaaacaactctagtcacccaggcacgaaatgatgagcccttgagcaaaagtgattgcagtgagtacagggaggaagaggaaacattttgatagatacttggtaaaatcaacaagatttggccaacagctctgaaggggatgacaggcgtggtgaatggagaaggaaggacagaaggctagtttgggacttctggcttggacagtgtattgtgtagtggaaccatcgctgaagataggaggagtccttttcagtcatactgaattcatgacgcctgtggggcacccaagtggaagtcatccattggcacctggatttagatctggcactcaggagggatggacaggatagacattgaccagacacaattatattggcatatttggactggagaacccagcatctgacttaaagagtctgcttctcttcaaaattgcttaggtgttttcaaactacaaacaaatacactcccaaaacctcaatagattctcccagtataccctatattttggccaaactggaatcacatcctggtctccccaaacactgcttgctttttgttcctttcttgctcttccttctgattgcaatgaactccccatttccagtccccatcctccaatcccttcatgtccagctcctgctcatcctttgaaacccactggattttaagattccatctgacaagaatgatcactgttccttccagttcttcaagcactttttctgtttttgatgggatttatcacttgaaaatgcatattatagtaatttctgaattcatcctgattctcctactggtttctaaactcttcaggttagaattcctgttggatatccctctggcccgaaattcctgaatgagttaagcaggacacctagaactatgcagaggtaataccttccttgacctgtcccttttctgggtcagtttgcccttcatgatttcggcaggagtgtgtctccttccattctggtgaacacatccaatgttcaatgttgctcatcagggtaagagttctaagtccctatgtcttagagacaggggttatctagctttgtcttctgcattggcttcaggcttcacatccttcctggacatgttcaatgctgctttcgtttcttgggcgagggccctagaatcaccttagacaccttgctctagacatggccccatcgtggtattcccttttgagaagacaaagattttaaaaattctttctcccttaatgcctcatgaatgcccaagcagcacttcatggaagtacactgagtctctactgcttgcagggattaaacataacattctcaacagtggtaagagagcctttcccttctctttggctcgttttcagtttttattaatttcctgtgcttctggttcatgaatcccaagtcatgatgtgaatcagttcagttcagcaagcactgagctcccatgatataacaggtttttttcttttccgagctgtggcccatgcagagtttactgagacttggctcttgcctttatgctttaaggatcctaaagagaagatgtaattataagatctaaaacgtggaggggggtggtgaattcagcctgcaggcatgtgtttgctgcccccacccccacatcctctttttttaaagttcgcataaaaacctggattcttggtttctcttaaaaaactggaaggtctggcacctttgctcccacatttcccgggcgcagcccttgactcaccctgtacggtggccgccccagttggatgatggggcttgtgcccaccgggtcagctcacaccaaccagcccctattaatttatacctggcccgctttccaaattgacattacctggctggtccgtacgcatcccctgcagtaactggctttctggaggtatgtgctgaggatctctttggcttctgcatctcaaaggatgagtgatttagccaggtggagaggttggggcggtatcctgaatgaaagaatagcacagacaaaagtagtgagttgaaaacagaacagcatggcaggctcccagtaatcccatgagtcacgtgttctgcccacatggaatggatggtggagaagggaggagggaggaggttgggccagattaagcagattgtccccattggtccatttttaaatcttccttttggtatttgtcccttaaggcaacactttcagtctcagaaaaaatccagtaaagggcaaaccagtttgggtgaatttctttgtttttgcagcatgtctggtcccaaagtgggacctggagtccttccgacgaggaagtgcagcctcttgtcgaggagtgcactgggaggggaggctggacttctgggctctgctctgcctctaatctgctgcccagcatcagccttagcccagacccccaaacttcctgggcttcattctgctttgcattcatctcaaagttaagccttctggctggcaggggtttctgagacagactgacagtattagcgtgctgcagtttcatgatggcaagaaggaggttaccaaagccgttttcatacaccttaactcatgagtggtagtgagtggccccaggtgggaagcacaggtgatttggagctggctaacctccttcctttggctcttactctcaccagctcttagacttggggtaggttagttagctcctcccagcctcagtttccctgtttgtcaaatggggtcatagagggtgagaatcagagtttatgcagggcatagcactagtgtaatgctgggcagagagtgagcatccagcaagtggttttgacaatgataataattataacccaagcgacacatacaatttaatcaggcactgtgtgtccacagcgatgtcaaggaacaatgcacaaagcagagtttttccagtctcctgatgtttgagccctgcgcgagccccactcttctcccttttctcataactgctgtgagcaacctcaaatccttctggaagtaggttggttatgaattatgaataattaaagaaataaactctggctctgcagctgaaattgggatcgcatggagaaaatagaaagtccagtgtttgtagctgtgatctctcagttgcttgcatgaattgtgctttaagattgtaaaattttagcccattaaaaataaaatctgttgctttccacccacacctggcaatttggtgagggacgggggctaggatatttactgtctgaaagttttagggaggcttttatgaactgggccatctctccttgtccccatttttctttgcatctccgaactctcattaatttttcacaggcttgtgatggatagtttttatttattcacgtctgagattccgttgtgtgaaaaggactcattttataacattacatattcatggcttgggatggatgggataaggaacttattattaatgtgtcactgtgggaaacttactctagttcatttgcgaaccttgttaaattcggtgtggtcagcagacccggtgaagttttggatacattctcttaacagagggcaaagagtttgctgttgcttttccttgattcagtaaaacaagtttaaatcttatttaaatcgtttgaagtagcaatttgaaaggggaggaaaaaaagggggatggcagagattaagtagagagagaagctccgattttcttgttgaatagccgtgtttcctcagcattctgtagatttttggccaggtttgtgtaagggatgaacgactctctataaaatgatgtcaggatcctttctttcctgcccattgccatttctagcattctctccttgagggaagttgcagttttctccctctgtgtattcatccttctgacctgtgctccggattccagggagttctcaatttggagctcataccgacatcacagaattccttgcctgggacaaatagagggaatattaacatagcatcttgtaaatcaaagctgggcagggggtgggggagggcacagtggggaacctggcccaatctgcttcagtgtgagcttggtaagaaggaagcatatgttgcatttagttctctgcaaagacaggcgctgctctctggcagggacagcgtgtagggtttgcatgatttgtggggccgtttcatgtttgcacggtttggcttggcttgggactcggccagtggtcactgcagtttaacagattccccccgggtgtgaaggaaagcgagataaatgcaggaaaaaggatacattttgaaatctggaaattttacataacaggcatcagatttgaagaatgtccaaaatattacgaatcatagcacaacctttgctaacaccgtggaaatttttgaacatggaatttgttaatgctgacttggcccaccatggggttaaaaaaagtgaatttctttttgataaccaaggtgatgatcttatgaagttgatgatggggtgtgaacggtgtgagtgggggacaaagcaatgaaatatcccttaaaatgcatcctctgatgatgtttccataatgccaaacatttgtttctctccaggatctcattggcggtttgctggtattatattgccatttatattggaaaggcaggcagtgcgaaaactgtagtctattaagagtttgtgagtgtgtgtatgtgtatacagtgaaataatatctagtgtaatgtgaagtgacagtcaaaattacagcttttctcttgccgcaagggtacttctctgccaagtatagtaatattgttgtagcagtgttcaaggttgtcagcaattctggcttactctgcagagagccataatagtgtgtggaaggaaggagcttcctgtcaggggaaatactataattttgatatatatttgttggtgccaaactgcaattaaataggaggtgttggaagaaggttttatttaaccagcttgaatttgttaattaattagcaaaaacttatctttggaatgcttcaagaaacagttctatgttgttctcataacttaattttacacaactgtcttttgtttgtatcttacagaaaacaaaataccaccctccgccagaaaagtgcagaataaaaattttccactagcaaaagaaggaaaaaataaaagatcttgaatagtctcatc

SEQ ID NO: 1109 - DNA, 545 bp, Homo sapiens
gcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggtccagcgggggtcacctggtggcttcccggcgcgccctctgctgttcaggatgcagcactgcgcggcgcggcgagggcaaagcggcctcatccccgccaaaaaataaagatgttttaaaaagcgc

SEQ ID NO: 1110 - DNA, 3017 bp, Homo sapiens
cagcaacttaagctattatgatcctaattttacagatgaggaaaatgaggcacaaagaaggtaagtaatttgttcaagagatacacagctagttaaatgtcagagatgagacctaaacccaggcactatgggctctgaggcctgactctccagtgctacggcctaaaactatctttatgctcagtttatcctgaataatctaaacaatattaccaaggctcagttatctgcttaagaaaatccctgtctctccacatgcaaaactagaatttaattgattgattgattgattgatttttgagacagagtcttgcactgttgcccgggctggagtacaatggcgcaatctcggctcactgcaacctctgcctcccaggttcgcacgattctcctgcttcagcctcctgagtagctgggattataggcacacaccaccacatccagctaattttttgtatttttagtacagacggggtttcactatgttggccagactggtcttgaactcttgaccttgtgatccacccgcttctgcctccctaagtgctgggattataagtgtgagccaccacgccaagcattttttttttaaacaaatatttttaaaaataaatattaaataccatctagttccaaaactcccaaagaaatccaacacagagtagcaagcatgtatatatcagaacagcatgaagtttaaggccatgtcttgggatagggcagacctgcatttgggtagctgtgatctcacatgctgcaaaaattacttcatttaaaaaaatgtggctaggcgcagtggctcacgcctgtaatccaagcactttgggaggccgaggcaggcggatcatgaggtcaggagatcgagaccatcctggctaacacggtgaaatcccgtctctactaaaaatacaaaaaattagccgagtgtggtggcaggcacctgtagtcccagctactcgggagcctgagacgggagaatggcgtgaatccgggaggcggagcttgcagtgagccgagatggcgccactgcactccagcctgggcgacagagcgagactccaactcaaaaaaaaaaaaaaaaaaatgctaaggtgttacaagtaacaacttctctaagcctaaatatcctgatatgtaaaaataggggtaataaaatacaacttcatggggttgtcaggattatgtaacttaatttatgtaaaatgcttagcatgttgtccggcacatagaaaattttaactgttgtctcatcattatcatacttcattccacaaatacttattgctatttgccaggtccagccctagtcataatacactcaaaatgcatcttaatatgttacacttcacatcttcacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaaaattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattttttttttttcttcatgcctaccctttttttggaagtttccagccgcaatttgaaatgaaatgacaaggtgtatatttgatcaattttcattcccaccattgcattacaacctctaacttaaatgggtaaccctaaggcatatcaaagaagcagattgcatgataaacggaaacagaaaaaaagaacctacatttattttgctttagcatccttactctcaccttttatgagattgagagtggacttacatttccttttttacattttcgtatacttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattgctcaataataaagcctgaattctgatcaatagaa

SEQ ID NO: 1111 - DNA, 9556 bp, Homo sapiens
gcaagatgtagctgtgtagtctccttccatagctgctctaagggggctggcaacatggctcagcaggcttgccccagagccatggcaaagaatggacttgtaatttgcatcctggtgatcaccttactcctggaccagaccaccagccacacatccagattaaaagccaggaagcacagcaaacgtcgagtgagaggtaatggggcttctcaatcaagcaaaattctaggcttagacagtgtggggaggtgctggacaatgttaattttcaaactcctccaggagactatcttcggtgatggcaccatgccatcatccctatatggcatttcaggggattaagtgaacttgtaatgctctgggatagtttattttaaagaaaccaggctgctgggttttaaaaaaaaacaacagggaaaaaatttgatagtaaaagaattctgtgttgtatattttttgttaggtgggcttaaatagaatgtgcttcagaggaagctcaagtggatttctgaaaatctggtgttattaatatggggcaagaagaatgtattaactgagcacactgtttcactagtagatattgagtaactcaattcagttatattttaagataactataatcttattcaatgtgtagcagaggatagagattttggtaatggtgacttcctgttttgtcattagttatcattagctgtatttccatatccttggcagcataaggacaacctataccatatatttaaactttttcatgtcagagacattgaatctctccaacttaaaaaagtcaatatgcaaagtcatctagtatttgaaggcattgtgatgcaaaactgaatctcccaggaacctcaaattttgagtgacttgaattgggttaacaggttaaagaaattgaaaagaacaatgatgatagcgaggtgtttgcaatacgttgaaacctaagcaaaagaaaaaaacaagacagagggtcatgttttatcacatcctctgcatcattttcatttcaggatatttcagattatgactatttccttattttcactccattagtaacaacacacacatacacaaatttcagcaaggttacagtctatttcacatgacagatggctggtgggtaaaaaggggtcttgtgctttaaggattataaagtaccattttttcagggacatttatttacaaaatttaggtctggtgcaaggtttcttttttttttttttttctgagacagagtctcgctctgtcgcccaggctggagggcagtgacacaatcttggctcactacaagctccacctcctgggttcacgccattctcctgcctcagcctcccaagtagctaggactacaggcgcctgccaccacgctcgactaattttttgtatttttagtagagacgaggtttcgccgtgttagccaggatggtctcgatctcctgacctcgtgattcgtcagcctcggcctcccaaagtgctggaattacaggcgtgagccaccgcgcccggctagtgcaaggtttcttaagtggaatcttttttccttaagaaatactgtacttctttcggtgaaagattaaaatatttctcatgagtagatgaaacatattgctgaagatggtatcgaaaggagaggggagagagaagatactgggtgacatggtacatttctgtagccagcgtttcttcactgctggatggagtggcactcctcgtgagagtggcgatcacccagtaggaatgtgtgaagagggtctgaacatgactgagtgtgcatgtgggtgctgtgtgggtgtttctgaagtaatcgcagcttaggtcacatccaggttttccaggggcctccctccccttcctcctcccactctcttctctctccctaccttctttcccacttctttacccccttcttccccactgcctctgtcataaccacatgtgcatgcacatgcttttatttaaaaacaaaacaaaacaaaactgactaggtacacacctcttaaatgtcattcccccagtatagtttttgctactttttgccattaggtcctagaaagtagattctacagtaggtgaagcaataaacctaaaccgatcaagcaattatatccccacccatccatatacttttaaaatagtttaagtaccttgaaatataataataccagtgttaaagagatcaaaagtgaaagccatcttctctctcccaatcctcaccacaaaattatccactattaactatcaggtaatactattcccagaagttttgtgttttgttttttgtaggattgtttgttttgagacagagtctcactctgccacccaggctggagtgcagtggtgtgatctcggctcactgcaacctctacccaccaggttcaaacaattctagtacctcagcctctcaagtagctgggactacaggtgctcgccaccatgcccagctgatatttgtacatacatcttttttagtatagatggggtttcaccatgttggccaggctagtctcaaactcctgacctcaggtgatgggattgcaggcatgagccatcatacccagcctattcccagagtttttaaaatgcacaattaaaatacatatttttaacaaaataagaattggctatgcagaatgtttggctaggcaaataaatttatttcatctattaaaccttggatagttaccagtgtaagcaatactttattcattttaacagctgcataatattccattgtttggatgggtcatcacttaatctgatctctcccaatacatctctttttgattcaatagccccaagtaactgctttgcacacatactgctccccatgttaggatgttatgagacatttccagaagtaaaattgcaggttaattatactttctaattgtccctccaaatgataacaccaatccatcttcccatcttctgtgtatgggagtgcccattcctatgtattttgacagtccaacatcatataatggttttactggccatgtcttctgggaatgacttttgtgtttctacactgtgtctacctctggagagcaacagtaaaatgaaagggagccttctgggggactcaaaatagcaaccgaagaatttagcttcaaacacaagatctctctggtacttgcttcataggtctcaatttatgtgttgcattcatgaataaaatatgacttttccagctcagtagttgttccacatattccctttgtttgttgtacataaaagacatctatatcagctacaaaggatggaagctacagccaagtccctggacaatgaatttcataaccatctcccaggagcctaatatcaattcatgtgtcttcatgttaattacaatgtttacaatctcccagtagaggccacttatttaaggagaatggagcaggaagctgagagggatgggggatgacatttttagaggtgacagcttataccttggaagaaagtgttcagcagtctttgcaagcccggcccccaccagctgatgaatttgcattctgaatgcacccttacattttttctggattaaatggtcacacaggtaaaaatctttaggttatagtatttctgagctgagccatgggatgctttgagaactgatgtgtagcattaagtaaaacagaggcaggggccacccctggatattccagaagacagcttcctaacccaaatgaggaaacatctggcttatgaagcacatgtttaaggggacagtgaattagcacatgtgaattttagactgtcctgaaaaatccagtacagaacatagacttcctccatggaatccccacaaagaagcagctgggaacagttcataccaagctttaagtatcttctctgtctggggccatgtgctcgggaccaagaaggtagaggcaatcactgtgcagaagcaggtaagagggatgaaatgagaacaggcctggagctgggcaaatttaaatcccaattcttcactttactagctgggtgaccttcagcaggtgaattcagctttccgggactctttcttctgcagaatggagacaatgattgtgtctctctcaaagcactactgaaagaattgatctctgacaaacagtatgtggaagcttttaataatttttgttatgatttataattcctgcttttgaagacctcacaagctgccaatctctaagagaatccttattacacctgaaatttcaatttatccaaggcttcttgttttctgccacttacttatagccaagattggtcaaggacagctataaagatcctttagcctcatccaggaacatacaagacttaagttgctaatacctaatatagacgtatttctatatgaacctttagcacttaaccctgctagtagccaccatacctgaggcatgtgttgagtcggaacactggggacaggggacctggggacccaaatcagtcagagtatgaattctgccatgtatcttttgagacactctcattggacttgtcctcattcttcagtgggaatccaatttttctcccttcatagctatgtttgaagagcaagtgaaaacaattttgtataccataaagtgtgtattcactagacaatattatgaacacctattatgtaccaagtatcatgttaagcatcagaagaaccaagaataataagacagatgaaataaagtaaaatagagaaaagaaaatatacagaatactctataaaatatggaataaaataaaatgtgaactgagactagagaatgaagaaaaataagtttcaaagacagattagcagaagggatactaaattatagtataaccaggaaagccttctcagaagaggagatatttaagcttgctaagaatacaggaaagcgctggagcaagagtgatcctagcagaaggaacacacagggaagatgagattgagctcattctcagatgaccctgaaagtcaacaagcctagagtcacaggatgtgactggagagacagaaggagcctcatctcacagaaggaccttctagtattatgattgccatgaagctcttaagaatcttcctgtccaagttattttctttttctttttttccttccttctttccttcattcattgtttttttgtttgtttggttttttttcagacagagtttcactccctcaccaaggctggagtgcagtggaatgatctttgctcactgcaacctctgcctcccaagttgaagcagttctcatgcctcagcttcccaaatagctggaattacaggcattcaacaccatgcccagctaatttttatacttttagtagagacagggttttgctatgttggccaggctggtctcgaactcctggcctcaagtggtccacccgccttggcctccccaagtgctgggattacaggcgtgagccacttcgccagccccaagttattttcacgcattattttttgtatacactgggctcaggttcaccaaaaccactattgccttgggtcctacattccaaagcttgattttattttaatcatacgcttttcatccacctaccccatcccaccctaaaattttccccagacaaggatggagatctgaagactcaaattgaaaagctctggacagaagtcaatgccttgaaggaaattcaagccctgcagacaggtaaggtgcagaccttctcagtgccttgtcccaaaggagacaggaaaatttctgggtcaatttctgggggacgtctttttaaaagaaacattgacaaatcaataatgtggccaataagagggccccaatgccgggagatgattgttttaggaaatcagcttcatttacaatcccattctcctatatatgggtggtatagaaataaaaataagtagttcaggaataaatttgaaaagtcagtccatacttattctctaaagagtagtgaaacagaatgaagccagtatgaaatgactaaaatgattagcatttattggatgatagctaagtgcctatcaggccaccaggactctctcgggccacacccagcctaagatgctggaaggacatgggttagaaccgcagcttgccaacagggcagcgccagcgttcctccccacagttatgcagccacatgcgctactgcccaggagctattctccaaggggtgaggaagtgagccatgtgggcaggtttgggaacagccctggtttacaaggctcatcccccaaggagctaatatcctttgtagcaatttcaaaagcaaggtgttgaggttcctcacaagagacctgcctcattacaagttactgccttcagggaagactgaagttacggctttccatcaagtatttataactcccagaccagatgcatgttaccaacctggggtcatttttaccacaagcaatgttgcctagtaacaagggtgacatactccctttatcaggcttccgggggaacagaattagaaagttaaaagacagtcaaatgcttatgcagaaggtgagtttggttcatcctttacccacagtcaggtactagaaattctttataaacacaaatccattaatcctccagcaacttaagctattatgatcctaattttacagatgaggaaaatgaggcacaaagaaggtaagtaatttgttcaagagatacacagctagttaaatgtcagagatgagacctaaacccaggcactatgggctctgaggcctgactctccagtgctacggcctaaaactatctttatgctcagtttatcctgaataatctaaacaatattaccaaggctcagttatctgcttaagaaaatccctgtctctccacatgcaaaactagaatttaattgattgattgattgattgatttttgagacagagtcttgcactgttgcccgggctggagtacaatggcgcaatctcggctcactgcaacctctgcctcccaggttcgcacgattctcctgcttcagcctcctgagtagctgggattataggcacacaccaccacatccagctaattttttgtatttttagtacagacggggtttcactatgttggccagactggtcttgaactcttgaccttgtgatccacccgcttctgcctccctaagtgctgggattataagtgtgagccaccacgccaagcattttttttttaaacaaatatttttaaaaataaatattaaataccatctagttccaaaactcccaaagaaatccaacacagagtagcaagcatgtatatatcagaacagcatgaagtttaaggccatgtcttgggatagggcagacctgcatttgggtagctgtgatctcacatgctgcaaaaattacttcatttaaaaaaatgtggctaggcgcagtggctcacgcctgtaatccaagcactttgggaggccgaggcaggcggatcatgaggtcaggagatcgagaccatcctggctaacacggtgaaatcccgtctctactaaaaatacaaaaaattagccgagtgtggtggcaggcacctgtagtcccagctactcgggagcctgagacgggagaatggcgtgaatccgggaggcggagcttgcagtgagccgagatggcgccactgcactccagcctgggcgacagagcgagactccaactcaaaaaaaaaaaaaaaaaaatgctaaggtgttacaagtaacaacttctctaagcctaaatatcctgatatgtaaaaataggggtaataaaatacaacttcatggggttgtcaggattatgtaacttaatttatgtaaaatgcttagcatgttgtccggcacatagaaaattttaactgttgtctcatcattatcatacttcattccacaaatacttattgctatttgccaggtccagccctagtcataatacactcaaaatgcatcttaatatgttacacttcacatcttcacagtctgtctccgaggcactaaagttcacaagaaatgctaccttgcttcagaaggtttgaagcatttccatgaggccaatgaagactgcatttccaaaggaggaatcctggttatccccaggaactccgacgaaatcaacgccctccaagactatggtaaaaggagcctgccaggtgtcaatgacttttggctgggcatcaatgacatggtcacggaaggcaagtttgttgacgtcaacggaatcgctatctccttcctcaactgggaccgtgcacagcctaacggtggcaagcgagaaaactgtgtcctgttctcccaatcagctcagggcaagtggagtgatgaggcctgtcgcagcagcaagagatacatatgcgagttcaccatccctcaataggtctttctccaatgtgtcctccaagcaagattcatcataacttataggttcatgatctctaagatcaagtaaaaatcataatttttacttattaaaaaattgcaacacaagatcaatgtccatagcaatatgatagcatcagccaattttgctaacacatttctttgggattttgcccttcctggggtataggggatcagaaatattgatccatgtgcacgcagataaaatggcttctgctaaacagactaaaatctttctctctagtctttctcacttgtacaaacccagtttgttttcaaaaaatcacagtagcaatgcaactcatcactctagaaaagcaagcttaggctacctgaaagattttcccttggaagtttagcgtatgtttgactaacaaaaattccctacatcagagactctaggtgctatataatccaaaaacttttcagcctgttgctcattctgtcccatgctggcaataataccttgtcagcccattacccttattttgaattgctccatctcctggtgggacttgtatcttgtctgccatatcagaacacaaacccctgaagaggttctgatttgattttttttttttcttcatgcctaccctttttttggaagtttccagccgcaatttgaaatgaaatgacaaggtgtatatttgatcaattttcattcccaccattgcattacaacctctaacttaaatgggtaaccctaaggcatatcaaagaagcagattgcatgataaacggaaacagaaaaaaagaacctacatttattttgctttagcatccttactctcaccttttatgagattgagagtggacttacatttccttttttacattttcgtatacttattttttttagccatcattatatgtttaagtctattatgggcaaccaatctttggaagctgaaaactgaatttaaagaatgctatcttggaaaattgcatacgtctgtgcaattttttattctgcctagtgctattctgcttgtttaactagattgtacaaaataacttcattgcttaatatcaaattacaaagtttagacttggagggaaatgggctttttagaagcaaacaattttaaatatattttgttcttcaaataaatagtgtttaaacattgaatgtgttttgtgaacaatatcccactttgcaaactttaactacacatgcttggaattaagttttagctgttttcattgctcaataataaagcctgaattctgatcaata

SEQ ID NO: 1112 - DNA, 324136 bp, Homo sapiens
ttccaacaatatttgtaccgtttttatttgtaaaaataaccatctgaatgcatttccatagtatattacagttaagtacttcattacgttattagagcattcagtagttgcaaaagtattaaactgtgcttgagaagattcagattgtttcaaagtcattcactgaactaaaagtcattttccccatttttacagtcatgacatttaccagagtcattcaactccaatttacataagaaaacattatagacaaaatcccactgaaatcatcaaacaatattttatgctgttacaaatatgttatgcaaaatataacactggcaccagatttgtatcatcgtgctttacaaagatatattgcacatgctagagcataaaatatgtagacaaaactaccaaataaaagatatttgcattgaatttttagatcacataagaaacgcatagaattacattttatacaaacactcagattgtcactatcttaaaatgcttttcccctataatactgacctatggtttatagtttcgtaagacgaaagcattttagcactgcaaaatcaaacaattcctatagaaaacttaagcattttcatattcatttcaatgcaagtacaaggggaaataggaaaaaagacactttatacattcaaagaaaagttgaaatgaaaactcactggtatcatattgctctgataacactcaaatgaaaaaatacaaaacattccacagaacattttcagaatatacaaatataaaaaggcactctaacttcatattacaagacaataaaacggatgagttcttcaaccaacacaacatataagcacaccaagttgctcaacagtacaaagaataactagtgcagcaaatccatttgatgttcttgttctaatttaataacaaaatgataaaccaagcagtgtttactgcctaaagtaccaaaacatactatggtgcccttttagtagtgataaatagaaataccctgagctatttactgtagaatcatagcagattttaggcaatttggagatagtaatgtatttagcaaagacaggcagacactggcaaataagtaagtgcaatgaaacatgatccttgtagttgtggttaaaatacagtctaaaaataacacaaataaaagcactaagcaactaagactcagttaaaaacacatttttttttcttagaaagctatggtgcaaacataattttatttctaagagatgtaattaaaatacagaaatgatagtttttaaagtcatttctttaaaaaaattttgccttggggtatgggagaaagagaaagagaggaagagagagagagagagatcagttgatgtaatgaacagttcattgtgagcatgatttcatttcgttcctttgtcctccttctatgagtaagagagtgggaaaagtcaaaacgcagctccatggagataacgtctcatggtgagtcactgctttgctgaaatgattcttgtactctctgctacacgacaggaaaaatgttaacgctgctttgccattaaagcaagcatttcatttcctgcttgaaatgccaactgagcaagatttccattcacttctagaaaaagacaccgcagcatattgtgcttcttcaacactgaacctctcttaattttcagtgttttggtaaagataaggtcattattgctcattagcaatttatctgctttttaaaaattcatcttctctaaacaaacgaaaaggacagaaggtgggaagcacaacaccaagaattcaaaaaaacaatggtggtggtgtggaaaattttcagtgaaatcaataccagttcaataaatcctttgaacaagttctcatttgtgaagaacccaacaggagttttaattaaatccaggatattaagagtaagattaaagttttatagctagatgaaaaatataatacagttatctgtctttgatccagatatgatagaacattatttttgaaatatctcacatacactataaaatagcaatttccagggtggaaatggaactcattataaaacgtcagagagtactgctctaattcgacacatttcttttctgtctcttcctcaagtagaaaatagcacttgagctggtgatttttatttctccttttggcacatgtgcccacacactgccatcatttctcatcaggttactgagactatgtgagcttttcagtgtacttagggtaatttctagatatttctttgtgctgcctttgtgtatatgatccactacacatctgagttttcatctcgcagaagggcatccagactgcaatgtcttctaagctctaagctggctacagactgtggctgagcagtagaagatgcgtagccctctctaaccaacgcggaagaacctgagggtcatctggaaaccttagcagtggaaatgctaggtttggcccttgggcttttggctagcccagggtcaagtgttttttttttcactttttttttgttattctaaataagatacatagcaattaaaatagagaacaaataatggatgtttcctcaccatttgtttcatttcaaataaatataaacacatttacagcaaaagtatatggacattttctctagtttggcaaaaaaaaaaaaaaaggtcagcacatcatcagttacaaatgttaagtggtcaactagaaatctgtgtcctaagaaatataaaatacaacaaagactggtacacagaaagattacatttaactccataaaaaagctacttcagttctcacttgcattttgaaggaaaaaaatgtgtatcttccattttagactgaagcattttggtcctcatgtgtagctggctgatgaactacacacacacacacatatatatatatatacacacgcacacatatatgtgtgcatgtgtatgtgcataatttttaaagagtctcattcttctttttgtacagcggttccaggtgtggaacggggtccatttgacctagaagctttggcagagggagcagacacagtattcactatgttgatttcatcatcaagcaactggcaatcggttttacatgctaaatcacccatttctactttctgctttcactttttttgttcctttttgcagtcacacttttcactgacttggtatgaccttgactgagaagctcattttactactgatgaacaatgctgatgattctgatgttttttaaaagttagtattttgatttaagaataaattaacaaagggtagtttcatactatttttgcatattgtgtcaaagttttggtgcaatataattttcacctgaaatgttattagataaatttgggttcaatcacttaagtgaaaattagtcacaggcttgttatagggaacactgtgttaaacaaaaaaagcaagttcaatttttcaattcatctggcaactttaacagagatcctcagaaagaagttctggatattcaaatgcttactatagagaggatataaatagttggactctctaaaaagattattacaggcattatttctgaagatggacacctttacctttggcttctagtgaggaagtaaacatcaaagtgagaagaagtttgaggcatttcctatctgcctcttcccttccctcccaggggacatgaatgtcacactgatatacttctgagaactcactgctaaatacatgaaaagaaaaattattcatagcgaacagctgcctctctgctgcattatccccaaagaacaggaattaaatacatcttttattctttatttaaaatgagaggtagactttcacagaagtatcttagatttaaagaaaatgtgaaacaaaacaaaactggggccatctgtgtgactgttccacccaacagcctcactgccctccctcgattaattccttctctactagcttctggaagcccaggccccaaataatacttgaatacaacataaacctggaattcaagcttctttcctttcctccaacacaggtgatcaaagaaaagcttctacagtccaaagtcaaaacgtttccgaatcagaatcattttcattgtacccatcctccgagcctacgttgttactgcacaggctaaccatgctacccagattggagagggtcgtcctgctcaaattgtctttttttaaacaaacgaagttgacagccatcattgtactggaaggagaaaaaggcatcatggtagccaaaatgagggccaggcagtcagccacgtctttgttaggagcgcaagccagggccggggtatgacctgggcgtaaatgcagacaaggcagtggttagtcctggggagcctagaggaggcacgagcattccacagtacatctcggatgatctcacaggcggagatgtatgttgagttagaaatcatgccaggtaaaacgaggagttacttctcacaagtcatgctaggggtgaggctagagggggagggagggggagacattttatggagggctttttatttttgttttcagctcatatgactatgacaagcacaatatcatccaaagttaggcaggattccagccttcatttagtgaacacaaacacaagggggtgggtgtgggacacaattccacaataaacagcaacaggacaatcaggaggatgtttccgcctgagagcacacacacaccatgagcctcaggcctgggcctgagaaggactctcattctgagaacaatgactttccattgttaggtaattgtgtgtccaattagaaaagatattgaaaattagatgactgcaaaagtgagtaatgaagttttgtcactttatatatgcttcatagaaaatagacaccaataactggttttagaaaaatggaatcatttcagtagatcagagacaggaaagcacaggttgtttgtgattaaaaatgtacaatcatttaggagaaatttaacaaattttttttttgacagagtttcactctgtcacccaggctggattgtagtggcatggggccttgattttactacagccttgtcttccgggctcaagcaatcctcccacctcagcctcccgagtagctgggactataggtgtgtgccactactaccggctgattttttctttttttggttttttttttttgagtcaaggtcttgctatgtttcccaggctgttctcaaactcctgggctcaagcgatcctcccaccttggcttcccaaagtcctgggattaaaggcgtgagccatcacacctggcctaacagaatatttaaaaatggccactcaccaatcaaagtctcaaatctaaaatgtaatggatgtgagaaaattactatgcttgtcataattagaaccatgttattctcatttagactcaatggatccaatccagataagaaaactgtcttaactcataatataggttccttggggaggtagattaagtctttgacttgattatttccttatccaacctttatcctactggcctgaaaagggttagctgccttctcagctggccaaagtttccactacacagtgagtagggcacttgctcagtaattcagaggaatggctcaatgaaacttaacgttttgttgttttgtttatcatcactcgacctgctctccccaccctgccctttaggacatcattcctttttctggtatgaaaacaaataagaatgaacaggtagtttaacattccatttcacgaaagtcagtgatgagtaaaggaattatggttgtactgctatataaaattgccccaaacgttcccaggcctttgggatgcaggtgcgcaccaacccagggctcttgttcctaaggtcactatcagctgaacaaaccttcaatgcagcagatttacaccaggaaaagcaaaactaatttattctattctctttgaccattttggagaaaaactgtgggcctctgcaggccaaccctaagtctacagtagtgttaagagggtgagggaaggtgaggcgggaaaaccaaggaaatggagtaatagggaactttctgcacttcctagatgagtcaggtgggggacacagcagggtacatgctaggatacatggggctgcaaaatcaaaactaataagagttagctaatgataatcagtatggctgcttacttctgagaaataggcatgagctgctaattccaatacctgtaataagcagttaattgagttacattaatacattataatactttaattaaatgccacattttaaaaattacataattcataaacatccagaagttccttttttgctccccaaggttaataggcattgtgcttaaaatggcagtttagtacaattctagtagccattcctttcaaaatttcttaggaagcagagtagaaagcttctgttaagaattagttcattaggaaaggaacattaatacagatcaggggaagcttcaagcctagacgttaattaagaaattttactcttgttcctcacatttccatactgggaatatgagttctgatctgtacttaaagaaaaaaaaagtttgatctcagaatgaacttaaatacaatcaaagatccaggtttttatttgagcccttgagcatgcattaatgacatgtgtagtccctaactcttcagcatttgcagttaaaattttgagtgtcaacttgaaactcttagtgtgtctaagatattttaaccactgtgctgaggagttagagaccagctgctggcattacatgcaaaatggacagcactgggtggcctacaggtagactatgtgatttacaaaaagacagacaggacaagttatccttgcttgatttctcacacacaggacttccaagggggacagaattcttaagtgccttttatactagctcctatctttctcatttcctctggcttcaactagcttatggaaggtacctgcagtcgctgttgactttttccacttaccattttcatctacagcaagtacacaggcccctttggccagcaactcctcaactaccacctttaagccattgcgcgcagcgacgtggaggggtctaaaaaacacaagaccgagcatcagttgtgatacatatttgggtgagaatgtggaatttttgttagcccatgtcactaaaaggaagaagtacttagactctacaaatagtacatggatgtttttacttaagaaaaaaaaatgctgaccagatcttttccaggtgctaatggtccaactgttgttgtatgtttggcccagatcttgctgcagatattacaaatattctgcatctcaaacaatctcaatgacagtaaatacgaagacagaggaagaactcaagctttgttgtgttttgcagaaggccctttactgcttgatttctaacacagcatttgaatcactgtttcacacagttcaacaatatgactggcattaatatcagtcatatatatgtataatttcaaacttccttgttactactaaatgcacacagatgttttactgaatttataataccttaaagaattatgtcaaactcagtatattgtgctatatactgcttaagaatctttttctttttttttgagacagggtctcactctgtcacccaggctggagtgcagtggcacgatcacagctcactgcagccttgaccttctgctgggctcaagtgattctcctgcctcagtctcctgtgtagctgggactacaggtgcaaaccactgtggctggctaatttttttattttttgtagagaaggggtttcatcatgttggccaggctggtctcaaactcccgggctcaagtgatctacttgcctcagcctcccaaagtgccgggattataggcatgagccacgacacccagccaacagtcttcttcttcttcttcttcttttcttttttttttgtggggggacagtctcgctcttgttgcccaggctggagtggtgcagtggcacgatctcagctcacagcaacctccacctcccaggttcaagtgattctcctgcctcagcctcccaagtagctgaggttacaggcacccaccatcatgcccagctaattttgttgttgttgtatttttagtagagacggggtttcaccatgttggccaggcgggtcatgaactcctggcctcaagtaatccaactgcctcggcctcccaaagtgctgggattaaaggcatgagccaccacgcccggcttaagaatcttaaatgaaaaaaattcctttgcctttaaaacaaatgcataaataatttcctaaagcggaaaatgaaacagcttttagatctttcacaccaagggttacactgaattatattaaaatataatcaagacaaatagcttagaaactcttcaaatgtattctgggaaactgatttgcaaaactgtcattttccagtcagaatacataatgctaatacataatacaaatagtttccccaaatatgtcagtccataaaatttttctaacagcccactaaatttataatattaccccagaaatatcagcaaagaaaaagagagacttcacaaaattaaatgaagacatatcaaaagaaggattctaactaaaactgcccagcttggtcagcacttgtaggtatgtgactgtcaccttcatgcaggggaagccaggactgcatctttcaccactgtgctccccagagctagtctggcacacagcaggctcttaatacttattgaataaatgactatgaccctgggttcaagtccaactttagtagttacacttacgtctgcagtgcattatttttttcattaataaggctctcgtcttgtatcttgtcaagtattaacaaggcacatttttcatgaccctaataaagaaaaagaatgataagaaatgcaagatagagacacagaaaagttactgagaaatttcttcattatgatttaaattgaaaatgaatgtcgtctgcctaagaacattctatagggctattttctgagtaattttttttcttctcaacaacaaatgggctccagacactctaagagtcctaataaggtctattagaacttggttaacataagtctgatctaaaatattaatactgctaagataaattttaaaattaatccccagagaggtaaagcagatgctagttcagctaggtcagctggtaactagggaatagaaataggaatactgtctgaatcctataacatttagcatacatcaaaagtcccacctcctatttcaagacgtcagttactacttcaattatccatttatccttggaattcccattacatctattatctatatcattcatcatcattaattgccttatattgtgaagaaaccctatttcaggaaaactcattgttttcttcttcaatcagtggaagatatctctgtaccttatgaagatagatggttaataatttttgaaaatcaactgatgagtcagagactcttacaatttcaggcctggtacccttttaaggggttatggcttcctaagcccttgctaatcaacatgtggcgtgcagaccagtcacattagtattactgggagttagaactgctgaatctcaagctctgccccagacctaatatatcagaatctgtttttttcacagaactcccaggtgattcgtttgcatgataaagtttgaaaagcattgcacttatattcaccaaaatactataccttgaaataaacttcataaggctgagcactttttgtggttcccatgggcttcccagagcatgaagtgagaaaatgtaagcaatgaaaggaatggctgagactactggtaccatataggtaacactgataatattttaactacattgaaataaatcaccgccatgggtgccaactggcttcatactataatgccttgtatgggagacccttaaatataattttagaaatgtccatggaggtttcattctgaggcactgctgttggaaggtaaactgttgtgacctcgtaagagggcaagttggtctaaaaatatttatatctggctgggtgcagtggctcatgcctgtaatcctagcactttgggatgccaaggcgggcggatcacgaggtcaggagttcgagaccagcctagccagcatggtgaaactccatctctcctaaaaaatacaaaaattagccgggcatggtggcgcatgcctgtagtcccagctactcgggtggctgaggcaggagaatcacttgaacttgggaggcggaggttgcagtgggccaagattgcgccactgcactccagcctgggcaacaagtaagactctgcctcaaaaaaaaaaaaaaaaaaaaaaattatatccttagactcaataattccacacttaggaatttatcttaaagtaatgagtaaggatgtttataaaagattcctctgcaataagcattatttatacaggttgagcatcccaaattcgaaaatctgaaataaaaaatgctacaaaatccaaaactttttgaatattgacataacactcagatttttggatttgggataatcaacatgtataatacaaatattccaaaatccaaaaaatcctaaatctgaaacacttctagttccaggaatttcaggtaagagatactgaacttgtactaacatataactgaaaacaagttatttgtctaataataggagatgggttgaataaaagatggcccattcctaagctgaaatactacatatcttctaaaataccataaaacatgatgtttaaaagatattaatattatacgattcagcaacataacgaagttttgtaaaatcatatatatgatataaaagataaattatatatatatataattttatataatttatcttttttttttttttgagatggagtttcactcttgttgtccaggctggagtgcaatggagtgatctcagctcactgcaacctctgcctcccgggttcaaacgattctcctggctcagcctcctgaatagctgggattacaggcatgcgccaccatgcccgggtaattttgtatttttagtagagacagggtttctccattatggtcaggctggtctcgaactcccgacctcaggtaatccacctgcctcggcctcccaaagtgttgggattataggtatgagccactgctcccggcctaaaatttatcttttatggaagaaggaatcttgagcaacatgtgaacacaccactatttgaaaaaaaaaatcacattttttgcattgaactgtacaccagaaaaaagggggaagggtagaaatacacatatatctatttatttgcttcacagtagagtattttttggctgtgttactacaatgtcttcaaatggaacaaaatgaaaacaagtaaaactgcttatactttacaagccacataactaaggtcctcacttttatgtggtaccaaaatgtggtacaacaaccagagagacagatacgatggcagcatcaagacagacagactacagcaagaatgcaagtggcaaatgccatgaaaagcatgtcctcagtatttgtgttgatgaagatatgcttcttcaacacgaatgcattgttgggtctgtcctttccttctcatccttccactttcagttgacaagaccctgggaaaatgtacatcttaattaagagccatgctacacagttccgaggtagaatttcagtgttattattactgttattattataacgtgaagtaataatattttaaattcatttacatactttactacaagccaaatgtaagggtgtattcaagtccttatcctttacagtcagatcagcctgggcactgttcaccaaaatatctgtagaaaaagcccaaaagagggttacttagatgagatgctaattacatgcattttgaagaagttactacaaacacaataacatatttaaattagtacagttcacataatcatatttaatgtatttaaagaaaaaagggagtaatttattctcatatctgtgctatccaaatccaaggttaataggcactaattttaactgcttttacagttcattattcccagttaaaatgattctgttgttacacttggtttctaaatgttgataatttcattgcagaagggttagctctttgacaaggtccaccaagaatcaaaaaacagggaactgaaagacgcttgagcaggtagaatcaggtgacttaagtaaaactgctaatggcccttttccacgtgtatatactatgagaacaactgatttcttgatttgacattattttggtttttgcatgggcataagggcaaagtccatacaacaagcacatacccacagcgcctgcctgcccattctcagcagccatcatcagtgctgttttccctgaattatctactgcgttcactggagcactgtgtctcagaagaagctgcaagcactccacatgatcagcaaatgctgccgcatgaaggggtgtcctaaagatttaaaacaagtatcactttagtttcctttaaactttattctcgctagttactgcccaagaaacatgcacaaggtgttgtcttaaggatttaaaacttctcagtttatagacatagtgatcaggtcccctccctctaaaggtcatccaggatagacactgaaatatcacctatgggactggaaccccctagatttgggaggggggtgtgtgttggccctgataatgaaattagtgtctttactgactctttaatcttaagttccagtgagtctacttttatctttgagatagatactttaaaaattaatgcttaagtctgtagataattggcagattaaataaaaattttaaaaacccgtcacatcatctattttggttgcttaatttcttttagaggataatttggcattatttatcaaaatttaaaaatatcaaccctttaaccaagaaatccacttctaggtatttatctctcagatacacttggtcatgtgtacagacacttatttatttatttatttatttatttatttatttatttatttatttttgagatagagtctcactctgttgcccaggctggagtgcagtggcacaatctcggctcactgcaacctctgcctcatgggttcacgccattctcctgcctcagcctcctgagtagctgggactacaggcgcctgccaccacacccggctaattttttatatttttagtagagatggggtttcaccatgttagctaggacggtctctatctcctggcctcatgatccacccgcctcggcctcccaaagtgctgggattacaggcgtgagccactgtaccctgcccagacacacatatgagaatgttcaccacaccacactttgaaacagcaaaatattggaaacaatctaaatgttcttcaatagagggcaggatgagcaaattatagcatatccattcaatgaaataatatgtagcttcaaaaagaatatggtaaatctgtatgttttggtatggaaggatctccaagatatactaaaagcagagcattgttacagaatgctaccatgtgcaaaaaagaatatatggatatatacatatatgtgtatatatgtttgtagatatgcataaaaatatttaggagaaaataaaatttgtaaataacagtgtatagtagctttctctgtggaagaggctagggattctaggcttagagggaaatttattttaattatacaccctctgtaatattaaaaaccatgcttatccattattctttcaattaaaaacatagatgtttggctactctgcaactgcaaagcagagggtaagattcatcaagaaaaaagcatgctgttttagattacttacctgcctttgtcatctctacaactgacgatactggaatctatggccccaagcagcaatgatgcacaattcccatgatcattgattctaaaatgaaaatgggttttaatgtaacaatctcactcttttaaattatatcacctcctaacccatcttcctatgtactgtatatttgacaatctgaagcatttaaaaaatcgaacgtaaatatttgtggtatatgtttcaatggcatacattttgtaacccctagcattacttcagaacctctatatccaggtagaagtttattgcacttatgcaaggcaccatgttaggcgttttggagacatcaaagtggaatagacatgcttccttcagatttaaaatctttctgacctttgggaggctgaggcaggtggatcatgaggtcaggagttcaagaccagcctggccaatatggtgaaacccagtccctactaaaactacaaaaattagccaggcgtggtggcgcgcacctgtagtcccagctgcttgggaagctgaggcaggagaattgcttgaacccgggagccagaggttgcagtgagccgagattgtgccactgctctccagcctaggcgacagagcgagactccgtctcaaaaaacaaaatataaacaaaataaaatctttctgactcttttttacttatactttctttattgatctactttatgcctccaatatctttccaatcaaatgactcagtttcatataaaggccagagacaatgtaaagacaaagaatcctcaggtcttgggcccccaggctaactatggaagcccagttgaaaacagactcccaggctgactatggaagtctgacttaaagtcactgtatcctctgaactatgattcactattgagactggagcaaaaattaaatttatcagacaagagcttacaacatatgaaagatgaagaatttcaatatatgaaaagttgtcccagtgtgaaatgcctttctaaccatctgtaggcatactgttgtcaacgctgacttatttttagaatttggcagacaaatgtgagttatacctgaagagttcttcacatgggtaatgcacctctcactctaccccttcacgagatttcccgagggtggcatctttgccactttggaactgtggcactccacaaaaatctccgggaaaatcattaatattttgctatcagatctacttgtctttagcagcaaaaatggaatatttcagtcttatctgtaatctaaaagacttttttccctacaaagcaacttttctatgtgtagttaaaatcattaaagcaacatcattaactctcagcgtttctacttacattgcacagtgcagtggagtaaagggattaccgataaatttgcgaaaacatttttgctccaaaagtacctctatacagttttcattacctgcaagaaataaaaataatttagggagtttccaagaaagaaattttgttcaacccaatctgctttttcattaagtattgagtttttggtttatgaattttcctgaattggctgaacattcattctccatgaaataatattaacaaaatgccaaaatgttattaacatgttcacaggtgttctgagacttaatgaacaaataaaacaatgaaggtcatatggtctggtgaagagagacagagaagatgactcatttgcaagcagaatatattctgttttattctcagctcttgaaagatagatgcctcacacaggcatgcttcaatttgtccacatttataagaggaaatgtacctttcacccatacaaatacttccacttacattatgcattctagtggagaggcgaaactgtgattaggagaaaacagtatttgagataatgcatgtgaaaattgactataaaatactatatgtgttttaactgcccccaagaacagttcttggcacatcatgggcattcagtaagcactattcaaataagtagatgaatgaatatgtgaaattattttcaacaaaatggtaggtagtttccaaatcaactgaattcaagttaagtaaggtcctagctgtcagcttacttgttatgtgatctgaggcaatttacttgggatctctgagcctcagtttctcacatattcaaaactggactaggaatacctgccctacctatgtcacaggatggtgagaactttactcaataaagggcctcagtgtggtttgtgacgttctatacaattgtaagacagatcttgctgcctggtattgtctcccaggaagaagggtgatggttccccagcctgactaagcattccctcattacagacctggttaaaacaaaaaacaaaaaacaacgacaaagtctctgtggttctcaattctaatgtgggaaggcattgccattttgctttgcaacacagattgtcctgaaacctcttcttggttgaactcagtgctaagttagtgaaagttcccttatgatctacctcagaatgatgtagatgggacaatttgaaatattaaaatacaaatcaaacttttcttatatctaaaaagagaataggcaatattgcttttagacagattaaaaagcttatgaagtaataaatataaaaaactggcagtggctgggcatggtggctcatgcctgtaatcccagcattttgggaggtcgaggcgggcgaattacttgaggtcaggagttcaagaccagcctggccaacatggcgaaaccccatctctcctaaaaataccaaaaaaaaaaaaagatgtgtggtggtgcctgtctgtagttccagctactcgggaggctgaggcaggagaatcgcttgaacccaggaggcaaaggttgtggtgagccgaaatcacgccacaagcctgggtgacagagtaagactccatacacccctagaaaaaaaaaagccagcagctctaggaaagttgtatgatttagccttccaactaactacatggaaccgtcattgaaatagtcccagacacctcaagtcttccaaaggatctagcttagggtagcatccacacatagcattccttaagtggggactatatgaatcccaatttaagagtctgtacaggtaggactggagatgactgagctcctttcaatatttcaaagtgcctagtaaaaaggagtctgggaagatgggagcttgaaactcagtcctggacaaaggctgcactgaaagggtgaacggcttaggaggagactgctcctcctcccctgcctgtacctggagaggctaggaacacagacacctctcaccctgagccctgaagagaggatctggtctgtgtcaggtttgcggcccgccattataatcagcactctcactgcatccttctcctcttgtaggttctccagtgccagagagctcccacagcttgacccagatgggggtcacccattagtaggttaaaaaaaaaaatcacaatcctccaatggcaggaagggaacaaaaccaagttgaggaaatagaaaatttggctcttactgagcagaatgaatgaaaaaagaggaccgtagtgaaaacacagtaagaggtcttaaattgatataattagaacacacacacacacacacaaacgccttttgtggaactattaatggtttctaaattaaaattttaattgactaattgaaaatgtaaaaagaaaattatagaagcaaagtaaaaaatacatgggaaaatatccatataatcttaggggtaggagaccttttgaagagagactggaaacctggaaaccatacaaaatctgataggatcttggttttgttcattgacatatttcaagtatctaaacagtagctgccattgtagttattcaatacatatttgttgaaaatataatagaaatgtatctctgtaactgattcaagtacataaaagctcaaaatctctaagtggaaaaaaacatcctaaacaaggaacaaaaatattcatatttctaagacattcatatcattaaacattcattcatatcacattcttatcaccaagacaaggtgctcccacaagcatacgagaaaagataaatagctcaataggaaaaaagtgaacagtggatggaaaaagtaatttctagaagaagaaatacaaatagccagggtactattagatagggaaatgcaaattgaaacaagaagataccttttgcctctcaaatcgacaaaaatttaaaaaggtgttattctgggttggcaagcatgaggaaaaacactaacttttatacaaatgtttggtgaaataataaattttgatatcctttttgcaaaataatatggtataatttattaaaattaaaaaatacacaaacccccttactcaataattttatttctggaaacttatctgagagaatttatggtaccataatatggacatgcacattgctgcattgcttgtaataggaaaaaagaaatctgaatgtcaatccacagaaacctggttgaataaataataagttctggtatacatattgctatgaaataatatacaaccattataagatcaatccatattgatacatattgacttgtaagaatatctgcaatacaatttaaacaccaacaaaaaattatagaatggctgctatttgttctataattccagtttcaaaaaatatacacattaatttataattatttatattttcaaaggaaaaattatgaaagatgcacacaaaattacattagaaagtaggtttagaaatggaaacaattttacttcagatatttctgtactttggaattggtataattaggatgcatttttaaattaagtgaaatacaaatttaaaaatctcccaaataataagtacaacaaaataaataaggaatatgaaacacaacaaacaccaaaagatgaaccatgcatctactagtaatcaattgtgacaggttattaaattatatacatatatttggtattagttttattattttaatcccttgtgggatcctggttatattatatagatcagaaaccctgaataaaattggtcatttaagcttatcggttctgattacggttaagtgttaatgattaactaaaaggggaaagtgaacttttactcagttaaggcatcacagcagctgtggaggggtgagaactattaaaaaaacaaacaaaatacacaaaaaagatatcttggatgcagaaagattagaaaccatggtttgcagaattacataaggctctcacctccactgagctcacagtggtcctggggtaggaagtctagtggaatcagtcaaatgataagcaactcaccattgtaacaagcccagtgcagcggcgtgtagccttggttatctttgaaacaacagtcctcctcagaaagagccatttggagcagctcgctcagccacgtggcgtggccacgagcagctgcatagtgcaagggcgtcctccctctggaatctttacagagaattgacacttcttgttccagcagcatttgcacacattcctcgtgtcctgtcataatctgatgcattgtaattaaaaacacaaaacaaacctcagaagactaaggaagcaaagcagttggctaagtgaggctgggcttagagcaagtggacatatgcctgggtctttaaggaaggcagactctgtcctatttcaagggcagaaggcaggacaacctcagcaaaattcataacagaaaaatctgtgaacatcagcattttcgaaatatctcttgcctctcctgacaactgtgaaagatatcatgatgcggccgggcgtggtggctcacgcctgtaatcccagcactttgggaggccgaggcaggaggatcactaggtcaggagatcgagaccatcctggctaacatggtgaaaccccatctctactaaaaaaaatacgaaaaattagcctggcatggtcgtgggtccctgtagtcccagctacttgggaggctgaggcaggagaatggcgtgaacctgggaggcagagcttgcagtgagcccacattgcgccactgcactacggcctgggcgacagagcaagactccatctcaaaaagaaagaaagaaagatatcatgatgcagcagtaaacatgagttttagaatcaggaagatctaagtgaaatcttggcacccctgtgacaggtcagttcgcctctccatccctcactctattcacctatatataagaatagtaataacaacttcagaggacgttgtgaggactgagataacagatgcaaaggctctcagcttgttgtacagcacacaggaagcaactgagaaataaaaactatgactgtgacaatgatcacatagcgttcctcttctcttcatttatcagtgtacttggtaccagcccaaaatagcaattttatgatttctgcttgtgtttacttagtttatttggcatgctttaaaaaacagttcagagggtgcaagtggctaatgcctgtaatcccagcactttgtgaggtggaggcaggaggatcacttgagcccagcagtttgagacctgcctgggcaacatggcaaaaccccatctcaacagaaaatacaaaaattagctgggcatgctggcatgcacctgtggtcccagttactggggggagttgaggtgggaggatcattgagcctgggaggtggaggttgcagtgagctgagattgtgccactacactccagcctgggtgataagagtgagattaaaaaaaaaaaaccaaacacttcaacagatgtgtgcaaataattgcccacaggatacatattttggcattatttgtaaggacaaacaattagaaattgcataactactgaaaaccaggtaatcattgaaataaactatgacacttgaacacaatgaggcattaaaaatcatgatgcagaaaaaaatgaaatgaaaaaagatccttgatatactaagagaaaaaagcagaatccaaatgatatcttcagtattctctttttaaaatctaaaacaaatctatatatagaaaaaagattggagataatatacatcaaatagtggttatctccaggaggtatgattactggtgattgtgattttcttctctgggctttaaaaaaaaatattctgcaaattttctatgatatacttgtattttgtagtcagaaagcagaaccaatttcaccagcagtaggtgttcatgcatctattatcacaatctaacatgaaatcttaagagcaaaaccttccattattttgcctttgccaaggattttgtaatttcttttggactgaataaggttaattggttgtattaggaaacaatttttgctaaacattttttgctaaaaatccaatcaaagtaggccctttgtaattgtttgctaaaaaagaaaacaagctcattaaaaaaattgcttgactagagctgagaaagatgtacatacccctctgtgtaaagctgtgcatcctaggatgtcaacagtgtctacgttggcttccttttcaagtaacaatgaaacagcgtcaatatgtccatatgctactgcaagcatcagtggtgttctaggcagagagataaagcaggcttttaaaaaggagatttaaaaaaatattcatcactaccagtaggaagacattctctttctcccattctcttcccctctccttttgacaatttcttaatattttctaagtgtccccagtttgctatacaatatgcagaacaagctatctgcctctgctctaatggccacatggaatgttgttagtggaatgatccctagggatgaggcaggggaagcttccttttcaaaatattcatgttaatcccatcattttcagatccatgtagcatttactagatatcaagggcggggagtatgtgtatgcagaagcccctcttgcttccatcagagcagctctactttgtagtattctatgttggacttctgctaaagatttcatttacacaaagcttctttccctaaagaaaagtctgtcaagtctccgggaaagaatgaagtgttgtgatgcaagagggaggtgagattctgactatcacactgattcacatgcctggggctagtcactgctgacttttgctctgcatttcctatttgtaagagaagattaggtggggaatatgccaacagaaggaaattactttgaaaaagcaaagttgaggaagaaaaggcatctgaaggattttaataatagagataacctcatgaggtctgtcctatttattaattagaaaatggcaatggtgtagcagcttcagaagaaggtaaaaatgggcggaaagagggaacaaaggagagaatataaataagagccgggaaacatggccacagcccttaaaaaggtgatcctttcatcaagacatgtgcacacccactccttcatgcttttcttggatatacgcactgtgacttaaagccacctcattgtgtattggtcctggtccaaatatattcctccaatttctcggttccgcagtcagccttgtaatgatttaagaaaccaaccaggtagctgctgtgattgaaatgtcaacccaaggccacgtgtgagcgcacttactgtcctttggcatctttcacatcgaccgcctccgggttgtctgcaatttctagcaacagccgtaaacacagtgtgtgaccattaattactgaaaaagaaaacagtggacagtcttttaacagaacaacactacacatatctcttccaaatgactttttcttttttttgagatggagtcttgctctgtcgccaggctggagtgcagtggggcgatgtcatctcattgcaatctccacctcccaggttcaagctattctcctgcctcagcctcctgagtagctgggattacaggcatgcaccaccatgcctggctaatttttgcatttttagtagagacagggtctcaccatcttggccaggctggtctcgaattcctagccccaggtgatccgccagcctcggcctcccaaagtgctgggattacaggcatgagccaccaagtgaccttctgagacagaatctcactctgtcgtccaggctggagtgcaatgatatgatcttggctcactgcaacctccgcctcccgagttcaagtgattattctgcctcccgagtagctgggattataggcatgcaccaccacacccgctaatttttgcatttttagtagagatggggtttcaccatgttgcctaggctggtcttgaacttctgggctcaagcaatctgactgccttggcctcccaaagtgctgggattacaggcatgagccaccgtgcctggccccaagtgacatttatttggacttcaaatcagtggttttccattgttgccgctggatccccctcggcttccagctcaaggtagtttccaggcagagtgcctctgtgttaatctgtcttcccccttcttcctagcagggtgcattgatccccaccttccttttctagttcctgtgttgagggttttttcttacacttggggtcctttcttatctcctgtcatgggactaataatctctccccactagtcagctcccctttttgttcctctgagtcacccaattccatataatcatactgtatctaccctgcctccaacccctttaaaaagaaggaagaagggagagaagggagtggaagtgtgaggggagcaggagcaggatggaggaggaggaggaaggcgaggaaggaaggagagaagtggaggggagaggggagacggtcagaagggaagggagtagggacctggggccgcctcttctcccaggtcgttttacattctgaggtagatattcagaagaggtattcctgcaatagctctgactgatgggtggtggcagaaaacaaaacctcacgccggctgggtgtgcacgctccatccgctcactgttgagtgacggtccctcagccccacggtcaccgagccacaggcggcgctttctctgacttcccaggcatcctcgtgcctggccgaggtgtgactgggctccctgggagccctttcctaggccagactgggcctccccctgcccctcctcgcccagcggaccgagtgggggccaatgtgggcaggaaatgcggcccccatgcggggcaggcctggaccggctggggcgggagcactggatgcactcctgtgcacaccaattccaggcagctttagaaggctgtagtggtcccacaggggctgggaagcaaacctgtgatgataacctcagggtaagctgctttctgccaggctattgaacgcaaaccaaagccttatgataggcatgacttcccactcagggagtaagatgagagcaaccgtggttaaaattccaaatgtgaccttctctcctctctaacaatgagaaggccacaaagtacattgtatttgccacattatggatgtggagagagaagggaatagacgccgctatgtgaggttgataaaggctctcctaagagctgcattttacagaccttttatttgcttgccagccacgagagaatgctaatttaacaatgacacattttttcagggacaatacatacatactggaattagcttgcattcatcaacagcactcaaatgaactacaggaataatgtgcacattttgtagaccattgcattcagctaattctcagcaacattccatttatgtatctcgggaggaaattctgtggattggagtacaggtaatatgtcgttgctgctgctgttatgttttttgttcttacaattacactaaatctgctaccattggtgaagtaggcaagaagtttaatgtatggctaaaaggaaatgactggcaaaggactgacagctgaatactgcagatggcaggttcatgaacatggaaaaacagcatattttgactggttcctctttctgtagcaacttaatactctaaatagtcataatcataatagttcaagtgacatttgatatttggctaaacataagaagaaaaaaattatctaacttcatataactcacccaatgtgttagatagcaaaacagtttctacagttgtgcttttgttttgttttgttttgttttttggtacagtagctttttgaacttagctaatagccctcaggtatttttttttttttttgaggtagagtctagctctgttgcccaggctggagtgcagtggcgtgaactcggctcactgcaacctctgcctcctgggttcaagcgattctcctgcttcagcctcccgagtagctgggactacagatgcacactaccatgcccagctaagttttgtatttttagaagagatggggtttcaccttgttggccaggctggtctcgaactcctgacctcaggtgatctgccctcctcggccttccaaagtgctgggattacaggcatgaaccactgcgcccagcccctcaggtaaatctaagttcccctgaagttggtagccaaacttaaattctctttggcttcctacacactacatttctttttccccaaattgccttctagcaaaaagatgctaacatctttagctctgctgccaagttcagctttgtctcagaccagctcagcctcttcctatgagtgacaaccatttttcacacgactcaaagactacaaactgtcactccaactatctgtgccaaaacctctcatactcgtcctggctcttgctcctcatagtgctctgaggatttgaaactcaaaatattggcctctcaaaaaagttgaaaaagattttgggtaagcagatcctcaaagcacacgctaaagcttctgcacagtagacattttgtgaacagtccagtgacagtgtctttttagtgaatgacaggaggaaaatccaagctgactgagtcttcttgaccactagggggcttcactggaccacaacccatatcacactggcaaatgagtgaaaatgattgttcttcattgtttacctgtttataagggcgattttccacaatcaaagtaggccctttgtaattgtcaggaattatataataacaaaaataggatgcttctcttaaaaatagcaactaatcttttaaaaaggaggacaaaatttgaattttataataataacaagaatggctggggagaaaaaagactaaatgtgatgagaaatgagaatttataattcaaccacaccaactattactaaccttatggctaacgttttttttttttccagcaacaatcatttccaagtaagtaggcaacaattaggttttttcaacctctgtattgtttttcttcagtggcttggaaattcagggacatagatggaaatagttttttacaaggtctatcattctgggaaaattttcccaagtaacaagaatcataaagtcttttgaaaaagtatcttcacttatttgcttcctcaatacacccatttcaccaagtaagacagttatttatcgttacaaaatgttatctactaccctaatcaaaggctgatatcactggatttcctgagccaaagatatctatgccttagctgagctagagactcttccatattacccttatgtctgtgtatatatctagaagtgtcttgacacaggttttcatgggcatggaagaaaaatcccagaaaaggcaaatgactttctttttgatatatacatgtacttttaaagcgtcttgatttttacatcgatgtgtaaaaaagctaagaaacatcatttaggctggcagaatgatgtactgattgctgccttatgattccttatgcgaaatagccctgaatacattaatatgaatatgaaatagccataaaacctgctattggttttatgctttcaaatactgtttgattttgatgtattttgttctatgtaacttgttctgaagattgcattacaccttgccctttgttcagaatgttttgtggtagcttttagccaaaagttctgaactctcttttgagttaacaaggccagagcacctggccagagaacaccaatcacctccaagaggatagcaggccaaaagcattttggaagtgtggaagtgcatctgatgtggaaagaaaattgatatttaaaaaactgggatgaaagaagatgctgctttccttctattaaaacttacgaacaagccacaaaactagggtaatcaggcccttgacaagacctacctgaggcatgaagtggggttcttttggttacattgtctttcacaaagatggatgcgccctgattgataagcgcttccacacattctgtgtgtcctttaaaggcagccagatccagagcagtgcggcctttctcatccctgatgtccaggtccaccaacgactgcagaaggacttccaaggcttgatggtgcccattgtaggcctgcaaagaagaaaccaatggctcccatgcttgctcgctcacctcaaatcccgccacagtccacaggaggggctgggcttcctgggccatggatagagaccactcccaagagcacgtcagaaaaacacttggaatatttattaaaactcaggcaagctggagagttagactgaaacactacaatgcacaaacctcacagttccatatgagtttcgtgttctttctcttttgtcacataatttgctccaaagacactgaatgtattaatgtattcttatatttatatctactgatctaatcatctaatataaactaacagctgaatgaattaccatattcttttatctgtcagttcagtcctaaacatattggcataatcagaatttttttccaggagtcttttctgataacaaacctgggggaaaaattactaaaaacattgtggactttgagatacaacagaggcatgtagatgttctgttataggccaattctatactaatttctaactgtgtgaccttaggtgagtttcttaatttcacttagagtttgtttcttcatgtataagatgagagcaatcaaagctgcctcctagggttgctgtgaagatgaaattgcataggctttgcaaaatatcttgcatgtagctagtgcctcttttctcctttatttcttcccctgattacaatgaaaaacatttcattatagaaacaattatggaaatacactccatgtagcagcactaagttcagaccttttatgaggtcctaagctatgttaagattaagaggcttgtcagacacggtggctcacacctataatcccagcactttgggaggccgagacgggtggatcacttgaggtcaggcattcgagaccagtctggccaaaatagtgaaacctcgtccctactaaaaatacaaaaattagcaggcatggtggcggtgcctgtaatcccagctactcgggaggctgaggcaggagaattgcttgaacccaaggcggaggttgcagtgagctattatcacgactctgcactccagcttgagtgacagagcaagactctgtctccaaaaaaaaaaacaacaaaaaatgatgctttgtaccatcaaaaaacaaaactaaaagtctgaaagataatttttattgagtctataagttaaaaaatgtattagctgccccccaccccacctctccacacacaggcaaaggacactgaaaataagagaagggagctcaggttatatggggtgaaatgggtatgggggacatggtcaagagcagttgagaaaattgtttattggtggcctgactctgaaactacagatgatactttaagagaacattttgagaaatggggcacattcacaggttgtgtggtaataaaagacccccgaacaaaatgttccaggggctttggttttgtgacctactcttgtgttgaagaggtagatgcttgaccacatagcattgatgagcatgtagaggaaccagagagctgtttctagggaagattctgcaaagcctgctgcccatctaacagcgaagaaaatatttgttggtggtattaaagaagatatagaggaatagaatttgagagaccattttaaaaggtatggcaagattacaaccacagaagttatggaagacaggcagattggaaaaaaagagaggatttgcttttgtaacttttgatgatcatgctacagttgataaaactgtcattcagaaacaccacaatattaataggcataacttggaagtgaaagagacccattctatacaagagatgcagtctgctggattgcagagaggtcgtggaggtggatctggcaattttatgggtggtagaggaaactttggagatggaggaagtaattttggctgtggtagaaactttggtggaagaagaggctatggtggtgaaggtggtggcagcagaggtagttatggaggaggtgatggtgggtgtaatggatttggaggtgatggtggcacctatgatggtggtcctggttctagtggtagagggggctatggtggtggtggaccaggatatagaaaccaagggggtagatatggtggtgggggatatggtggttacaatgaaggaggaaactttggtggtggtacctgtggtggtggtgggaacaataatgattctggaaattatagtgggcgacagcaatcaaattttggatccatgaaagggggtagttttggtggaagaagctcagacagtccctatggtggtggttgggtctggtggtggaagtggtggatatggtagcagaagtttctaaaaacagcagaaaagggctagagttcttagcaggagagagcgatgagttgtcaggagagctgcaggttactttgagacaattgtcccaaatgcattagaggaatggtaaaaatctgccacaggaatgatcatccatagtcagaaaagttaccgcagcttaagcaggaaatccttcttgtgcaggactgtcacagccaccgtttgcaaaacgtccagctattaattaatgcaatgtaatgccatttagatgtacattcctgaggtattttatctgtcgtagctttatctttttctttttcttttcattacgtcaggtatattgtcttgtaaattggggtagtggtatgaggattaaaaaattaaggcatttttaactttcaatatttgtgtaattccatttttctacattttaatacagaaactaacaaaatgcagttttgaaggtgtttccttgtgagttaacaataaagaagatcactattaattactattttgtatgaattttattaaagttaactgtaaagaaacaactgctgacttacagtttaaagggaatctattctccccatttccaaaccatgatctgaatgggcactgacaagtggagagaatggatatctgtatgtttgcaatgtgtgttttagataaataggactggaaattagcatatttgtgaatttaatagcattaagattaccttcaaatgaaaaacaaaaactcagaattcacaaaaaaaagaaaagaaaagcctgattccagtgtcttcagcaaccaagtctcctcttatgtcactcgcactttttatttttttactgcagctattactcaagatacaatttgtttgaaaaaaggctcagcacagacaaaagactaatttccttaatatataaagaactcttggaaaccattttaaaaactaggaaaatacgcaaaaggcatgaaaaggcaactcacagaaaaagaaataaaaaaggtcaataaatatgagaatatgtgaagaaataagtaaaattttaaagtatgatttttcacctaccagattggcaatgattaaagtttggtcatgcccagtattagataagacactgaaaaaagcaatcatacactctgttggtgagagtatagattggtgtgacatttgtcgagggtggtttaacaaaatctatcaaactttttaaaaagagaaaagaagttgcaaacagtacttaaagcatgatctcatttatatacaaagcaaatatatctcatatatataggcttctatattcatagaagatttgtagaaagatacaaaagaagctatcaatggtacttactctagaactaggaagtagagtaataaatgcatggacttattttaccttatcttttaaaatatggtttgaatgtttcttcctgagtgtgtgttaacaatgacaataacaaaaactacattgaaaaggagacagaggaattaagagtacagatacattaaatatttttttctcattacattatgtttgtgaatgattttgattatgttacatattaaacctatatatcatttataataggtagtataacaactcatgctgatgaatcccaaaagtatatcccagtcccacttctcccttgacttctcaacttgtatgtccagctgcctattgatgttcccacttgaatgtgtaataggcatctcaaactgaaatctccctcccaaaacttgctccatctgcagcctttaccatctcagtaaatggcaactttattcttctagttgttcaggccccaaaccttacagttgtctttgtcttccctcctgttaaacccagggctattgccctgaacaaggaagggctctggataatagagccagtgggtgttgaaaaatagcccttcccctccttgctgccctagtacagggaagtgtctgctgaaagcaagggacacatttgctaactcacatggagatgtcattagggtctcaggtatctggcaggaatctggcctaattctcacaaagtgctgtatcaatgccactttcagggctcatcatttctattctttctttaaaatacgtccagaatctgtcttcttctcaccgcatcaccaacctgttttgccaggattacagcaaaagcttcccttcctatccttgtcccactgcaatctgttattaatgcaaccattgggtgaaatcttttaaactcgagttgggtcacatcattccttgcttaaaactagcctatgacgtcttccctcactgataccaatatccaaaactttccatgaccaatcaggcccccagaatctggccttcctctaccctcagtttcagcatgtcccctcactcactctgttccagctgcaccagcctccctctatagttaaatagctgcatgtccccctctgggccactgcatctgtactttctgctccctctgtctggaaagctctcccagtaattctgctcaaatatcaccttatcaggggggcttcccagagcagcccatgtaacatataaaataggctctgccctccacctcacacatactcccagatactctccaccccactaatcctgctttcttctgcttcatagcacaaaactgatatcaatggatatctgttatgtatctattgatttgcttattgtttgtgattgaagggacttaatgtgggttgttcctgctgtattctagaatcatgcctggcacacagtagacactcaatacttacttgatgaataaatgaatgaatataatgactactatatttattactatttttggtagaaatatgttttttaaacagcaattattttttgagggttttttatgtgctgggcactatttcaaacattttagcataaatcccaaacatcttttcttatagatgaaaaaaccaaaacaagcaatgttaattaacttgtccaagatcacttagttagtaagtgacaaaatcaggattctgaacccagaatctgtcactactaaatctcacgcttttaggtgccatcttacaattttccccagtaattccatttagttgacttccagacaaaattctcttgtctctatgtggaatagagacaaaataatggtgacagaattgaataacaaatattgaatcagaaacctaaaccctttctatagaagactcaacacagaaatgcagtggcttgagcggagctatgaagcgagaaggtacacttctgggactaacctttagactcttgctcttctactacacacaatgcctggcttgagacaggagaatgcatttctaaaataaattgctaatagatatgtctaactttctgatctgtgcttgttatgcaaaccatagctgcacaggatagtaagtctctattctaacctaaactctgaagcaatagctaacttttatggagcacttgctgtatgtcaggcagtattgggcatgcattgcctcactgaattctcacaacaacctatgctctgctcctgttattcccattttgcccaggatgacacagaagggcagagatgataaccagctctcccatggttacacagcctaatgtggaggagctgggtttcaaaggtggaccaggctgactcccagagcccaagctgtgaggcttttcactagtgaatatggaaagggcgcaacatgaccataagttatatgttcccgtaaccttttattataggaaattccaaacataaacaaataatagaggatggtataatgaattgccgtatacctttcacgcagtttgagtcatgaacagctcagggaataggcgatttctttttttttctttcttttttttttttgagctggagtctcattccgtcgcccaggctggagtgcagtggtgccatcttggctcactgcagcctccacctcccgggttcaagtaattctcctgcctcagcctccccagtagatgagattacaggtgcacgccaccatgcccagctaatttttgtatttttatttttattttgtatttttagtagagatggggtttcaccatgttggccaggctggtctcaaactcctggactcaagtgatccacctgccttgccctcccaaagtgctgagattacaggcgtgagccaccacatccggccacacaagtgattttaagccaactcaggagcacttcatgtaaaacttgagataaaaggagtgcctacatcagtgtgtacatcaggctatgacacttgactccaggcttagtctgtcgcttaaacttggacttaacttgcttaagttaaagagacctaatactaaaatcaaatggagtgaaccatgctggcaattaggaaagctttaaaatttcaacccatactttcttctataccaggcacttgaaaaccctcttaaagacagaatggttgagaggccagatttatctatagcaggggtgtccaatcttttggcttccctgggccacgttggaagaattgttttgggcaacacataaaatacactaacactaatgatagccgatgagcttaaataaaaaaaattgcaaaaggaatctcatcatgttttaagaaagtttacaaatttatgttgggccacaatcaaagccatcctgggcacatgcaacccttcagccaggggttggacaagcataatctataaaattcgctttgtttctttatctagtttgtagctcctgaattttactatgcataaagtaaagccttcactagaagtattaaacattttaaattgttttaagcaacacctttaaaaagccttattaggtaacaattatttctttttttttataattatatatggagttttttattattattatactttaagttctagggtacatgtgcacaatgtgcaggtttgttacatatgtaaatatgtgccatgttggtgtgctgcacccattaactcttcatttacattaggtatttctctcaatgttatccctcctccctccccccatcccacgacaggcccagtgtgtgatgttccctgccctgtgtccaagtgttttcattgttcagttttcacctatgagtgagaacatgcagtgtttggttttctgtccttgtgatagtttgctcagaatgatggttttcatcttcatccatgtcactacaaaggacatgaactcatccttttttatggctgcatagtagtccacggtgtatatgtgccacatttgcttaatccagcctatcattgatggacatttgggttggttccaagtctttgctattgtaaatagtgccacaataaacatacatgtgcatgtgtctttctagtagcatgatttataatcctttgggatttacaatcccagtaatgggatggctgggtcaaatggtatttctagttctagatccttgaggaattgccacagtgccttccacaatggttgaactagtttacactcccaccagcagtgtaaaagcgttcctatttctccacatcctctccagcacctgctgtttcctgactttttaatgatcgccattctaactggtgtgagatggtatctcattgcggttttgatttgcatttctctgatgaccagggatgatgagcatttttcatgtgtctattgggtacataaatgtcttcttttgaaaagtgtctgttcatatcctttgcccacttttagatggggttttttgatttttaaactaatttctctcaggaactgaccaaacaaccaaaccaaatgttaagtaagtttacagaatatgtgagctgcacaatgagaaaaatttctctaactgccgtataaaacactatgtctagcaactacgaaagacaactttttataaacaattatctcttaaacgtgattaatttctccagaccttttaagataggaactaaggacaatgaggggaaagaattgggatctcaacagaatccatgagaacaatggatctgtctggaaatcttgacagctagagcctttcatttgcataacattgtttcttaatttaatcttttcaagaggatgaaatgcttatgaaattcactgggccaataaccctggagatttgaatcattcagccaggaaatagtaactcaaggcaggtcaggtttcttgtagcagtcaaggtttgggggcatctggttccattacactgctagatggcttccacctaagaaattatgtgccttgggttttatcaagttaattgctactgaggcccctagagagggtgatgggcataccttttgggtccttaaagcaaataatttgtatttagagagaaagaataaaatgactttagaaggaatccaccgtaatcaccctggtcaaagtcatggtcatcatctcttgcctggtttgctttgcttctgctttcgttcccttgcaattttgactcaacatagaaactaaagtgatccttttaaaacaaaagtcacatcatatcaatctgtttcctcaagaccctcctaatagtttcctattttgttcagagtaaaagtccccatgagatctgtggtggccccccaaactcctggctccctccacaacatgtgaggcattgcccccagctactctcctcaccactctgctccagccacagtggcccctttcctgttctgtggacagttcatgagttcccccagggactttgcacttctgcccaaaacactccttcatcagatgtcaacatgcatagctcttaaggtctctgtacaaatatgagattctatgctacgtaaaatagcaccctggccaggtgcagcagctcatgcctgcaattacagctactcaggaggttaagacaggaggatcacttgagcccgggagtttgagaccagcctgggcaacacagtgagaccccacctcttaaataaataaataagcaccctgtctgccatctcaatactttctatctccctgatcccatttcattttctctgtagcacctgcagcacttattgccatctgtcatttgagatatttcctcgcctgtttgtctcccctagactggatactctgcaagggcagaggtggggttttgttcactgcaatatctccagctactcaaacagtgcttggcactattcacagtcagtgtatgttggatgaaaggatgatgttaataatgatgttatatgatgttagtaatgatgacgatgaagctagctcatggcacatatgtgtgccaggcactgttctaattgtgttacatccattaactcatgccatctccacaatggccctacgttgaggtactgctattctcatatcatgggtagggacactgagacataagaggtgaggtatttgggttaatatcacacaataaacaattcaataaattaacaagttggaaagggtctttgagatgcttaactaacagattccctttaacttacaggtggggaaaccatgcacaggtgagttgctaatgaaaagaatggcagctaggacctccacttgatgtacctttcctgggtctctgtcagctgcagaactaccaaagcccacctcttttaaatgatatcaccaccctatctttacgcagccagcaacccatagagtttagcagagtacacaataagcattcaacaaatacactgtggaaaaaaaaaagaagaacgagagatgatcaagtctttggaagccaagaaactcttctcagattagtagcaggcttggcaatgcagtcaaacccactttcttggggcctgagaattgtatctgagataaccctccacataagactctctaggggcagttagtgctatgtttgtgagtgctcagctttggggtaacttccccaggcacagcagatggttgggcagggattctagcaagcaacctgtactaagggccaactggcatgaagatttatatgtataaatatcccactattcatccacattttccacagtaagtccatctccgggaacacagactgatgcacactttaccctgatttcactggactcaaaatgcatgtgtgtatgagcgtgtagtgggtgtgttggtgggtgtcagaggacgtgtgagtgggtgtcagcaggtgtgctgtgagtatgtggggagacaggcagtgaaaggaaagctccacacatatggtcagttctggatactcccaatccttgtgtgatggccttgtctccgctctcttgcctgaacacctctgcatgtcaattaataaaacactcctctcttctctccaaaatttccaggtcaatttttcatcagaatgacactgaaggagtgcttatgtacacatagtattaagtgaaaagtcataaacacagttaaacaaagaaacccagccccttcccattcttcctggtgtcctgcccctgggttttactaagcaaagaagcatccaaacaccatctttgtggccttgaaccaagtgctcacaattcagcagcaccaagggcacgtgagtgcctcgggaaggtgagctggctgttgctgggtgtggctgccagtcagcagggttcctagggagcagctgctgatggccaactcttagcaactcacaatctgagacagagtggtgggtgcacttcccaccttggtcactcccatgaagagtttggggatcatcactctgagctgttgcatttgccttcaattactgggatgtggagaggaagcgttactggtgataaaataactcttcttccctcacctcccagatctcacccagtacaagaatcagagcctcagacttcgttgaagaccctgatttcaagtccaggcagaaggtcgcagctgcagctctgcatgtgctcatcttgctctcatcagtttgtgctgaaacatcctgccagtttttaactgtggtattcaattagccataggttttccacttgtatattgttatcgctaatcaaatctcttaaactgaaatgtatcctttgaattttaaagacggttaaactctacaagaataaaggttaagggctttgggtgcattatctcttttcatttgccctcatttcgcagatggggaaactgaggctcaagacagggtaagtcatgtgtctaagatcaccagcagatgaagctgggaatgaaggcgaggcagtctgtctccacagcctgtgccttttaccacggactactttcactaccactcatcactgtgttactacatttacattttaagagcaatctagttttaggaatgcttaggttgtttttgtaacaggtgaagctgctcatggcatctcacttacagctaagtggagtggactcttagtagcaccagaatctgattcttcaaatccactgtttgttctttccaaaagctgtggagacaaaaagcaaacaatagtacgtgagtccaaattttgcaaaatgttggtgtaaatgagaaaagaggtttcagaaacttgagaagttatgcaatttatcagtaatataaaaatatgatataacatatctaaaacaaatatgctaacagaatatttaaacttctagatcacctcagcacttgaatccagaaaaataattcatcttacatccattttcacctggcaaacagataataacgaaaaaaataagacccagtattgattctactatcaaacacacatttactgcagatagtgtggatagtgttgaaaaagacaagactcctgctctcatgaagcttacattttggaaaaacgaagcatagataaataaatataaaaataagaaaacatttggaaatgatctgtgctgtaatgagaataaaatacggggatgtgatatggagtgactgacaggctgctttacagcagatggccaggcaaggccttctccaaggaagtgacatttcaagtgaatcctaaataagaagaattaaaccagataaaggtgtggcaggagagtattcaggaagaggaaatagtcaatgatatgcatcaagagaggacaaacatggtaagatcaaggaatggaaagaccaatgtgactagggcatcgtgttagtgagggtggcaggaaaatgacattctcgtagacccttggtggaagaacaaattgttaaaacctttctggttccctagcaagtagactcagagaagggggagataaaaagaaacaaaaaaaaaaaaaacacctttctgggcaatttgtgcatatcttttgaatctagggattcaatcctaataaatagatgagtgcacaatagtgcatattgtaaggaaatgcattcatacaataaatactcagtgaatgattaccatgtgccctgacactgttccctgcactgataattccataatagaccaagtatcaaaaatctgttttcctattgcagaggtggacctactataaaagaaagaagtttcatagtttattagaaagtgcaaggtgctatggtagagaaggaaggttcaaagaactcgaggggagattagtttgtaactttatgtagggtgattagggaaagcctcactgagcaggtgatggcccagtaaagtctccagggagatgagggagccttgtgaatatcttggagaagagcattctaagcagaggggccaacagctgccaagacccttacagacaggtgtgcttaataacatcaggaggctggagccaagtgagcgagggtgagaatggcaggacagaaatcagagagatggtggctgtgggggtgggcatgtcaaagaaagccgtgtaggctgttgtcagaattttgacttttatcccaagtgaggtggaaattcagtggagtgttttgagcagaggagttacatgatctgttaggctctaaggagacaaaggtgggagcacagagacaatttaggagctggggcaatagtccaagagaaaaataacagtggcttggaccagcaagaagcagtggagatgagagaaacagttggattgtggatatttttggaggtaaaatcaacaggatatgctgatgggctgaatatgaatgtaagagaaagagagaggccaaggatgacgcccagtttttgtcctaagcaaacggaaacatgaaggtaccatgacctgagatgaagaaggctgtgagtgggatatatatagtggaaacaagcagaagttcagttttggacatgtgaaatttgagatgtttataaagcatctaaaagtacatctgggccaggtgcggtggctcatgtctgtaatcccagcactttgggagaccgaagtgggaagatcacttgagctcaggagttcaagaccaggctgggcaagatggcgaaaccccatctttaccaaaaaatacaaaaattaaccaagtgtggtggtgcacacctgtagtcccagatacttaggaggctgaggtgggaggacggctttagcccgggaggtggaggtggccgtgagctgagattgtaccactgcattccagcctgggcaacagagccagactctgtctcaagaaaaaaagacatattatccaggaagttgctggatacatggttttggagctcagggtatttaaagccataagattggatgagatgaacagagtacacaaagaagagacggggtcccaggactgatgcctggggcacccaccactaaaagctggagagatgaggaggaaccagcaggaagactcagactgagcaggtgagctagaaggaaaacaaggagaacatgaggttctggaaccaagtgaagaaggagttttatgaagagaatgagcagtcatgtcaagtgtcatgacagatcaaggaaaataatgcctgagaattttttttttttttttttttttaagagacagggtctcactctgtcacccaggctggagtgcagtgatgtgatttcagcctacagcagcctcaacctcccaggcttaacggattctcccactcttcccaagtaactgggactacaggcacgtgccaccatgcctggctaacttttaaaaaaaatttttttggtagagacaggatctcactacgtttcccaggctggtctcaaactcttgggctcaagcaatactgccagcttggcctcccaaaccgctgagattacacaggcatgagccaccgtgcccagccaggtctgagaattgatcactgagtttagcaacatgaggcctgagaactgaccactgtgtttagcaaaatggaggaagctattagtgactctgataaaagccatttattaagacattgtttatgtgaaaaaatagaaaaaataataactagcaatagtataggttaaatatagtggtatatattacactttcagataaattgttcccctttatcttactttgaagctctttatttttattttttaaaatagagacagggtctcactctgccaccctgactgaagtgtggtggtgtgaacatagctcactgcagccttgaactcctgggctcaagtgatcctcccacctcagcctccagagtagctgggactacaggcacaagtcaccacgcctggctcttgaagcttttctttgtatagtgacacatccaaaaggaatgcaaatcctgtatccaaagcctcgatatgtgctatgatggtcgtcaacatccaactccagcttcctgattggtgggcttgggctgccctacattacagaggctggacaactaaacaccacatttcctagactcccttgagctacagctccagaggtgatttcagctcttccagttagacgcatgaacttttctttttcttcactgcctctttgataaggtctttattaaaaataaggtgtccaaaatgatttgatctttatggaataaactcatttaaaagcttatgcagcaggattattttcctctgtggtagctttcttttctgctggtttcttttaagctgctgttttctcggtagtgctgccttttttcccaccagaggtttcctctgcttcttaacaccaactgtcatttttttcctctctttcctaccacaggcgtcttcctacaaccccttctcatgtgatttagtctctagtgctagtgctgctgctgctaccttatcccccagagtttgtgattatttttctttttttttttaggatatttttattattattattatcatactttaagttctagggtacatgtgcacaacgtgcaggtttcttacatatgtatacatgtgccatgttggtgtgctgcacccattaactcgtcatttacattaggtatatctcctaatgctatccctaccccttccccccaccccacaacaggccctggtgtgtgatgttccccttcccatgtccaagtgttctcattgttcaattcccacctatgagtgggaacatgcggcatttggttttctgtccttctgacagtttgagcttgtgattcttggcctggcaaagaatggtgtcctgacacatggtgtttgcatatgggtttagcttcaacatgagtttcagatttttcatggcttctttgggactctgcaatgaatctgcttgcctgctgcttgaagggctctttggagctctaggcttttcaagattttgctaaggtctgtgttgcttatcttatgcatgggaagattttctagagggaagcagctttatgcctagtgccatataattcatctaacttccagaaagcactttcagtccaatgcagaaacatcccacatgcccaccaagagcaagtttcaaactgttcagttttcttacattaaatgcagagtcactccagggatgtttctgaaggccttcatggtaccattatcctcattacaggcaatgcagggtatcctgtgtcagatacgatgatggtttctcattttgtccttgccagttcttatttgctgagaggcatagatctttttgatatcactccaggttttaagtttcttatgcagcaaaacagcctcctgggtcttcttgtagccttcaactttaccttcaaccaccgaaggaagttcaggaacttcctcaatacaatgacctttagacatgaccagcattggtaaggctgaggcagctggggcagagcaagtggcatatcatttttgggttgtgttcattctacagtgccaatggcaccaggtttttgttggtgcaaacaagcagtcttcaccacccatatttccaaaggcatcctagccagaacgatgagtcccatcacctcagactctgggtattggagccacagctcaaccagtaccctaaaacttctcatcctaccatggcatgtgttcatccactgattgcagtagactccaaaaagggagagttatctggcaaaaacgtcattttgcctgctgtgttcaagcctgcctttcaactagatattgtgaactttgttcacaccaacttgtataaaaaaacaaagagccctatgctgcctgtgaattagcaggtcatgagaacagtgcctttagaagacggaagtgaggcagagaaaatctgtgatttccaatggtgagcacagtcatgaagactgtcttttagcttccagtgtagaggccatgagtttagtgaggatagagaagcaagacacagggatgcaggacattcatttttttggccgtgtggatcaagccaaaaagtggtgtgactcttgaggcaatattagtgggggtgacaagactgtccccgaacatcagctagggtgatgcgtctatggaatcagtcattccagtggctgctttctgattccttatcttcctgatcatggggcagaggcagccccctgacagtccagttcatcagttcaggcttatttctggaggcccacctaaaggccactcttttagatcttccaataatcttgtaaacactgatttttaaaaataaaactttttttttttgcttaaaagagctagagtggtttctgaatcctgcaaatgaagcctgactgattcaaagagcaatacaagtgcttttgttgttggtggtggtgttgttttttacttattatttttatttttgtagagatgcggtctcactatgttgcccaggctggtctcaaactctaggctcaagcagtcctcctacctcaacctcccaaagtgctaggactacaagtgtgagccaccatacctagcccataatattaatacaagtttgtatagatgttttcctaatggggatggagaagaggaaattatagtacccacaacactggaaagcaaaactttctaaaaatctactttacctctttttctccctgtaaatccaaagcttgtcaagcggaaaacacattttaaaaccataagtgttgaatgacactattttctttttttttttttataaagcagtattgacatgactatatatacaggaaaacaaaaagcctagacatagaaatacataccttacaaagtttaacacaataacctaaaagtgatgttatagaagatttttattttcttctttatatttccagtgaatgtgtattgttttgtttgtgtgtgtgttttgtcttaagagacagggtcttgctacattacctaggctggagtgcagagcacaggtacaatgatagcacagtagagccccaaacttctgggctaaagcaatcctcttgcctcaccctcctgagtagctgagactatggggcataccaccatgcccagctatgtattgttttgtaatcagaaaaacactaaagcgatttctatttggaaaaaagctataacctttcatctaatttaataatgtccacagactctcagatagattcagaactcctttctagtcaatacatgtggaacaaaatgctatgatgttaggattttttggtaaatcaaataatggtgtaaaaattaccacctaaaagcatgtaatttcaaatttgcaaataatacaatactataattatattggtagtatgagacactttgtgtttgtttcttattagtgtgaaaacagaatctggaacttaaataatctagtatctgttagaaaaatgagagtaaatgtaattttaacttcaaagcaaataacttcaaaaccaatctctgttacatacttgaaataaaagtagccctaactgcttgataaggctagaaaacagctgttctttgctttgttttgcaacattatcacctgcaagacttcctggaattgacagtgtgtaccaaccccaaatcctgtcctagaataaacttttagtcaaaggaacacagaatcatttcccccactatcacagatatgacaaacagggactagaagacaatatactattacatttttgagagtgttccaggacaatagttataaaccaggtcattatcagaagagacatgatcatgatcagattcttgagttttataaaatccactctggctgccgtgtggaaaatgaactacaatggtgctgggggtgggcactgctaccctagaagcaggaggcatattaggatatttcaactgcgggatttctaaactgtgaattaataagtcagtgagaactcatagtggcctgaactacagaagaggttatagaaatggaagtgtcacttttttttttttttttgagatgaagtctcgctctgttgcccaggctggagtgcagtggtgcaatctcagctcactgcaacttccgcctcccgggttcatgtgattctcctgcctcagcctcctgagtagctgggactacaggcacccgccaccacgcctggctagttttttgtatttttagtagagatggggtttcaccatgttagccaggatagtctcgatctcctgaccttctgatccacccaccttggcatcccaaaatgttgggattacaggcgtgagccatggcacccagctggaagtgtcactcttttattcattaatttcaataattattcattgatccccatgccaggcactgagattacaactctaatatggcccctaaatagagcttagagacacagagcttatagtttagaaggtggaatgaacacagatcattaactgaacattggaggtggggaaagaggagagtcaaggatgactctgaattgtctagctttagtaatggagtgaatggtgatgccttcttcataagaaacaaagagaagaagcaagatcaaagtagagagagatgcgttgagtctcagttttaatgctgctgggacattcaaggggaggtgtctagtggacggctggatataaggtggtaggctttagaagagagatctgggatagagttatggatttgggaatcatcatcaatagctgatgcatgaagcccccacagtgaatgaggccactgagagtgaatgtctaatgggagatgggaaaaggcctaagatataaacctcaggaacctcaattttaagggtttggaagaggaaaagagtctgcagagaggattaaagagtagacagagaggctgaaggaaaactaggagagtgaaatggtgatgatgatgatggtggtggtggtgatggtaatgattaccatgatgatgaaggtgatggtggtggtgataaataatgatgaagattttcactgataaaagccgaaagttagtaagcatttgctacgagtcaagcactctcctaggggccttacatgaatcatctcaataaatccttgagtaatccattaagtaacttgctcagattcacacagccagtaaaggacagactagggaattgaacctatatctaacctaaaacccatgttctttacacagcaatgccttccaatcaactgataagctgaactttcccctgatatttcacaaacagcacagggatgggggcaggaaacaaagagaattatgtgttgttgttgctttttttttttttaagtatttgggtctgtttatgtctctaacaattttctttaatctttgagattttcttctttgttttctaaggagtggttagtactcatcttagttatgcagcaatcactggagatgttgactggaatctagctgctctaagtagtccccttcctttagtgattcttctttgttaattaagaagacaatgtaaaaaagtggagagaaaagcaatttgcaagtcatttaaaactggcatttacaatttgaattaacttttctctctaatttaagatttggtcctaaacattgaatccaagggatgatgcagatattcagcatggctcagatactctagtctcataaatgtctcaggggaggcatatgagggctagagagagagagagagagagagagagagagagagagctcatactatgccttgctatacaaactcgtaattcagcttgtggtctgtattattggaaaacaacattgctctacagagatcaacctcaacctatcttgtcaaaatccagaaacagaatggctcttttaaaacacagttatagctaagaatacatggccaaagaaccagcattataaaaagcaatgagttctgcacatagagcttgtagttatacatcagagagtacaattttatgcccaatataacaaaactagtcataactttcttgtaagaatactcccatttaatacatcttcatggttaccgacatttacacaatccatgcattcacatgctagttctcatgctcaactacattcataaatccaacgtgcatatctagtatgtcaccatggacttctattggcacaataaactttgcactcattccaaggactgacttggtcctctgcctaaaaaaaaaaaaatctattaaaatgtctgccttaataataaggccttcatccggactacctaatcttattttttaagcccaaattacttcttttctcaactgattaatcattcacgaaggttctacgtagagtccagcactgcttgaccccacttcttctccatagcctccaccaaccaccatgtgtttgccaggattctgtttgggtgaaaaataatcagatttgaggttgaaatatcaacctcaaactcctactgagaagtgaagataggtgcctgaagagaatatggagagaaagaaggcagtacaacagtgcaagccaacttttcagctgccttatttgtaagtcatgaactctctggttcacttgggggaatggctgagatgcacaatggagtttttggtccaagaatattattgtatttgaaattacaataattcataggacagtttctcaatctggaggcatttccacaggattggaggactcacatgaacagcatttcaatgctttggatttaaaagcagcaaaggcaatagaaggttaaatttaagcctcttctacaaagtgaatctgtgataagaaaatcaagaacaaacaggagctcaatggtaagccaactggctgctgagttaacaaaacagtaatcttatcatccaaatttgtgagggaacacataaatataacacttgagctgggaagccaagctttataaatagtatagattatgacagactacatgaaaacatggcagggaaaaatccaggggccccgagagacctcaagctaatctacaccagttttaaaatttaagaaaatagaaagtgagtatgactcaggctgccaaaagagaaaagtatagctggtgtgtctgaggtaagcctctttcatgttgcttctaaactacacactggtttacacaaattagaagggatgggagaagctagaaaaccaatcagaaaatatccctggggatcacatcaaggaggttctctgagaagaggttaaaaatggatttctttatcttttagcagtgaagactgagaggacatttatggatcttcaagtctatgaaggggtggaagcaggccagggcccctggaaagttggtgcctgtgtcacaaagtctctctcccattctgcttgtctatgctgaagaatgaaaagctattcaggcaacctcagggccacttctgtgtcaactgtgcagccagtactcgtcaagctatgacctggcctcggctcagcccagaacggggggctgagtctgcagaagttccagaccacccaggccgtgtcaatctcctcccttcagaggatcccaggggactggtttgaggttgggagatcccataggccttttggtctcagaactgatatgatgtgccaaaccacgctggaccccagtggacccccagtctttctgcatatccacaaagaacctcaggctcagccccaaatcaactctcattccaaggtggcatatctgtagcagcagtgaccatctctttctcatgattccactcacatccttcacagctattagaagaatctgtgttcccagaaattgttattaacaacaattaccagaaactcggtagtttgtatgaatgtatgtatgaatcaaacctaatttagtttctgtctcccccgactccaattccataagcaaggagacattacctttctatagttgcgtaagtcaaggtctatgcaactttatttatttatttagagacagagtctcactctgtcacccagactggagtgcagtggcatgatctcagctcactgcaacctccacctcccaggttcaagtgattctcctgcctcaccctcccgagtagctgagattacaagcgcccaccatcatgcccagctaatttttgtatttttagtagagatgggattttaccatgttggccaggctggtctcgaactcctgacctcaaatgatccacctcagcctcccaaagtgctgggattataggcggtctatgcaacttttaaaggcaataacacaaattaaggagggtgctactgaaagcttagctacattaagtttccgtttcttcttgggagcagattttgatgactctgattatctccaccctccagtgtgtattcagttcctgatgatttccttgccaattaaaaggcagaagagcctgtagtatgtgtaaggaaaggctaatgaaatccactgtgaaaatagatccgaatgcaacatgcaaaatgcatggtatttcaaactaccttgcaagagccctaaaaatgttcatatacttttgacctagtaaacctacttcagagactctatcctgataaagttttaagcccaaagccatttaatagtgaaacattatgaacaacctaaattgtagaagagctaagttatggttgagctaataattgaatattatttagtgattaaaaatgtttatcaagagtttttaatgacattgggaaaggattatgtcatgatatgttatgaaaaaaatcagcatacagaattacaccttcaatgttacttaacagatgtaaaaaataaaatatatggataaggaaacctgaaggaaatacaccaaaacgttcatatgagcggaggtagtgaaactacgggtgttttgatttcttgtttctacttttttgcatattctaaacttcctacaacaaataaacattactagagaataagataaatttctattgaaaagtgaaatggttgaatcagatgatttccaaggtccctttagctatattctgcaccatatccaataataatgtaaggggttgatgtttttatgactagtatagctttattaaaacaataacacattctggccagtattactgttggttgagtatattacttcatggccattaaactgcaaattccttaggggcagggactacccatactatgtagtaggcattcaataaatgtttatagaactgaatttaaatctggtaagtgaatgagacagcattagtggaattaattattggatgataacacatttgcttgcttgctttgacactgcagaattaccaaaatcattgctggttattttatattttggatagattttccctttataaaaacaatctgaagctggatgcagtggcttatgcctgtaatctcagcactttgagaggccaacgtgggaggatcacttgagcccacgagtttgagaccagccttggcaacatagtgagaacctgtctctacaaacaatgacaaaaaacaattagccaaatatagtggtcgtgcctatagtcccagctactcaggaggctgaggtgggagggtcgcttgagcccaggaggttgaggctgtagtgggccatgatcacaccactgtactccagcctgggcaacagggtaagaccttgtcttaaaaaaaaatggaaagaatagtcattgctacattttaaaaaccaggggttggaggttgggaggagggatgagtaggcagagcacagaagacagagcagtgaacacactctgaatgacagtatgatgatgaacaaatacctggcattatacatttttccaaacccacagaatgtataacaccaagagtggaccttgaggtaaactctgggactttgggtgattttgatgtgtcactgtaggtccatcacttgtaacaaatgtaccctctggtggaggatgatgataatggaggaggctgtgcatggggcgggaggggagcaaggagtatatgggaaatttctgagccttcttctatccaatttgctgtaaatctaaaactgcgcttagaaaaataaaagtcttataataacaaaaacaccaaccaaccaatcaatcagcaaaacaagcaaacaaataaacaaacctgacctttcatagaacatagtcttataactgaaaaatggtctagggttagtatgactttctaaaccacagtgtcagtttactgctacaaggtgatgaaatcacttatcatgaggtgacccttgggttgtctacatttcaggggtcataaggaagtaaagaagattcatcaaaattaagtttttatatttaattgatggaccaatactataaaaaggtgagacaccagtaaaagaattccaaacatgttttctggttgtagaatacctaaaccagtccagaaaatgccagatcatgtgtttttgaaataataagacagtgtgattcctttcatcttgctgtaggtgttccagatgagaaatagtgttaagattaactcatacaaaataaagccactattattagggataaggcatcgtggttgctaaaaacataaggagtcatccaaggctgaaagaaaccaaaagtgattgcagaagcgaaaagggttttaacttacttgaaagtaatgcaaagaattgctgcagaagccattccaaatgtgaaaaaaaaataatcaaagtgttcccatattattttggaggtcccacagcagctttgggttaaaatgatttaagtagtgggagaattcccaaattcaatttttcccaagcaaaataaaaatataaaattactctatctgggttaagcagaatcatacttcaccttaataaagaaatattctatctggtgccaatactttcctataactgaatttagtttcattcttttgtgtgggtagtgaaccaaaagaggggaggaatgtttacatcttggagacaggatagagaagagagatagctggaaaaggtgccagagaaaatctctgagggaacagccaccagcaaattccagaagcaccaacttcagatacaaagtgaatgccctggctgctgatgccagcaaaatatgccttggatgcattcttaatatctctccttgggatatgattatgagtgctgcaagttcatttggatctggcagtaatcgttgcaaggaaatgtcagtacaatgagatacttcggctactcccttgatattcatattaagggaatggcctagaccatacctatttaacttctaattttgcagagtatttcaaaggttaagtcacccttctatattagcagtaagttggatatattgtgttctatcagtggaagaggcatctgattttctttcatgctctttttggattcctgcattacatgtgtgtggtggtgattgtgtgtgtgtgcgtgtgtgtgtgtgtgtgtgtgtgtgtgtgtgtgtgtgtgtgtgtgaaggggcaggggagaggaggacaaaaatgaaaggtctatgttaatcagcccttatcatatcactcatgggtagcataagtttaggatgcaagagagtaagaagggtaaataggttattgatagattccctattgttaagataaatgatcctaaacttgtaaaaataggcaaagaggataatttcatgtcctttcaaaagcatcatttaacaggcccacccaggccaggcgcagtggctcatgcctataatcccagcactttgggaggccgaggcgggcagatcacgaagtcaggagtttgaggccagcctggccaatatggtgaaaccccatctctactaaaaatacaactaaaaatacagaaattagccaggtgtggtggtgtgcacctatagtctcagctactcaggaggctgaggcaggagaatcacttgaacccaggaggtagaggttgcattgagctgagatcacgtcactgactccagcctgggcaacagagcgaggcgagacaccatctcaacaaaaaaacaaaacaaaacaaaaaaacaggcccacccaaaaattaatttttttagtataatgttaattaagggcaatttctctgtgaaaattacacgttaactttcagatttgtttccagtggaggtaagccttttttttttttttttttgagacagactgtcactctgtcacccaggctggagtgcagtggcgccatctcagctcactgcaacttccgcttcccgggctcaagtgattatcctgcctcagcctcccgagcagctgggactacaggcatgcaccaccacacctggataatttttgtatttttagtagagatggggtttcaccatgttggccaagctggtctcgaactcctgacctcaagtgatctgccctccttggcctcccaaggtgctggaattataggcatgagccactgtgcccggcctgtttccagcagggataaaagttttgctgtctggtaggaaaaaataaaataaaataaaataaaagcctccagaggtcatagcttattgccctgtaggacatgaaccagttttgtatctaaactagtaatctcattctactattactatattaaagtgcctacacatgctctgttcctcagatgctccttggaaagctttagcatcttactggttccctcattacttaatgagatttttcaaaaattgtttaacacatttcactcttctcttattatgacagtcatgtttttaattttttgaaaagtaaactttgacaccactcatcagctttaatgctaacagaagccttcaaaagtcttactatcctttggaaatgcctataaaagtctcctcccctcagtactgttccacaactaactcttttcataaaaacattgagagaatttaagaaggtgcctttcccttcttccaaaggcacttgttggacaagagacagagtagacagagctatgatgtcccaagagcagaaaatccatcccactggatttccaatgaactcttcttaggctccgagactgagaaatcataggctcctctcacctcttcaagggtctactttatccaaaaggtcatggtaacggccaaggattttcatatgggctaccctctcctggttcccattggtttgtccctgcagtagccagtaacacaggctcccgcttcctgggcatctgtctctctctctctctgggcataccctataggccttggctcaagcatcaactatggtcttcaagccacctcaagactgtatggccagcacttgctcatttttctcactggaaccaacaggagttgcctaatgccagcaattgcctctcttctctccccattctaagagaaaaggtcagcctttagagtgttgaattcattcagcacacttcagtaggaattcacaatgcatcttcctgtctctttttctggcctccttcctgcttagaatttttagcagaactacagggaacctcactccagcaggatacctatagatctcagatctcagatcacctgcagcccaacaggcagacccctctctccttctccatcttacctctcttcaaaaataaatctcaccacagaagaaaatgaaatacacaataaagaacagattatttacaacagaaagcaagagcacatgaatctaatctaagctaaacatgataattcaaagaattgttttctccaaagttcatacaatttcatttcattaaatcaggttttcatttaggtaagatatctattgtaccacagctatttaatgggtacattaatgaaaaaaaaacataagaaaaatatgttttagattttaagaagacaaaagcctatataaaaatcataatataactttatcttcttttaatgtaataaaactatgatacccccaagcctgattttgtgtgtgtgtcaatttaaaaaatggttcctactttgagtctttccactgcggggtccaccttagccacacactatcctcctgataattatgcctctttttatttgaaggggttcctggtagccagcttgcaggcctgcatttggcaaatctagccttcttggattcactttctgtgagcttttagaccatatcccagtcctactcctgttaccttgtcctttggctattattgaataggaaatatctaccatttccttcacaagtggccaacattgttaggagaaaaggaagaatactgtccataagactcaattcctattgcttccaattgtatcttctcattccacatctgccccctccactactaaaaaaaaaaaaaaaaaaaatccaaatttctttcctccaggcctccatatttaaagaactacctgtctctcggggaagacaggcattctgcttcctaccctctctcccccaatgtcaaatataaatcactgtcacaaatccagaaagcccaggaataacatatgaattttaagaagtcttaaaatcaggtcctaaactgtttatttttatttatttattttttagttttacaacctcagctgagaactgactaaaccttttcaggcatccagcaattctgaaagtgaatcatgttcagccagtgaggcattttcagtaaatgcaaggcattttcagtaaaggcaagaatgaggcattttcggtaaacagtgtccatcatataaaactcactgcagtttatgaatttgggccaccaggatgcaaatgcagccgtttcactccctggattcagaggcttttgcaccaatgtgggtgtgtctatggctccttttccatctgttgtttgtgttttgtttctagctgttaattagcttgttgaacagcaggtgtgagagaaagggatatttaatttagtaatatgtaccacaaacgtcctcacgattctcaccctaaccagtttcactgtttgctgatagcttcaataaacgggtttaagaagagaggtgaaactgttgactaaaattaagtttttgtagtacctggacttatcctactacctcaatccctagtaatgaaagaaaacctaaaatgtagtgtaattctatatcattcagaagagcaatttaatataatagaaatctatacttgtaaagttcctttcttattgttccccattatctattagaatgactttgctctagttttgacaaggctttttaaaaattttttgtagagatgggggtctcactatgttgcccaggatggtctcaaactcctgccctaaagtgatcctcccacctcagcctcccaaagcactgagatgacaagcatgagccaccctgacgaggctttattttgaaagtcatgttaaaaaatactttcttacaccctaaaaattatggaaaattaaatattgacaaagttttgtttttaatttttaaaaatgtggggcatcaaatatgttaagcatgcagatgaaaggcaggtgaaaaaaaattcagtgttccatttaaaaaacaggtagtgatgctattagcttgacacgggggagactaaactacctttatttgctggacaacagcatggttgtcaaaactggaccctggttttttttttccctttcaggacacatactgtatcatgggttctttaatttagtgtatggattaggtagggacatatttgaaagcactaattcactcttgattgccaaattcataaagtgaactgcttaaggttagataagaatgatctatttataaaatctagtgccaaaaattaaagtaattatactagaagtgtgatttttatttctgatctttttaaagtcaagggatcagtgatcaaacaattaaaatgaagagtccatatcttaaaataacaaattcaatttgtaggatattttcttttttgtttacttactgtatttcttggaattttatttattaagcaataaaaatggaagtgaacacaactgcataaaaattttggaatacttctctgtatgttatcatagtcaaaagatgtttttcagaatttgtcttatgatgccaaattattccaaaatttcctaaatggttgataaacagagtaagaactggattatacatcagctcctgcagtttccaactgcacattccagttttaaagtataaccataatgtatgctttcctcagaagggtgcctggcatttatttatgatggtcaattttttttgttgttgttgagatggagtctcattctgttgcccaggctggagtacagcggcgcgatctcggctcactgcaacctctgcttcctgggttcaagcaattcctgcctcagcctcctgagctgggattacaggtgcctaccacacatacagctaatttttgtatctttagtagagacagggtttcaccatgttggccaggctggtctcaaactcctgacctcaggtgatgcccgcctcggccttccaaaatgctgggattacaggtgtgagccaccgcacccagactatgatggtcagtttttaagtatatgcctgaaaagtgacatgatctcgatgaatgcccttttaattctaacaacacaccaagcacaaactgagatctcacttggtcctaaaataataaagcaagccctctatttgtaaatagtttatacacacaaattcctagcaattccataaaagagctataaaaaggaagttttatgcctaagcaaaaaaaaaaattagtagagcttaatttccgcatttattcattgtaacagctttgaaaaaagtttccaagtttgtgctcagagagggtgctgaatttggaaagaataactagaattattaaaattaaatattaacggtggattttattaaaatgccaaagaattatcaaaggttctggtggtttctataattgcacagtttaaaccataagctggatttctttcttcttttttttttttccttttctattttggtaagagggaagcagttgggctatacaagcttgtcctatgatactttcatggctgtcttgtctttgctgaacagacaggagctcttctttttatcctttctacctgagctgataattctgtctccattttacttcccttcctcaactgcaataaggaagttgtattgttacaacttccctacaataatgaggtcaggttgccatggtctcaactgctctgaaggcattttatttttaacaggaccaaccactaacagtagagacttaaagtcctctgccttaactctgagatacaatcccacctgtagtgtcattttatttccacctgtgttattcattcatagcctaaaagctcctaaatttccacccctgttattcattcatagcctaaaagctcctaaatttccacccctgttattcactcatagcctaaaagctcctaaattaccaggaagaaagcaagagagtctgaaagctcaggtccctgttactcctcctctgtctaaagacaggcttggaatctcactcttctaaacaccactggtcactctgataagcttaactttcctttaaaatgaacttttaagtgctgacaaatgttttcttttccattgactttttatataacttctaaataacatgtactcaagaaggcatgcattatttaacaaggtacctgactctagaccagtatctgacccagagaagatactcaataaatttgttttgatgcataaatttgaaaaaaaatgaaagaattgtaaactgtctttaaaatacagacaagaaaagaaaaaggaaataacatggcccataacccataatggcagcagccagagataaccaaccgacatttcagtatgtactctactagtcatataacatcctagaaacatacgtaaatcatgatgcatgcattatttttgtgtgtgcttaatatgtagtgaatatttttcccatctactaaatattcttttgcaatgtcattttatggccacatagcattccaataaatcagtgcaatagtgtgctggtaatttaactttcttccctattcttgaccttttaggttgtcccctttttggtattattattattattggtactgtcagctataaacatttgtgtggctgaatctttatgaatattcacgatgatttcctgatgctaaattccaagaagcagaatattaaggcttttgattcgtaatcggcaaaatctttctagtaatttaaatcaaatattaatctttctagtaatttaaatcaaattttagggtagctttaggtgtggtgcacgcagaaatgctttactgggtcttagtttgtcatttccagtattattcactcctatctctgaatttacacctttgaggctcattgaagcagtcattctcccaggagcctgttgttacagaaccctcagagagcaagaaactctttcattaaaaagagctccataagcttgcagtgagatgagatcgtgccactgcactccagcctgggcgacagagcgagactggcaaaaaaaaaaaaagctccatagttatttgcacctgttctttcatgaccagctggagtagtatacatgtctctcaattctttttctaatagcaagcatattttaaaaagtaaatcttgttttcttaagactttgtaaatctttactgtactcatccttaataggtaaagtaaaatatgagttgagccatgtttacaccacaacaaacagacacaacctgggttttcccatgaatagaaattaatttcaacttgtgagaaagaaacgaataaaaagttagccttaaaaagcatttatagctatctatgaataactgtctttagaagactattaaatttttctttaaacgtttatcaccatttggtaaataaggtaacagaattactttttttttttgagatggagttttgctcttgtcacacacgctagagtgcaatggcgcaatctcggctcactacaagctccgcctcctgggttcaagcgattctcctgcctcagcctaccaagtagatgggattacaagcacacaccacaatgcccagctaattttttatattttcagtagagacgaggtttctcaatgttggccagactggtctctaactcctgacctcaagtgatccacccgcctcggcctcccaaagtgctgagatgacaggcgtgagccactgcatccagcccagaattactattttaagatgactaacgaaatgcaatcctctacaaatgtaagtggacacgaaataccatggcttctaattattcttggaaaatatacacattgggtttaaaatgatcacttgagtaatgaaacggtttgtccatttcactaataaccactataaattaatgaagaaagaatttatcatcttgaaggactagtgccacaatgtcttactaataagagatactcaatatgctttataggaacttagagaaagatttgcagcattttccaaaacagagagggggaatttaagagtgttggtgggctgggtgcggtggctcacgcctgtaatcccaacactttgggaggccgaggcaggtggatcacgaactcaggagatcaagaccatcctggccaacatgttgaaaccccatctctactaaaaatacaaaaattagctgggcatggtggtgtgtgcctgtactcccagctactcaggaggctgaggcaggagaattgcttgaactcaggaggcggaggttgcagtgagccaagattgtgccattgcactctagcctgggcaacacagtgagactccgcaaaaagaaaaaaaaaaaaaagtgttggtggattttttgaatacctataacaaatgccctctggaactaaaagtatctgattctaagagaaaaacaaagacaaaaacccaccatacatctacaatttctttgttgaaatagtttttgagactcctttaataacttacatcttaacccttatttttaactatatgaataaatattttatgtgaaattttggcaaattatgaaaaaatttatttttacattgtgtttttctaaatagacctatttttaatgtattcattgtatttttttattatactttaagttctagggtacatgtgcaccacgtgcaggtttgatacatagctatacatatgccatgttggtttgctgcaaccatcaactcgtcatttacattaggtatttctcctaatgctatccctccccctgccccccactccctgacaggccccagtgtgtgatgttccctgccctgtgtccaagtgttctcattgttcaattcccacctatgagtgagaacatgcggtgtttggttttctgtccttgcaatagtttgctgagaatgacggtttccagcttcatccatgtccctgcaaaggacatgaactcatccttttttatggctgcatagtattccatggtgtatatgtgccacattttcttaatccagcctatcattgatgggcatttgggttggttccaagtctttgctattgtgaatagtgccgcaataaacatacacgtgcatgtgtctttatgacagcatgatttataatcctttggctatatactcagtaatgggattgctgggtcaaatggtatttctagttctagatccttgaggaatgccacactgtcttccacatggttgaactaatttacactcccaacagtgtaaaagcgttcctatttctccacatcctctccagcatctgttctttcctgactttttaatgattgccattctaactggagtgggatggtatctcattgtggttttgatttgcatttctctgatgaccagtgatgatgagcattttttaatgtgtctgttggctgcataaatgtcttctttggagaagtgtctgttcatatcctttagccactttttgatggggtttttttttcttgcaaatctgttgatgttctttgtagattctggatattagccctttgtcagatgggtagattgcaaaaattttctcccattctgtaggttgcctgttcactctgatggtagtttcttttgccgtgcagaagctctttagtttaattagaccccatttgtctattttggcttttcttgccatgcttgtggtgttttagacatgaagtccttgttcatgcctatgtcctgaatggtattgcctaggttttcttctagggtttttatggttttaggaatagacctattttcatataaactttcattaaaaatttgccatcttctaataatttgtgtgcaaaggatttttccataacatttacaagttcccaggataccacaatggagggtaactggagacttctgaatatatacacggtagcaagaaatccttgttttaccctccaataacacctacacaatcagacactaatatttaagatctatactgtggaggaaacacattctcattactcaactttcacattttcacagcaaatatgcctcatattttcatgttttgtatattatttaggataaccagatggttttctgaatctctactgtatgatttttttttttaattttagaaacagggtcttgatatattgcccaggctggacttgaactcctggactgaagtgaccctccagtctcagcctcctgagaatctaggatttacaggcatgaatcaccatgcccagctctaccttaagaatttgaccttatcagtgattttaattaaaggaagaaagaagattcctggggtaccttttcagttttaacacatattactcttccttctaagctaatccaatgatctctctttttaatcttggccaagacaccccttggccactgtattagtccattctcacactgctatcaagaaatacctaagactgggtaatttataaagaaaatggctttaactggctcgaagttccacaggctgtacaagaagcatgaggctggcatctgctcagcttctggggtggcttcaggaacttacaatcatggcagaaggaaaagggggcaccagaacttcatacggctggagcaggagaaagagagaagggggataggctacacacctttaaatgaccagctctcataagaacaccctcactatcacaatgacaacaccaagggggatagtgctaaaccattcatgagaaactgctctcatgatccaatcgcctcccaccaggccccacctccaacactgaccattacaattgaacacgagatttgagtggggacacatatccaaatcacatcaaccatcaataacgaagcattctacttcttccctatttcaaattcacaatatcattgttttttgtttttgcttttttttttttgaggcagagtctcattctgccacccaggctggagtgcaggggtgtgatctcggctcactgcagcctccacctcctgggttcaagcaattctcctgcctcagcctcctgagtagccaggattacaggtgcccactatcacgctcagctaattcttgtattttcagtggagacagggtttcatcatattgtccaggctggtcttgaactcctgacctcaagtgatccacccaccttggcctcccaaagcgctggcattacaggtgtgagccatcacgcctggcctaaaattcacaatatcttttattgcaatcaaaactttccccctcagaaaattagttattgggctaattaaattatattactgttaccttctgttggtaagccgtcaggttattttttgaaagttttacttacagagcatataaattacccttggttattctcagctgtgattgagttctgtgaaagcatagtaccctagtaccctgggatatctctacatgtgaaattattcaaatgtctcccttactttttttttttttttttgagacaggctctgttgcccatgctgcagtgcagtggcacaattatggctcatttcagccttgacctcctgggctcaagtgatcctcccacctcagcctcccaggtagctgggactacaggcacacaccaccatgtccagctaatttttgtattttttagagacggggtttcgccgtgttgcccaggctggtctcgaactccatggctcaagggatctgcctgccttggcctcccaaaatgctggaattacaggcatgagccaccatgcctggctatcctttcttatcacttttaaggtgctgatgactcacacacaatagagcccaaccttctcaaaactgtaattctctaccaaatacagtcactaggaggtaccagcttggttaaatcagaatacatcttcatttactcattcatttattttagagagagggtcttgttctgtcacccaggctggagtgcagtggcacaatcatagctcactgcactctcaaactcctgggctcaaacaatcctcctgcttcagcctcctgagtagctaggactataggtgttacaggtgcacaacacacacccagcttattttttaatttttattttttgctctccacatgtgccttctgaatcacttaatagtaactttgttgaagagataaattaacagtactagcttagagtcccagctgtatctcacttataaataagggtctgctttatcttattgtcaccactgagatgctaatactattctctagggcagagattctcaaccagggcattgtaacccctaggggacatttggcagtgtctggagtaaaaacgttaagtggggtgctggttgttagtagcacctagtgggtagaggccagcatgttattaagcctcctataatgccaagatagccccccacaacaaagaattatcctgttcaagatgttaatagtaccaaggttgagaaatcctgctttaaggaaataaaagtagattgaaaaattattcccgtttaaacttcggggttaccatccgggcagtgcagagctctgactttgagcttcataataggaagataagttgccaagcagaagccctgtgatgggagtaccccaatatattctcataaaggaatttagtcaacatggacccactggtgtgtagaccaggttccagggaatagtgtaaccatcaacttgatagtgttcatagctagtgagaaacccatccttcacgtttaatttgactgcatagaaaatttgtgagttgaatggagaataaaatagacaacagatgttaaccaaaccatctaaataactttacgaatagcctttcttgatcgatttttaaaatctcttcttgttggggaagtgttgggcttggaggatgaagtgcaataaataccttccgtgttgtgacatataagaaaacctctagccatttttagattttaatcatcttacccacattacagatgtaggctgtttggcagaggctcagaggaaagagtgttatcagtcctcagccatctaattacttaccttagagaaaattaggcaatgttccaagtctacagaagactcatgttctgttgggagttactaattacaagcagacctaagaagcattaatttgttttggtaatcatgccagggtgtatatagctctgccaaataatacgggaagtaaagactggggagaaggtgagctgctcgcctcagctggtaaaagagggattaaaaccagatggcctcaattcgtctcttttagccaagctctaaacaaaatattccttgtgctgaagtttaaattaaattgatgcctgactgccccactcctaataatctaaaataattctgtcttttaaaaataatttcctgttttgctgttttttttaagaacttgagataggctgggtgtggtggctcatgcctctaatcccagcactttgggaggccaaggtgggcagatcacctgaggtcaggagtttgagaccagcctggccaaaacagtgaaacccccacctctactaaaaatacaaaaattagccaggcatagtggtgcgtgcctgtagttccagctactcaggaggctgaggcaggagaattgcttgaacccaggaggtggaggctgtggtgagccgagatcgcaccactgcactccagccttggcaacagagcgagattctgtctcaaaaaacaaaacaaaaaaagaacttgagatagttaaaagttactctgacacacacccacacccacatccatttgcgtacacaagaaaaaagactgtgagaaaataaaccagaatggaaacagtagttatgtctggatggtgggatcataggggatttctattttctttttatatttctatgatgtttccacaatttttacaattaagcacagataatttttataatcagaaaacaacctgaaatagggcagttatttatacccattctgtctttctatcccattctctaattataattcacttctacctacactgatatccttctaaaaaaaaatggacttttgctcttgttgcccaggttggagtgcaatggtatgatctcggctctttgtaacctctgtctcctgggttcaagtgattctcctgcctcagcctcccgagtagctgggattacaggtgcccaccaccatgcccatctaattttgtatttttagtagaaacagggtttcaccatgttggccaggctggtcatgaactcctcacctcaggtgatccaccctccttggcctcccaaagtgctgggattacaggccggagccactgtgcctggcccactgatctcctttaaatattgatatggctatttatgctggaaaaggtaaataaccagccataatactaatcaaatcaaaatctcacccattattacctacttatataattggctgtgttgcatgttgctaatgggtaacatgttaaccttttattcaagaactaatttatcaaaggacttctcacattgtatctctaaggataagtacacatattcttatattctggcaaggtacagttcaaagaaaaagacaaaggaggagaatagatatcaggtcacaacctggccggttataggacatattgaagatacaaggctcaaaccttgaaaaatatctgaaatataattacatttatgctcaatgtctaaacttatatgtaatgtaaacacttaatgaaattcttaggttggtaatatagaatacttgatgttggcccatgtgaagcacaaatatttctatagtatgtgaaataacataagcttacctaaatttatgatcaacaaagaactgagagaaacggtttgttttgctataatactaagaaaactcaagcaactgaacttatgcatatgaaagcaggagttgataactcaacttccaagaaaaaaaaaatcatcaactattttaggttcaaaggcagagccataccatacatttacagatgtcacaattgaaaggaaacatgtccccttaaaattaaagtctatatagttaaacaaaagacaataaagtgcctgtagaagcacaaaataaagaaattccctgtacataccactcagctagtgaggctgtcttgatattagccagtaagtgagaaataacttatgctcacagtgatcctggtagcaggtaagtgatctcgtccactagctatttccagttccaacttgttaaccactggggaattcctgtttgatttatgacacttttctgatgagtataaggccatgagaatatttgcagggttcttttagaataataatcctagtaactctttggctaaagcaccatttgcagactagtttctgtatggatgccatggtagtgaatgtttagaggccatagaatatgggagagatatggtcccaggtggcattagcccaaggtaaattgaggaaaagaggcagttatttggaccaataggctctcatccattccatgctcttacactggcctgtagctgctcaaatctccctcacagagcaaaacttacctgttctatttctcattctctaaagccctttgctctccctgagctgagacctgtgatggatttctaacctataacactgtaagataatgaatttgtgttcttttaacctgctcaatttatggcaatttattatggcagcaatggaacactaacacacacattgtagttctaatttgcatttccttgatgactattaaagctgaatacttttttcacatgtttataaatacttggacatcctcttgtgaagtgcctgttcaagttttttgcccatttttctattgggttatctatttttttcttattggcttttaaggtttctttatatgttctgtaggagttcttcatatattctggatacaagacctttttcatatatatgtattgcactctgaagcttgcctttgttctctcttaatggtgccttttaatggacaaagcttttaacgttaatagagtccaatatatccagttattccttttggttcattaattttgcatcttattaaaaaatctttttctgtgagtcatgaagatgttctcttacgcttacttctaaaaacattattgttgtacctttcacgtatagatctgcaatccatcttgaattcagttttgtatatggtaaaagaatattcattttcctccatatacatatttattaacctagcactatttggtgaaaagataattttctctactgaactactatgcacctttatcattaatcaggataccacatatgtgtggatccatttttcaactccctattctgttcttttgattagttcatctatgtttgccctaataccatactgtttttctcaactctttattctgttcttttgatgagttcatctatctttgctctaataccatactgttttcattactatagcttttttgttgttgggacagggtcttgctatgtcaccaggctggagtacaggagtgctatcatagctcactgtaacctctaactcctgggctcaagtgatcctctcacctcagctccagagtaagtaggactacagatgtgccaccatgcctggctaattttaaattcttttctagagacagggtctcactgtattgcccaggctggcctcaattgatactcctgcctcagcctcccaaagtgctgggacattactatagttttgtaacagattttttatatctggaagtctaagtccccaggttgttctttttcaagattgcctcatatattctttaccctttgcatgtctgtataaaatttaaaatcagcttttcaatttacacacaaaaaaaaaaccctgctgggattttgatgaatctgtaaatgagtttcagaagagttgttattttcacaatctttcaatttatagaaataattatgtttttctacgtattgaaacagagttactttttctccataatgtattatagttttatggtaagggcatttaatactttttatgctgttgaaaattgtaattttttgtaagtgatatctttttaaaatttcattttctatttgatgttgctgggatgtagaaaattgatttttagaatattaaccttgtatatgcaaagggcaaagtcatttatttaggacatctttaatttttctcaataatgttttatagttttaatggaaataacattttatataatattttagatgctagtaaaaatgataatattttgtaaatggtattttaaaaatttttagttaaatttgtttttcttgctggtatataaaatatagttgccttttgtataatgaccttatacccttatcaatccatcttgaattgagttttgtgtaagatatgaagtagaaggaaagatttatttctcctatatgcatattaaattaacctaccacctatcttaacatctgtaacttaattacatctgcaaaatctcttctgccatgtaaggtaacatattcacaggttctagagtgtggacattattggcgggccattctgtccaccacacttttatttttgtcttcctctattgcaccagctaggactctcagtccaatactgaagagaaaggaagatggcaggcatatttgtcttgttcctactataaggaaaaaaagcttttaatattttaccatttagtataatgtttgccacagatattttgcagatgttctttatcagattaatgatgttcctttctactcctagttagctaagaatttatcacaaataggtattgagctttactaaatacttgcattgattgaaatgtttatctgatctttttctattaatatggtaaaataccttaattttctaatactgagctacccttgcattcccacttagctgttacgtattatctttttgaagatatattgttgcacttaatttgccaatatttggtttagaattgtcagtactttttcatggaagttttcagtctaaaatacatacttttttttgcttctaccttggggaatataagcactgtttttgaatttttttttaaattaagagatctttattctccagaacgttataatcttctgaaacttgtccatattgatccaaccatataacagctctttttgcttctacctaaaattttctgaccaggtatggtggctcttatctgtaatctcagcactttgggaagccaaggccaggagtttgagacaagcctgggcaatacagcaagatcctgtcactacacaaaatttttaaaagttagccaggcatggcggcacatgcctgtaatcccagatactctggaggctgaggtgggaggatcgcttgaatccagggttcaaaggctgcagtgagctatgattgctctactgcactctagcctgggtgatagagtcagactctgtctcaaaaatcataaaaaataaaaattaagaaattaaaaataaaataattttttgatgatttctttgtctgaataatggaaatatgtctaggggttggcagtcttatagaacacacacatttccaacagaataatccattttcatttatttcctgcatttctgccagctcacagtatatgctaaatctgtcaagatagggctggatctattttatagtaagcaatacccggtatactgtatgttcttaataaatacacaataacattaaaaatgaaaccaccagatggtgccactgtaggtaatagtcagcttgttaattccaacagtaaagaatgttttcttttaagcactatgtgaaaaaaatttattgagattgccattactgcacatactaataatcatctactgcttcactccatgcctgacaccgcaggtccccaaagtcaccaaatgttcaaatcaatattgcttgaagttagaaaagcactggagttgaattggaggattcacagaggtgttctccccgcatttaggctgtgaatcttttttttttttttttagcagtgacttgttactgctctgtgttccacgaattaaagcctttttaaatagagaagggacgttatacaagatgaggaaaaaataatagataagtttaagaagatcagaaacttatagttgatgtcagctgtcctaatttttcaccttccagagcattatgagttcactgaaacaatgtgaatggtatctataagagctttgactattagagtcttgatataagtctgaggcctaatcactactacaagtctgtatccaagataaaaaggaagcaggtctcctgcatttcattctatttaaaatgcatttagtctcctgcccattatccacatttgttaataacagttctcatctgagggctaactcagttgaagtcctgcactgcaaaatacttgactgcattatgtgacaggcacattggaatggtgacaagcagccaaccctataaaatactccagaatgatgggtgttacatctgatcaattccacttgctaagcatatacagttcttgcacattatcaggaaaaactataatactggcctcacgtttccatggtgacttgtgagagctattcttaaatttaagagttacctcttttaatcaacaataattttcatctagatgatattcccaggctaccctgaattatattatcatggtggtaatttactttctgtctcagctcaaggtaaaatttatttgcctagggccagagagagtagaggggtaggggtgggttggaagggcatgtagcagctgagggacatgggaatgataaaaattgcttaaaaaggaaacaaagcaggtaacagatttgaatacaaaaaagtattaacttttcaataattttaaaaaatttgcaatggaaaaagtacatttttcttacctgctctttgtcctcacaaaagctgtacaaatcaacataaatatgctttgggacagcatttttaatgttaaattacagcataaatttctcactttaagcatcaattaacattttagtgattctagcccagtcaataaaatatataactttaaagaaaattccttctgatccaatgacagctaatcttgttgggattctgaaacactagctaaagaccacaaagactacttctggctagtggacattaaaagaagcagcacagattcaagtaagtaggtaaagaaagctgttattattttaagcaaaattaaaacagatgggagagacagacacacatgtattcagatatgcgcctgcctcacatttaatcttttatgaatggctgctcccagatggtgatgtgattcagcaatgcaattttagatacaccatctattttccttacttcaatgtactgtgtcaattacaacttttccacttagtggctgatgcaactatcatcaaaagaaaaataaaccatcatgaaaacaggttctctgatattttgaaaacaaggtgatattcaacttgtcaaaccaagtccagacatttctctacactctccatccttcaattcgttacaggtttggtacttctattccacattcacacaaatggtgaggtaatgaaacaagagaccaacataacaaacacattatgctgatgagtgtttgtgaatctctcactaactgaccccagaatgggacatgctgtcccctaaagtctcacagcgtgtcacctgtacctcttctaggacatcatgttttatcttggataatgataagaataatagaaatacagaattctaacagagcaactactgtatcttgtcatagttattaacatgccaactcccactgagatagtaagctcccagatatagcagcttcttcatctttttagatctggcacatagcagtatccagcagatagagaaatcaattaagatacattaaatgaatacataataacagttgccacttgtacctatcatatgccaggcactgtgctagatactttacttacattcctttccttcccagttttattgaggagtaactgacaagaaaaaattgcatgtatttaaggtgtacaatgtgaggctttgatatatgtgtacattgtgaaatgattaccacaaacaaactaattaatatcctaatatccgtcacctcagatagttaccttgtgtgtgtgcggtgagaacactttctactctcagcaaatttcaagaatacaatgcagtattattaactatagtcctcatgctgtacgttagatcttcagaacttattcattctgcaaacggaaacttcatattctttgaccaacatctccccatttccccctagacctcagctcctggcaacccccattctactctctgtttttatgagttcaacttttttagattccacaggtaaagtcagttcatgcagtatttgtctgactggcttatttcacttagtgtaacgtcttccaggtcgtacatgttgttataaatggcaggattcccttctgttttaaagctgaatgacttcccagtctctgtgtgtctctgtgtgtgtaccgcagtatccatctatcaatgaacacttaggttgcttctacagcttggctattgtgaatagtgctgcagtgaacatgagagtgtagatacgtctttgagatactgatttcatttcctttagatatatatctggaagatatgtatctggactatatggtagtcctatttttaattttttaggatttacttacattcttccactaatgctataaacaacctaacccccgtttgacagattagacaagctatgaaggctcatggaagtgaagtaaaatgcttacagatcttgtagctaggtaattgtggggctggcattccaaaccagacctgtataatgtggaagtctttgagctttcaagcatatcacacagcccctcctctggccgaactcccataagctcaggtctgagttgtcgggtggggactgcaggaggtggtagagtgcagaccccatacccgggcagtgacactggcagcccctgcactgtcatgagtgggcagcgattggagcagtgtctttactggacacctgtgaccaaacagcctttggggtgtaaacagtaatggaagataccactacagaaagtaaaaacaggagaagaagaaaatagtgggtgtcctgtgttcaccatgagaagtgcgtagagctcatgggaaacatgctgaaagcccttccgaaggaattggagcagagccagagctcctgcagaatatgggggcagggccaaagaaataactggggagtagttattataatcctgttattgccctatggagaactaggaaatgtgggtgataagtcaatattaatgtggcatattttttacctcccaaactaggttataatctccttgaaagtaatatccatgcctttttttttttttctgaggcagagtctcactctattgtccaggctggagtgcaatggtacaatcttggctcactgcaacctctgccttccagattcaagcaattctcctgcctcagcttcccaagtagctgggattacaggcatgcgccaccactcccagctaatttttgtatttttagtagagatggggtttcaccatgttggtcaggctggtcttgaacacctgacctcgggtgatccacccgcctcggcctcccaaagtgcttggattataggcgtgagccaccacaccctcccatgcctaatattatttctgtgtcagccatggttcctagcacatttccctataatccactctgtaacttcagaaagcagccatcctaaattaggtagctaatgtaagagaagccacaccttggaagttgtcctaatggtctgccaggtcagttttaatggagcctaggaaaaacagcaccagtggttagggtttctctagccctatccagaggacaggactcctggatgggtcaccaaaggtattctgattggtatggcactgggtattgaataagagaggatacatgaggttatcagagcttaagcgcattgatttttactcaatttctttgattttaattctatactcaggaagacaacatccgatctttattcagtttataaaattggataccctacttagaagggacagtgggtgcagcccacagagcatgagcccaagcagggcgaggcatcgcctcacccgggaagcgcaaggggtcagggaattccctttcctacccaagggaagcacctggaaaatcgggtcactcccaccctaatactgcacttttccaacagtcttagcaaatggcacaccaggagattatatcctgcacctggctcagaagaccccatgcccacaaagcctcactcattgctagcatagcagtctaagattgaactgcaaggtggcagcaaggctgggggaggggcgcctgccattactgaggcttgagtaggtaaacaaaacagccaggaagctcgaactgggtggagcccaccacagctcaaggaggcctgcctgcctctgtagactccacctctgggggcagggcaaagccaaacaaaaggcagcagaaacctctgcagacttaaatgtccctgtctgacagctttgaagagagtagtggttctcccagcacacagctggagatctgagaatggacagactgcctcctcaagtgggtccctgacccccgagtagcctaactgggaggcaccctccagtaggggccgactgacacctcatgcgcctgggtatccctctgagacgaagcttccagaggaacaatcaggcagcaacatttgctgttcagcaatattcactgttctgcagcccaggcaaacaggggctggagtggacctccagcaaactccaacagacctgcagctgaaggtcctgactgttagaaggaaaactaacaaacagaaaggacatccacaccaaaaccccatctgtacgtcaccatcatcaaagactaaaggtagataaaaccacaaagatggggaaaaaacagagcagaaaagctgaaaattctaaaaatcagagcgtctctccccctccaaaggaacgcagctcctcgccagcaacagaacaaagctggacggagaacgactttgacgagttgagagaagaaggcttcagatgatcaaacttctcccagctaaaggaggaagttcgaacccatcgcaaagaagctaaaaaccttgaaaaaagattagacgaacggctaactggaaaaaccagtgtagagaagtctttaaatgacctgatggagctgaaaaccatggcacaagaactacgtgatgaatgcacaagcttcagtagccgattcgatcaactggaagaaacagtatcagcgattgaagatcaaatgaatgaaatgaaacaagaagagaagtttagagaaaaaagagtaaaaagaaacgaacaaagcctccaagaaatatgggactatgtgaaaagaccaaatctacgtctgattggtgtacctgaaagtgacagggagaatggaaccaagttggaaaacactgcaggatattatccaggagaacttccccaatctagcaaggcaggccaacattcaaattcaggaaatacagagaacgccacaaagatactcctcgagaagagcaactccaagacacataattgtcagattcaccaaagatgaaatgaaggaaaaaatgttaagggcagtcagagagaaacgtcgggttaccctcaaagggaagcccatcagactaacagctgatctcttggcagaaactctacaagccagaagaaagtggggaccaatattcaacattcttaaagaaaagaatcttcaacccagaacttcatatccagccaaactaagcttcataagtgaaggagaaataaaatcctttacagacaagcaaatgctgagagattttgtcaccaccaggcctgccctacaagagctcctgaaggaagcactaaacatggaaaggaacaaccggtaccagccactgcaaaaacatgacaaattgtaaagaccatcaatgctaggaagaaactgcatcgactaacgagcaaaataaccagctaacatcataatgacaggatcaaattcacacataacaatattaagcttaaacgtaaatgggctaaatgctccaattaaaagacagagactggcaaattggataaagagtcaagatccatcagggtgctgtattcaggagactcatctcatgtgcagagacacacacaggctcaaaataaagggatggaggaagatctaccaagaaaatggaaaacaaaaaaaaggcaggggttgcaatcctagtcttggataaaacagactttaaaccaacaaagatcaaaagagacaaagaaggccattacataatggtaaagggatcaattcaacaagaagagctaactatcctaaatatatatgcacccaatacaggagcacccagattcacaaagcaagtccttagagatctgcaaagagacttagactcccacacaacaataatgggagactttaacaccccactgttaacattagacagatcaacgagacagaaagttaaaaaggatatccaggaattgaactcagctctgcaccaagcagacctaatagacatctacagaactctccaccccaaatcaacagaatatacatttttctcagcaccacatcgcacttattccaaaattgaccacatagttggaagtaaagcactcctcagcaaatgtaaaagaacagaaattccatcaaactgtctctcagaccataatgcaatcaaactaggactcaggattaagaaacccactcaaaaccactcaactacatggaaactgaacaacctgctcctgaatgactactgggtacataacgaaatgaaggcagaaataaagatgttctttgaaaccaatgagaacaaagacacaacataccagaatctctgggacacatttaaagcagtgtgtagagggaaatttatagcactaaatacccacaagagaaagcaggaaagatctaaaattgactaacatcacagttaaaagaactagagaagcaagagcaaacacattcaaaagctagcagaaggcaagaaataactaagatcagagcagaactgaaggagatagagacataaaaaatcccttcaaaaaatcaatgaatccaggagctggttttttgaaaagataacacaattgatagaccgctagcaagactaataaagaagaaaagagagaagaatcaaatagatgaaataaaaaatgataaaggggatatcaccaccaatcccacagaaatacaaactatcatcagagaacactataaacacctctacgcaaataaactagaaaatctagaagaaatggataaattcctggacatatacaccctcccaagactaaaccaggaagaagttgaatccatgactgaactctgaaatcaaggcaacaattaatagcctaccaaccaaaaaaagtccaggaccagatggattcacagctgaattctaccagaggtacaaggaggagctggtaccattccttctgaaactgttccaatcaacagaaaaagaaggaatcctccctaactcattttacgaggccagcatcatcctgataccaaagcctggcagagacacaacaaaaaaagagaattttagaccaatatccctgacaaacatcaatgtaaaaatcctcaataaaacactggcaaaccgaatccagcagcacatcaaaaagcttattcacgatgatcaagtgggcttcatccctgggatgcaaggctggttcagtatacacaaatcaataaacataatccagcatataaacagaactaaagacaaaaaccacatgattatctcaatagatgcagaaatggcctttgacaaaattcaacagaccttcatgctaaaaactctcaataaattaggtattgatgggacatatctcaaaatattaagagctatttatgacaaacccacagccaatatcatactgaatgggcaaaaactggaagtattccctttgaaaactggcacaagacagggatgccctctctcaccactcctattcaacacagtgttggaagttctggccagggcaatcaggcaggagaaagaaataaagggtattcaattaggaaaacaggaagtcaaattgtctctgtttgcagataacatgattgtatatttagaaaaccccatcgtctcagcccaaactctccttaagctgataagcaacttcagcaaagtctcaggatacaacatcaatgtgcaaaaatcacaagcattcttatacaccaataacagacaaacagagagccaaatcatgactgaactcccattcacaattggagaataaaacacctaggaatccaacttacaagggatgtgaaggacctcttcaagcagaactacaaaccactgctcaatgaaataaaaaaggacacaaacaaatggaagaacattccatgctcatgggtaggaagaatcaatatcgtgaaaatggccataatgcccaaggtaatttatagattcaatgccatccccatcaagctaccaatgactttcttcacagaattggtaaaaactactttaaagttcacatggaaccaaaaaagagcccgcgttgccaagacaatcctaagccaaaagaacaaagctggaggcatcatgctacctgacttcaaactatactacaaggctacagtaaccaaaacagcatggtactggtaccaaaacagagatacagaccaatggaacagaacagagccctcagaaataataccacacatctacaactatctgatctttgacaaacctgacaaaaacaagcaatggggaaaggattccctatttaataaatggtgctgggaaaactggctagccatatgtagaaagctgaaactggatcccttccttacatcttatacaaaaattaattcaagatggattaaagacttaaatgttagacctaacacctaaaaaccctagaagaaaacctaggcaatgccattcaggacataggcctgggcaaggacttcatgtctaaaacaccaaaagcaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaacagcaaagacttggaaccaacccaaatgtccgacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaataaaaaaaagaaaaaaataaaaaaaaaataaaaataaaataaaaaaaaataaaacaccaaaagcaatggcaacaaaagccaaaattgacaaatgggatctaattaaactaaagagcttctgcacagcaaaagaaactaccatcagagtgaacaggcaacctacagaatgggagaaaaattttgcaatctattcatctaagggctaatatccagaatctacaaagaacttaaacaaatttacaagaaaaaaacaaacaaccccatcaaaaagtgggcaaaggatatgaacagacagaaaacatttatgcagccaacagacatgtgaaaaaatgctcatcatcactggccatcagagaaatgcaaatcaaaaccacaatgagataccatctcacaccagttagaatggcagtcattaaagtcaggaaacaacaggtgctggagaggatgtggagaaataagaacacttttacactgttggtgggactgtaaactagttcaaccattgtggaagacagtgtggcgattcctcgaggatctagaactaaaaataccatttgacccagccatcccattactgggtatatacccaaaggattataaatcatgctgctataaagacacatgcacacatatgtttattgtggcactatgcacaacagcaaagacttggaaccaatccaaatgtccatcaatgatagactggattcagaaaatgtggcacacatacaccatggaatactatgcagccataaaaaaggatgagttcatgtcctttgtagggacatggatgaagctggaaaccatcattctccacaaactatcacaaggagaaaaaaaccaaacactgcatgttctcactcataggtgggaattgaacaatgagaaaacttggacacaggaaggggaacatcacacaccggggcctgttgtggggtggggggagtggggagggatagcattaggagatatacctaatgtaaatgatgagttaatgggtacagcataccaacttggcacatgtatacatatgtaacaaacctgcacgttgtgcacatgtaccctagaacttaaagtataataaaaaaaaattgaccttctctttgctgaattgcttttccacctttgttaaaaatcagttgggcatatttttgtgggtatatgtctaagctgtctattctgttccattgtgcctatcactctgccaatacttcagtcttgattactgggtaagatattaacaagattgtcaggtattgacacagtagtataaaatatatattatatattcaagctatataataattcttgaaattaggtagactgatttttcccacattgttctttttcagaattgtgttagctttctagttcttttgctattccatataaattttagaaaaatctttcattcgtctatgaaaaccttgctagaattttgataagaattgtgttaaacctacagattaatttggcatcttcattatgttgagtcttctaatccacgcatacagaatgtctctcctttttttttttttagatctctgatttctttcatcagcattttgtggtttcaacacacgtcttttggatctaggactaagcacagagttattgacagcaattttttggggcagttgaaaataatattgtacttttaattttggtatctacatattcattcctagtacacagaaatgcaattgatttttatacgtttatctcatatcttgtgaccttgatgaactcacttatgacttctaggattttttggttgattactggggattttctatgtagacaatgatgtcatctgcaaataggaacagttttgtttattcctttctgatctgtacactttttatttccttttcttccctaattgttctggctagaactttcagcacaatgttgaataggagtggtataagaagacatccttgacttagtcttttaccgttaagtaaattagctgttctttatcaagttgttacatgctctttatcaagttgaggaagttcccctctatctaatatttctaggagagttttttgttgttgttgttgttgcttgcttgttttattgtcttgaagtgctcaatgttatcaaaagtgttttctgcattggttgatataaatctgatttttcttctttagcctgttaatacagtgaattacactgactgattttcaaatattgaaacaggcttgcatccctgtaataaattccattagtcatggtatataattctctgcatgtatcactgaattctatttggtaatttgtaaagatttttgcattcatgttcatgaaagacattgtgctcgctctcgctctctgtgtgtgtgtgtgtgtctttggtacttaatatcaaggtattaccttcataaatgaattggaaagtattctcttgtattctattttccagaaaagactgtgtagaattatgttaattctttaagtatttggtagaattctccagtgaaatcatccatgcctggaaatttctttaggggaagttttaaaatttaattttctgaatagttaaagggctattcaaatgatctacttcatactgggtaaatggtggtagtttgtgtttttcaatgaatgagtctattttatcaagttgtcaatgtatgcagagttattcataatattcctttatccttttaatatctgtaaggtatatggggatatcccctatttcattcctgatattgttaatttatgtttcctctctctttttcttagctacacgtttgtcaatgttactgatttttcaaagaaccagatttttgtttcattgaatttcttcactggttttcaatttcatttatttctgcctccatctttatatcaattttctgcttattttgagtttaatttgctctctccagattcttgaggtagaagcttagattactgacttgagactttcctcttttctgatgtaaccattttgtgctaaaaatttctttctcagcataatttagctgagtccccaaatttcactttgttgtactttcattttcattcagtccaagatattttttgaatttctcttgaggctttccttttaactcatgaattatttacaagtctggttttaatttcctagtgttggagattttcctggtatctttctgttattgatttctagttttatcccattatggctagaaaacacgctctatatgatttcaattcttttatgttttttgaattttgttttatggttcaagatattgcttatctttgtgaatgttcatgggcacttgaactaaatatgtattctcatgttgctgggtagagtgttcttattgttgatcagatcctcttggttgattatgttattgagtttttctatatacttgacaattttcagtctcattgttctaccaattgttgagagagaggtgctaaagtctcccactataattgtgtatttctgtttatcttttcaattctaacagtttttgcttcacatatattgtagctctgttgtttggggcatacatatttaggacactctccttgagtggggttccaacccttactaggctgccttcctgacttccctcctgcggcctcagtgccaactgggctgccttcctgctctgctcaggcttccctagtgggtttgtgactgagagggagggagggatggagggaggaaagaaggaaggaaggaaggaaggaaggaaggaaggaaggaaggaaggaaggaaggaaaaggaagaaaggaggagggagggtagggggaggaaaggagggtgggccagattaacttatttttttggttgacttgtaaactgccttctctttaaaacaaaaaatcttcctttttctgacatcactgagtccttagaagtttccacatcagaagcaataattcctattccttgaacctcttagtgctccctatccatctggaagaaattacagagaaatgtgtgcacatatgtgtatgtgtgtgtatgtgatgtctttataccagtttgacatgttagtataggtttttattgaagaagaaaacatggaggaccagttgcaataaaatgagctggtattggaaagtaatcaaatctaaagaaaagtccaggccacagaaaggcaaattttcatttcttttctcacctgccatcttctatgaaataccttcctaacaaacaggacagttgctatatacttaaaaattagcattgatgttttatcactaaataaagcttagtcactcacagtgtatttcacttgttcaacaacttttggcacctgataagtgcctgacagtattagaacctaatgccttataagttgatatttaaatccgcaaatgtttaaaggataatagtttatttttccttagagctcagcattaattttttcctgaaacaatgactaagtgtttagctatttactgaaccagcgagtcatggatataatcaaataatacatttattctctttttccctatactaggtccgatctcctttatgaggttacttcttttcctgccacttcatgcaaaatctccaacaaataataaagagttctctaggcactttagtttaaaacataacttcatgtcagcaatcaatacatctgttccagtatgacaatcacagactcctaacattgttaaacttattaaaactccttcccgccttcccctaaagactgagtgggtaacgagacatggctgacttctctgttccccaacctagggcttctcctcctcctcatctgcctctgcctcctccagttctaaaggggataggcaaaggaagacacattaggagcagggacaatggtctgactggcacccttctggcagtgatgtcttctgaccaggccagatgtttacaattgtccctctcttagatgctgaattaggttctccaccatcactggggtgtctcacctgcagtgcctctgcctgggtgaatggaccttcctgctggtaacttatattcccctctccacactaggaatcctgggtctcctgactcttccacgcagccttcccgagtgggatcaaggagaaccccaggctagctctggcccttggctcacatttggacattgggaaatatatactttgacccatcatttctgagagtggagtgatttcccaaacacagccttcttcttatttagctgcctggccagcaagttctggtcagagccatttagtcttcagatttatcatataccagtctggcatgctccctaaattgtgtgggacacaaataagatatctaagcaatctccctgaagcttccctcccttaaggttggggtcaagagaaggcattctatctcctccactatgaggggtggtagaattcacagcagagctagctccaaagaagccttctctctaatctctaacttcttgttctttccaactgtgactttagaaatggggaagggggccatgagttgaagcaccagtatctcactttgaaatgtggaggcaatgccccagtgtcctaggccctcaactgaaggcaaaactgaaatgttctattttaacacatcctgttgaattgttctttcatcagctgccaaattcattcatggtaaagcccccaaaattttttctgccacattacaaaaaaaatggaacatcttatcataaaaaattgtctattccactgttttggatatagatttacatccaaattctaactcaaaatttgtgaacttatattcacatctgagaggatgccagtggtatcaaaatatccatgctcacccccaccctcgcccttaatgagagttcctcataggattttatgtttctctccaactgaattaaatagaagaaaacacaagaccagcattgttgaggtttccagagaacactgccccttggcaggctgcctgctgggaggtcaggcacaacccaagtccttctcttagcaggacctctgaggagagaaaacaatcatcagagacttgtttggagctggggttcaaatttactgatttttcattttcttgtccttagatgaccacccagtagttttccttttttaaatgcttttctctacctgctttcttagtcttgagaggcgtaatgacacattgccaatgtaagtccatattatttttctaagagatggggtcttgttctgtcacccaggctgtactgcagtggtgcaatcataggtcactgaaacctcaaactcctgggctcaagcaatcttcatgcctccgcctcctgagtagctaggactacaggtgcacatcacatcaccatacctggctaattttaaaaatacttttgtagagacaaggtcttgctatgttgcccaggttggtcttgaattcctggactcaagcaatcctcccacctcagcctcccaaagtgatgggattataagctgtgagccactgcacctggccataagtctgtcttatacagacacatatagttattcagagccgggtggtaatggttttctaaagtccggtgataaacacaagaaacaacctaaaacattgagtcgtttatttgaaagcagcataattttagtgttgagttgcccaagacacagttgctttcagtctttcttcagagaatcccagaagctcctagaatatgtaagtaggggcatttgtcacccctacttattctcacagttgaagttcaagttcattcctatcattgaacaggggagaagattcagagaagcagccaaattccaagtgatttggcatgaaaaaatctcagcctgaaagtaatcagaggcctagagttttcaatctctctaagttttgtagacaatttacataattacattggcacacacatttttccatttcaataaaaaagcctcaaagatctttatgttcatggacaaatctttaatattgtaaaaaatataaaataaaccaatataaactcaaaaattccaaataggggcatgattccttgatttttcttttcagagccagtaagaatacatttcagatagaggaaaagggaggtctggaactttcctttgccaatacccttcctccactcaaacatacacaagaagctttattagccaagtctcccccactttgctttgatattttgagcccaattgaatatgactgatcacagctctcagtacatgtttgtgggcagatttttgcttgcacacatagtacgaacgtctttgatcaagaccagctgagaatactggcctaaataggtagacttggcagaattctcaaccttggctatttctatcaaggctaaggggttcatactaccttttagaagtcttttttcctcatggaactaattaaatataagtctgtataatagaagtaaagttaaaacaactataataatttctgtttatttttgattacagcaaaacggactgaacacaaagtggtttataaattccatgcttacgatcacagacaggagccacaaaccatgaatgccaaagtaaacgcagaccaagctgagtgtcagagtcaaagaaaatatacatcaaatttaatgatacatatttaatgatatgtataatcactgtaattgcttgagtagacaggaggaggcgccaaagacacatttcatcagcctcacaaatcagctggtccagatggccccccatcttcttcaatcctactccagcgcccagaggacaaagtccctggaccggtagtgaaggccagaggaccacacatactcatttactctctccattccctccacaggccagaagcataggctgggatggtggagtcaaaaatgatctccttgcacaattcctgctcagaagctcaaataacctatgaagagctaccagatgtgtgtctctttgtcaacataactctagcacaaagcacagagtcagggacaatttgttaaaaggatgacccctgcgaagacggctatttgtgttgggagatgaggaagaagattggcatggcaatgtgaaagtcttagaaattcacctcctagtgcatgtaagttaattggtttgctttcctaacatctaatacccaaggaaattggagttttaaagactgttaagatattgggttcctacagaaagagggaaaatatatgagaaaaagcatccccctcaaaaccccacttcttcatttaatacttgttttggggtttttaaaaaaacttttaggttcaggggtacatgtgcaggtttgctatataggtaaatttgtgtcatgggggtttgctgtacagatcattttgccacccaggtactaagccttttaccaaatagttattttttcttattttctccctcctcccaccctccacccttaagtaggccccagtgtctgtagttcccctctttgtgtccatgtgttctcatcatttagctcccccttataagtgagaacatgcagtatttggtttcttgctcctgtgtttgtttgctaaagattatgtcctccagctgtatccatgttcctacaaaggacatgatctagttcttttttatggctgcatagtattccatggtatctatgtaccatactgtctttatccagtctactgttgatgggaatttaggttgattccatgtctttgctattgtaaataacgctgcaatgaacatacatatgcatgtatctttatggttagaatgatttatattcctttgggtatacacccagtggtgggattgctgggttgaatgatagttttgcttttaggtctttgaggaattgccacagtgccttccacaatggttaaactaatttacactcccaccaacaatgtataaacattccctcttctccacaacctggccagcatctgttattttttgactttttattaatagccattctgactggtatgagatggtacctcattatggttttgatttgcatttctctaatgatcagtgatgctgagctttttttcatacgcttatggccacacatatgttttcttttgaaattcacttaacacttgtatcaaagacaggccctattcccttttccctcctttcagaaccctttcctcctgtcttatctcctgttctaatccatccacagttaggtgagccagcagtggggataagatacctgcaaaggcctgatttgtggttccactcctaggggaaagtccaggattgttttcagggttgtgttttgttttgattgggaggggttggggcataagaatgtttttagcctacttaggatctttgctttgtacgaactacaccccagaggaattttgggatgcattccaaaataggaatacataaaactttctgtcccactaaaaccattcaggaaagtgagaggagaactttcatcctgtgttacaaacggctgactgaggtttctttcctgaaagcaaacaacagtaacacttctaccaattatattgataatccggtctgttcgactgacagtgtaaattaagatcaattaacacctcctcctaaccgtttttgaatgttttataattgtcacaaatagtcatctctttgtaaattacacagggcaaatgttgatctaatcaaaggggggtaatttcattttcagacaaaatttgtgaaaccttcttatggacaggaaaaactcttacttgaataacagaaataatggtaccaaaatggtcttcctgaaaaaatgaagatattgcatgcgatatgttatttctatacaaagaaggtgttaggataattatcctgagtttctagactatgaaggattaaagataactcacaaaagtactatagaacagcacacattattaagactataataacaaactgtataataaaagtttgttttatcatgacaattatgacatggttttcatagagaaaaccaattaaagacagctgtgtcttaagtatattttggaaggcaggctcataatatgtagtgacagtagaaagccttcactctgccactgattaccacacacacacacacacacacacacacacacacacacgcatacacattttgtgaggagcatttcttatatgggatctaaacacaaagccatatttgctaataggtctataccaacttccatggcaatgctggtgttaggaggcagaaatggtactgccttatatcgatgactaccatgcttttgtgctgtgcttaaaagccttgggtggtggtggggctctaacctgcaatggaaggcagcatggtgcagtagaaaaaacactttttgaaatcagaattcatgaaatcctgattcatggacccactttttacacaagccagagctacaactctggaaaaaaacagttaatgcctctgtgatttggggtatgtgtgtgtgtgtgtgttagagaaaacaaaacaaaacaactcaccaattccagacactgcctgtgcccataggcggcagcataatgtatgctattgtaaccttccttgtcccggatagatggatttgcatcattttgaagcagaaactctagacatctgtaagtataaagatgaagtgttattttagaaaacatctctggactgaaaaagataatttatgtaaatcctcctattacgaacgttccatgaagtactttatgagtttgtttctttaaaaatcctacagcaatgaagttttatgtgttgaaaattgtgtgtgtgtgtgtgtgtgtgtgtgtgtatgttttctgtagctatctttatttgagcttaatatagccattctagaattcaggaaaagctttaggaaaaagagggtaattacgatttttttctcctcatcttcaggtaagaacatctgttatcaagattactgaatagcaagttttggagctccatgttcaacaaagtctcaataaagaagtggtcagtatcagggcaagtaacagggcaacctcaatagggaggggtttactcttaacctcaccataaaatcaaaggttagaaaatgaaagttaaaaagagtaagaaaaaaaaataagaatagcctaaacaataaaaagattaaaggaatgggtaagcatttttaaagaatgaagaattaacttcataaccacatatgaataaagaggcttaaatttcaccattaggaatatagacctgaaaaatcaatgtttaaagccttttcaggcagagttgtaatttttctgaaaaagccacagtctttggaatgcttagaggaaggagcacggctccaccttcactgaagagcccaaaactctggttcacaagtacccaggaatgtaataagttctgctcagggcctactgcaaacggtccagtcctgctgggaaagagggagtcactagtcaggaagcgctgcttcatagcatcagcattatccctgtggcagtgggacaaacatgtcttttacaagaccaagctgattcaatttcatactcaaatcaaaatgttaagattctaaatatcaacccatacattaaataagaccttccaatagaaaatttctatagtttacccaaaaactataaatagcatttacctatcttttggtataaggcaaaacgaaaaaagtcaattacacatagggacaattaaaacagacacttcaatttctagaaaaactgatgaaagccatacattttaaaaaaaccaaatacccacatgtcaataataaatcaaactattcttagagtcttgctattattctctcttcggtcatttgcaccttataaggaaggaagttcttttttattttggtaattaaatgcccatggaaaggatcccaggtatgactcactgtaaattgaatttgactctttaaatgaaatcactcaataggaataacatgctagtggacacacaattcccaatttctgaatggattatatcctaaaaatcagttaataaattgaatttgtaatatagccaaactatatatactaacaacagtattattataataaaagtaatgtagaatttgcatattctccacattgcttgtaaggaaaacatgcattccgtgttttcactgggaatgcctagtttttttctcttcccagagcctagtaattttggcaattaagatgcaaagccaacagatgcacatgacgtcagaggcgtatctggatacagggagtggcctccctttgcatagaagaactctcaggcagctggttccccctgcccccctacctttcttgtcccctccctctctatcagcttgtctggctcagggcaagcttgcagttcactgtaaaaggaagcgtttgctgcagtggcttaagatgctagtcttttaatattgttattttaaatttgggggtattaaagcaaaactctggtcattctattttattcactgctgcatttcctgtcctcatcccaattaccatcgaagttaggtcccacaacctgcattggagccacactctctaacttcctttccacaacagtctgggcatgggaggagcacagtggaaaaccctggagtagacacaggcattcgggccacagaaaaactggctcctctaacaatggaagaataaataagttaacaacgatgtgcctgcagactcatagagcaccatatccactggattccacaggggtgaggcacaaggagtgggtaccaattcgtttgtttgttcatttactcaacagttattgaatattgactatgtgctaggcactgcactgagcactgtaagcttctcactgtgacctgtggtgcagaaaagactcagaggacgaagctgtagaggttcccgtgcatctacagccctgagtgatggcaggcactcccacccctgccacagcaaagagctacgtctctgttagaagccagggagaggcaggtgggatgaggggcccaggagcatccttttgcaggagcaggaggctcttcctaaattgatgtgcatgtgggctgggggtgaggggaaagcacaaatggttatttcacaccgaagtattaagaccttttaaaatagaatctgctaaatagatgtccccaggtcataagagcagaacctaagcctctgagaggagtctttgtttgtcttccttggtacatgatgcatcgcagttagaatgatatttaggacaccaggtcctaaaaactgctgaccaatcacagtggtggctgaagcaaagcgtacaattttagaaagttccctgtgtgaaaatagcagaattgaaggctgtattaaaagaatagtttcttccccattaaaggcaagcccatatcacttcctcaagatcccaagtgaaaccccaaaatagtaaggcaggcaacgtggcaactcagaaaagcagaagaagcgtcagaaatggcaccttgttcttaagctgagaagaaacttacagtgtggcttccttttccttcagctccctggctctttcaagttcttctgaattatcatgggcatttcctaagatagtcttacttctcagcataaaggatagaaaaaaaaattgcaattaattttttaaatggcaaagctgttaatggttttggtgcaatttatatctcaatgatttttaccccaacccaaaagaagtaagcaccactgattttcattgaagatatacatggttctctccaaagccatccagtaaatctattctctcccaaggatccaactggaatatgatttcttaaaacttccacttaagtatcagcaattaaggtaacaatcaagttgcccacccttctataaacatcctaaacttcccaagtaaagaagtgagttagctaaaacttctctgactcctaccacattccccactgcctccttgccagctcagcatctcatttgtccagaaatggggtcctattcacccttcgtctgccagaacaattcttcatcatccagaattccttttccagctcttgacagatgaagtatattgtttccccatccttttcaccacccccaatctattccaatgaattgcctggagcttggcacatagtagatgctcaataaatgtttgttaagcaatgtctgtttataacctgcatgcctaagggatcagaatgctacatctgatattattattttgatttattatataactatgaagaggaaacaagcagtatttttcaaactatggatcataagccattactgaattgtgaaatcgacttaatgggttgtagtcagcaagattttttatctaatgaaacagagaaaatgtcagaatgcatcacacatggtaaaagtaaatatgattttatgaaaactttatttccattttacatactatatgaactatatatatgtgaatgtgcatatggggtcatgactgtaagatgttacttctcactgtgggtcaccatctaaaagccattgctctacaagagaagcaattaccactgacccagaatcaattccacagcacaaggcagcaaataattcaatagttcttcaaacaaggtcatcaaaaagtattcctatgaaggaagcccttccttaagcttctaagaacaatttcatcaactgtgggcatctctccaacctttttccctttaactagttcacttatttctgttttctattcctacgcacctagaatccaaacatgccctgagcaaccaacttcctctcctctagctcctgaaagggcattcatacccaggtttggagcaatggtgcctagtttacatgtactaatgctgaatttaaaggctgttgggattatgcatgggtggatgtttttgacatatgacatatatattagcaaatgtaagttttatagcaaatgaagcatttaagtggtgacgatgaaaactacggtatatgtcaaaataaattaaaacagattttgaatgaaccataaacctgagcttgacagctccacttgggattcaacccaaagaacagagaagttattgtgcagtgacatgtaataatcaaacataaattgaccagaacaggaaagcccaggtttggaattaagcaaatctaactcttttgggttagtctaactctttttccatgaggcggtatgaagaaaacttagcaatccttccccaccactccccaaccctgttcccagaggaagcatgagcaaggctgtttttactttctatccatgtctgatgcagcggcgtaatgcaaagctgtgcgtccccagtcatctgtttcattaacgttggcccctgtggtcactaatgtctcaatacagtggaaatgacaattcgcagctgcatagtgcaaaggggtcctgaaaaacaaacagcaatttattactccattcagtctagaaaacaggcctgttgttggcactagcactggcagcagtatgcctagggcatggaaagctcttggactctcagagtgtgtggaggccaaagtcatgccttccttcaactatacaagttaggtatcccttatctgaaatgcttggaactagaagtgttctggatggttgagcatcttttattcaaaaatccaaaattcaaaatgttccaatgtgcatttccttcgaacattttgtcagtgtcccaaacgttgcagattttggagcatttcagagtttggattttcagatgaggggtgcttaacctgtataaactggaagtgaggctacaaagacagtggcttcaaacaaggccatctaccatggatctgtcctttcttttccttcctagagcctaccctagttcaggtctatgttattgcttttttggatcattgcaagcccatcctattggcttccttagcgctaatcaagtgtccataatttctagttaatgtaaatgaagaattttttttaaggtgcaatacccacatataacaatcatgttctaaaacctttggttctctctactaaccaatacttgattcctcagcctagaattgaagactttccaaaactggtcccaatctcctttgatggggtatctctctcccctagatgtacccaataggataaccaaactggatgacttgaggctttctggatcatgtccctacatcccccctacctttgtccaggttggtttagccccaggagtgcccattcacgaatcacttccacccatcaaaaccccactcatcgtcttgtcccaggggctagttctctttagtttgtctaagatggcttatctactctctgggtctgtcttgagttctcatcacatattgccttgattttagcactggtgtattgtctcatcctccccactgaactgcaagctccttgagggtagggatgttggttaatgggaagaacaatgcagaatccgaatccaaatccaaatcagaagccctgggttctggcattggcagatgtgcaagctggcctaaatcacatcccctctctgggtcttgacttcttcacccttatttcaacaagaacttttaagctactgtgccctacctaaggtccttctaggtctaaaattctgtgtatatgtgtaaatcatttagtttctctctcattagttgacttttctcctctttagttaaaaaaaaagaaattttaaatattttacctattggattgcatatgttttaattagactgaaaattatcaggtaacaacctcatgacagagcccaaagataaaggctgtaaggtccttctaggtctaaaattctgtgtacatgtataaatcatttagtttctttggactcagctttctcatctattaaaaggggtaacagcatccccacatacctcatagtgttagtatcagaaaacacaagcacctcgtaaagggcaagactacagaaatataaagtaatttgctgtacattacttatttttagctctcgattgttcagcagtttttctggtatgaccagctgatagtcaaagaataataaacaaatgatcagttttcaagtataattatttcatattttatagtcaacttatgggctctctcactagttgatttttctcctctttggttcaaaagaaattttaaatactttacatattagattgcatatgttttaattagactgaaaattactaggtaagaacctcacgacggggcccaaagatagggagaaaatgatacccagttcttgtcctgaggaggctcacagtcaggtggggatgtcagagacatgtgaaccagagcaactccatcttgaataagggctgggtaaaatgaggctgagacctactgggctgcattcccagatgcttaggcattctaagtcataacataagacaggaggtcggcacaagataccggtcatgaagaccttgctgatgaaacaggtcacagtaaagaagccggtcaaaacccaccaaaaccaagaaggcaacaggaatgacctctggtcatcctcactgctacactcccaccagccccatgacagtttacaaatgccatggcaacatcaggaagttaccctatatggtctaaaaaggggaggaatgaataatccaccccttgtttagcatataatcaagaaataaccgtaaaaatgggccaccagcagcccttggagctactctgtctatggagtagccattcttttacttctttactttctcaataaacttgctttcactttactctatggactcgccctgaattgtttcttgcgcaagatacaagaaccctctcttggggtctggatggggacccctttcccataacagggagagacacaaggagtgagagtccataagaatagtgtgaggtactctgcagtcatgaaggattagggtgctaggggagcagagaagaggggcatgccatcggtgcacaaggaggtgtcactgacatgaatctgaaagggcgggtaggagttgccttagacaagttggtaagaagagaaatttgtggcaaccccagagaaggagggtacatgtagaaaggaagggtaaagagatgcaatgggaaaaaaaattatatatatacatgaaaaatatatatccatgtaccagctagcatcatggcatcatttacttacataaaggaccattaaggtaagaagagttctatgacccattggtggtgtgtgtgcacttaatgttttaaacatgtctgaaaattcatcccaagatgaaatgttcaatacatataataaaatattctagatcttaagactaggatttatgtgttccactctgctagaaacagaattttccaaactatatccatgtaggagttttgttttgtcttttaactgaaaaaaaaaagggagacaattggcacatctaaacagcagctgtgagtggagatgctttctttgtgacttgttatttgctttgttggcaacctctatgagaagggacttccttccgaggaggatggaatccccccagctaacttcccggtttaccatttcaacctaacttgattactacatagaccactcccagttcctcttatttaagcacttgaagcacaactctctgattacatacctcccacacttgtcctttttatggaaatctgctccgctgctctgcaagagttttatacattccacattactagaaagacagggaaaacatcattaagatggaagagatcaattactggcctatcttcagcaagagctattttctgcagagtacaggaccagatgaaaagatagctcctggtctaaattccgctaataaaaacctgaacatactagagtaatgacatattgtaaggatctaaagttcctatgattcctttttcaaagctaataaatcaatagattaaagagcttggtggaatatttttaattccatgactaagaaatttaatgattattacatgattaaaccctccagtgatggtttcatcatttatcctaaaattctttttccaaaaccgtcaagagtttatgaaacaaccacttaaacctataataatttcatgtcacctttaaacaatgagccagagtggatgggcgttaccttctatcacagcagaatgaattcaccatgataaccactttcaacccagatactccttaatagaaaataaaacaactgtatttccctgtctttgtaatttatgcaaataaatgtgcagaaccaaggctgaaaatgatgtcatggagcacagtgatcttccatagcttctttatcatttgcagaagcaataaatcatatttagtagagagaaaaggacccatcaaagtgatttttcctattaaagggcatgtagctaaatagtaattctaataggaatttcagacatgaatctggaattgtatgttgtcactttctgtacaggtctgatattttttaaatgtgagcatacaaaagagacaattgtccatcattgttctaaacttaggatgctagaagtggcctggaattattactataacttaaataagaaaaatgatctcaatgataaacctgagcagggctctcctcaccccacacccaccctttatagccaccttctcagagaaatagctctttcaatcataacatgtaagaactttttaaaataagtatgtgttggtgtagcatgccagctgatataaagcacctgtctcttactgaatgatgccaaaggatcaagggtagtggcagatccaacttgtgtggctcatgaagctcatacaatttgggggctgaggtagggggaaggggtcttttttaaaaataatacaaaattatgaatacaaatttagttataagaattcagaagggactcatgtaaataaggagccctaaagtgtcaccatttatccacctctgataaataggtaatgcctttggtaatatacaaatgacaaatggagaagcattactgttccttaaggaccaggaaactgattaagaaccaacatcttccccaaacaaggtcatccaagagatgccatgtttagtcaatgtgtggtcacatatatcaatgacattgatcagagcttcaatcttaccactggtaagtgaaaagaaagtagctgatgaaaaattctctttacaactttaaaaaaaggtaaggattaaatcacttcttgcctgtcttttgggttttcttgacctatgttcacatttaatcattaaaagactaaaaattagatttgaaacaaggacaaaaatgtctgtaaatgaacataaattaattcaatctttgattctcttgattatcacccacataacagcaacaaaagaggaaaaacctaggaacaaatttcaaattattgtcttttggtgtatggggtaactgatatgtattctatagcctgaaaatctataatttaaaaaaagaaaagagaaagaagaaaacaaaagaagaactatttgctatttgaaatgggctaataatttttctttggtgaaacaaaatgcttgtgatgtggaaatataacatagtgatatttgataattagtagaaatgattcttattttactaaggaaattgcctttgattcacagacaacttaagtcaagtcaataaagatgaattagtaactcataaattaactagaattggtaactactcaccctcctgcagcagcagcatgaaggcacgttcttccaaatttatctggggtgtctatttcaaagcctgcagacagcacgtgctcattactaaacaaggatactatgctatacttttgtcctagttaaaccacaagaaacattgcagagacagaaaaatcagttagtagaaaaaccagaatgcaagcaattgtagtcagaaagaggttgtcatggaaacgaatgggaactgctcaagcttggcaattttataggaagaaccgtgaagtcaagaaggatttattttcacattcagccctgggtgaaccacagtcccattttttaatcccaggatagaaatttatgaaaccaatttgagataagtagggcaatcgacaggcagatagaactcatggacaaaacatagaagcaaaggaataatcttagcatgctggaacagatttttttctgaagtgtatttcaacctttcagttggtttaagagttgggaaacatgcttgcatgcagggattattttttaaacatgccaacagcagtgaaagcagaatcagccataggtaaagtacttaaaggaaaaaaaaatgcctctgggatatctcatgaattaattcataaacaatctttgccttgcagacctctaccatttttgaaagcccaggaatttcttaatatatgacagttggcagaggtagtgataagaaagattagcaaagctccaaaccagaaacaatctcttggctccaaatagtctcatattttaaaaattgaaattaaacctagttggaggaaatcagccatagtgatttttcagtgcccagggagtgggaaagtaacatgacattctctaccaccagatgtagggtatttggcctttttcctttgttgaaaaatattaaatgctaaaccatcattttaaacctcaaagacttttccttcttctgtgatgtaacctttctgtaaactctggccatccctgccatgtttcaccctggaacacccaagcttttacttgaaaaacaggcaagactctcattctggggcaggaataatgacattcaaacagctttaacaccaaggattgttgggagctgtcacatgcagttagctgagaaatacaactcatcctgacgagtcaggtaatgacatgaagcacaggcagccactcactctgaccagacacctgaagccattgactcatgtacaggacacattaagcctcatctctgctaacagatttacttacccgatgataacaactttctgcagcagtcagagtgagcatttagggcagctaaatgtaaagggaacatgctatggattccacacctgaggagtaagaaaacagagcaactcacggcaacagatctcaagatacatgcggaaggacaattacctttctagattctctgatgaaaattaacaacaccttgtgtagggagtcttggctgaaataatttggtaattcttccattcaataaataattatgcaatcagtttctaccttaaaataataaatgcctgaatcaaaaccataattaaaagcccattaccataggaatgtatatttttaagaaaatctgtttcacataaagcatgactccttaaatgtaaaattaatttccctgtcattttctttcagcttggtgattgtatgtctcattctctcattcatctattcaacactttctaagcatcatagactatgctaagggctggatataacaatactgagcaagacaaactcaagtttgaaaagcaacctgtttcctttcttttttttcttttcacttttttttttttttttgagacagagtctcacctgtcacccaggctggagtgcagtggtgctgatacaatgatagaggcagggggcagagaaattctaggcagaaaagggcaggttctgagcaaaaccccactctcaagctgaaaagcctgaaactgtgccccaaagtgagaacttatatccctgttttcccactcaaatgttgccttttcctaaactacccatggccctcccccaccaaatcctgtgcctataaaaatcccagactcagctagtagacaggactatggctgaacgtcagagagaagcagcttgatttgagagagacagtttgatggcataacttcagaggagaatctggccagagacagctggacttcaggggaagattatctacccatcccatccccttttcagctccccttcctgctgagagccactttcattggcaataaaatcccctgtgtttaccatccttcaatttgttcatgagacctcatttttcctggatgccaagcaagagctcaggaaccacaagtgcagatataaaaggctgtcacgctggccctttgccctcgctggcggagggcagctgccttatgcaaaaaggcaaagggcccactgagctgttaacatttaagccaaccgtggacggcagacatcaaagcgcactgtaacatgccctcagggggctttgggagttgcaggcacccccgcctggatgctgctgcagagcctgcacagagttcactcctgcccgtgccaaagcagccagctggttccagcactcactcaccccagttcccatgctcatttgctcaggcgttccttccagcaaggagttgagagtggcaggctgagtaaacaaggtacccctgtctcaagtcccacaaaggggtcagggaaatatcctgcttcagtgtaatcacagtacactgcagctttgacctccttgggctcaggtgatcctcccacttcagcctcctgagtagctcggaccaccacaggcgcacatcactatacccagctaattttttggtgtattttgtagagacagggttttgccatgttgtccaggctggtctcaaactcctgggctcaagcaatccacctaccttggcctcccaaagtgctatgattacaagcatgagccaccacgctcagtccttgttttatttcttgatttgataaacaaatattattgtggtattatgtcccaagcactttgctaggagttaataatggctatattgttgaaaataaagttttggataagaataaaaactaatgtttgccttttgctgatcaaacttcatcttcctaatagatttttacattgcacattaacccacatcacaataccagtcacaaaaacacaattggaggtaataaacattactttgcatatatttcataaatctagtagtatttaagagaaaatctagaaaaggactttatagaccgacccccactaagacacagtcaccaggatgaccccttaagggacagacgtcttctgtcggcagcactttttgccttcgggattaaatgctcctcctcttccctactacatcttcttcagcaaggacccaaagccatgtgctgaattgtggctcataataaacagcatcaccaggtggctcctgtgtacttgtaagcatctataatgttagtgaccacttctcataacatcttattttaatcaaataatacatttcagccttttaaaatcttctgcataatacaagcaagtatgggactatatctgtttacaccctacagcattaattacctaagtctcctctctggcacaaagtggcccgttttcagactccatgcttcataaagaaacacatatgatttgaatttgttaagctttgggtacatacattttatttaccatctcaaaagttattatgatgatgtgtgtgtgactgtgaaaaaggatatacacattcacagacatttcatggtattcagggttttgcaaaattcaattctgacagcaattaaccactgttttctctttccataatagcttcttcctatttaacggtggttttattcggtcttccctctgtttgttttcctttccctatatggagattccagcccagtgtgtataacagctggcatccatcaagtgatgcaatttgctcatcttccaggcagcatcatgtggaggagaactgcttgtaattgcctcgctcatcatttaccaaaaaaaaattctgaaatgcaattgcatcagtgatgaccttgatgctcttgaacgggcagagggagttgggggataggagagaagcttttctgcttatgctattatttatattgttccctcttgattcaagagaaacattcttttttttcaatgcataacatgttttaaaacctccttataaaatggcacttaaagctaatgtgattttacctaatcattttatttgttttgggaatttaaggcaaaactatgtgattaaatatatctggacatttagaagaggaaaatggatagaatattttcattcctgaaagaatatgcctggaatcaaggactggatttctcaagatttctttgagcctccctcattctttaaatacatacaaacacacacacacacacacacacacatatgttcatatacacgcataaataaaaatatatatacacataatatatatacaatatagtttataaagttccatatgtatctttatgtaaaataatacaagcaaatgaatttgaggaaatagcatcaaactctataagaaaccaattgggaaaaacaaaaagtataagtggtagtataacagcaacaatatgatatattccataaacctcattatcaatatttccaatcaatcttgccacttaaaacccatctttgtataattcatcaaactctacattcgctgattttttttcactgctccttacaaacctgagaagatgaaagagatagaactactctgatttaaaaggtctagtaaaatttgtttgatatatattttttactccacagtgaataaaaagttactacttcagtgcaggatttgaaaacagattcgcatagactcaaatactattggcatttgcgcttgcatatgaaactatggttcaaatagtaaaactaagtttcaagtcaagattggaaataaaagaaaagcagaattcagtgtctctgaatcaattcaggaatgatttatgtatttcaaaataaaattactaccttattttataaaataagactgctcacaaaggaaggattataaaacctttagcaggaaaattaggacttggctgtcttagccaattaagaagcatcactcttacttcatcaggtatacatcaaggaagatcaataatgaaggtgccaaatcacactaaacttaacaatgcataagttacaggaaagaggagaccaatttcgttaaattgccacatttatttgaccagtcattgaattaatggaacacatttatattagctagttctaatttagctgttagttggcatctcctacccagttatttcagaataaatgaggtctgcaggcctgtcttgcagagagctattagaaatgaagaaagagccttcacacgattagaatttggggtctttgaagctttccccttggcatcagagagatgtggctgccctccctacatccagtcttttctgagccttctctttaggccatgtgggtaaagaatacatgattaaagtgacagagtcagaaacttggggtttaagtcctcattttgccacttgctatctacttcacctttggcaagtgcataacggttccctcctcaggaaaataagacaattacagtgactctatcatggagcaactgtaaggacccattgagataatgttcatgtagtgctaaaatggagcatcacgcacatggaaatcctttaccatacatgttagtatgattgttgcccttgcaattcatataaggttaattggtaatcagcagtacatgagttttgaagttgtaatcaggttgtacttccttaaaatcagttgtatgattccttaaaagccaagaatgaatcatgatcggttaacatttctgttatctttctgtgtgtctaaattctttataatatttacctcacaagtgtcccagcaaagtgggattggtttagctttgctcactgagaggatgagacaaaaacatttcttaaatttagaataggatgattttatgatgttttacccaaatgatcaatccaagtaaacaaaccaatttcttatgaattttatctatgcaattccaagtatttattatgcacccttaagtgacagccatgagacctggtccttgttatttgcaacgaacagatgttttcagtggttccttttgaatcaagtttaaacacgctaaagtggttcaagaggccccttctcgatctggctgttgtctaatctgaatattctagaatctcaataaacttgtttccattcctctaagtgccaggctctgtcctgcccccaggcctttgcacataccagtccctccacctgaaactctcttatctttctctcctgtttctcccattatttctccaactaatcagtgcatctccgaagtactggaaatatctttgggatctcaagagttctctgtgagaatttttaacctgtcttttcctttctatgataatctaaaacaactggcataaaagcattttttttgactcatcggagtggccctttatcaccacatacctctgcctaatttcagtgtccatgtttgtactgaggatcacattggtgtttgtgtagtactggcatgggccagtgagaaaagaataaagatgggctcaatggacaagtgataaggctgaacctagggagggccaatgataatccagtacctgagccttccatataaacaaaatttggcagtagcttgaagaaggggctctgtgctgcatgccaagtccactgttccaccactttaagccactgcaaaacctccattcttgcagtgtatattgaactctaaagagcctgcacctcagccaccaggaccataatcctacacaaatggtgacttcactttggcaaaatgtgaaccatcacatcatctgctatgtagaggcagcaagccacttgctcaggagctgagggtccagatccagtagactgaagatgagtcccatttctatcccttactggctttgtgactttgagcaggtaactgaacctctccgtgcctcacttacttcacctgcaagatgggaataatcatagcacttacctcatgaggttatggtgaaagttaaatgtaacccctcagagcagtgcccagagggaagcactcataatgtttgctactactaaattgtgcagttaacatgaatggtgttggtttctgtttgcatgtattttgtaattttttaaaatattaatttgctagcgtcaaaagcctaaggagttcatctagtttatgtttatacatattcatgtatcattatgataaaaataagtatatactgaggatctaaaagactcttgctaccatgagctaactgctagtcatccttcagtcttggttaaacctttacatcttgcttctctagtcttgtgagactgggttccacatcttagatatttttcacacatcccagtggcacccagcaatcgctctggcatcacacttagcatgcatgattgtattgcttgtttaaatcttgctcccaggggatcataaattcctcaagggcagggacctctataatcccagaacctggcatcataggtaccacttaggccctcaaccaatatttaatgaatgaatgaatgtcagagccagttattcataaactataatacccctaattctgctgttgaggcagaaaaagaatgcataattggtaaggaaataggcaaattaaaatcctcgagacaatccgcaaactaacaaaattaaagaagataaaccaaagggctttgacatcacgtaaagttgcatgagcactgaatcaaaccgtaggaagctgctctgacttaaagttcagagaagcaaaaagaataacaaagaacattctaatcaagggctgacatttatttcagattcaaataaattcgtaagaaagtaataatgataaaacttgtcatatagagttaatttaaatacatttggctatattgcttatgaatgaaaatgggttcttttcacaaatgctatttgttttttcacttatctatgaaaggcctatttttctcctctttaataatcctataaggaacccagataacagtgattttctgagaggcttttggcaaatttaatcttctccaattactcttcccttcactttgatattttgccctagggtcgtttccattctcccacacacacaaacacacaaaggcacttacacacacacatacaatcactgccctaaggaaccattgtcactgaaggtagcatgtcgcatccccagatagttgtgacaaagaaagcagacatggctctttcaggctgagacaatgtttccctcatctgtgtccctaagacatagcagagacaatggaagaaaatgctacttgaacaacaatgctatttttaaggcacttttgctacatggtctgtgtttccataaattgaaagcaaaataattacatggaaataaatttccatcatattgaattaaatggtttttagggaaaaattttaagtaaccattgggtccagcttatttttattcctaaaatggattcaagtctggaagaaaatcagaaattcatgattgtttggctaaaatttcccaagtaacccaaagctgaaaaaaaataccactgaaaatattaacacattacaggtaaagtcagttggtgcctaaatatttatttttctgcttaattaacactgagcatttattatctctatctttgggcatctacgatctggttcagaactccagaacctggtaagagcgtactgaatcttagtgtagagctctttccacaaaactgagaggcttattttaacttacgacatcccaattaaaaagttcttttggctcacagcagattcccctctcttctgtaaaaagacatcccactgctaatactatttgtcagcattctcctcttctgtcatccctcagcctcatctttagcccaagacctcatcttttcttccctggacatttgcaagaggctgccaagtgtttgtagcctggactgcctccagtacgtctggaccgcctgcagtatgtctggactgctatcagagcgaactttcttacacacaaatgggatcattagacacaacctgttctacgcccacttagaattctttaacagcttccgaatgactcagagtggaatgtaattctttagcaggacttgcgaagccctttgagatgtggctcttccagcctttcctcctcatttctttccactccacccaccaaacatccaatgacccagctttagaaatgtgcttttaacaggttcacatgtttatgtctttataacgactgttccctcttcttgggatatccttcctttctcccatttctctttctaccccataattatgtccatctagcaaactcctatatatccttccttttgttacaatgtcatcttttctgggggatccagaaaattagtatctctctcactctgttcccacagcctggtccaaacatccatcttaacaaatttcacaatactcagtaatttgtgcttgttcttatctctaccactagactgggaggtgtttggaacccagttcaacttaagatgttggacagatgaagataaaccattatatcctaccaatctaccagagtgcttcacaaaattcattttaagtccagaacacctgccctctgtgaatctgatttcatgatcccactgcgtcttccccaggccatttcaattttagctcattctcatacaagactttcaatgatgttgcagaaaattaacaaataaaattcctaagatacactgctttcataaggtttttcttctaaaaatttagttattgttacagactctgatcaaggctaaactctttattcaggcattgaaggccctctttaatttagttctactacctattattaaataataaaataatagttaacatatattgatagctcactacgtgccaggcactgttcaaagagcttttaacatgcgttatctttttaataaccttaggaggtgtatttatagaactcatatagatcttaccagataccaaagagctttactagtaattaagtcacttaatcctcataacaaacctacagataagtactagtattactagtattactacaatatttccaattaggcaaggggctcaaagtcacatagctcacaagggaagcagcttggattggcatcaagggagcacccaccaaagcctgggctcccaaccaccctgggtcctgcccctcggtggtgcacagcatcatcacattctctactctgtcaggccaagctcttccctggtgtggagtctttgcctcttttgttcccgctttcctccctgcttgggatggttgccaccctctgctgtactcagataattctcagcccctaaagcctagctaaaattcatcttctccttgaagccttttcagaaaacactggccacctttgagctctctcctccctgtctatattctgtgacacagattgtctacaccaaacatttgccacttaagtctgtttcatttagaactttatgatatatgatcttgcatggttctttgacttaagtgggtcttgggccctgaacaaaattatgagcgccttgaaactaggtaacttacatcttctgaaatctcccatagcacccagcatagatgctttatgtatttttgtggaattgaagttcaaaatgaagtcaggttcccccttccctacatagcagattgactcaattgtactctataaccatatcattaaagctgagcaagcaatctgaatacattctaaattggctcagttaggttttatttttcctgtttaatatgaagcattgggaaggacagaagaatattagaaagaaaagttacgaataaagttcaagtttccttaattaaaaccactgaaatagacctcatttggatgaagctaaaaaataaaattggttcttctttgcctctgtcattaaaaggcacttaatttatttaaaatttaatttgtatttagtataatggtatagatccaccttaacctggataaatgggaactatctactgcacggaagaatctttttggcagtattcccacttgaggcaattattccaccgtatttttgcggtaacctacttggctgtgtcagctccgctggttattaaggtgttaatcaaaagctcatgaccgtatcttgcagccacatggagaggagtgttgccgtccttatccacacagtcaatttcacctcctgaaagagatattttaatacaggataacgcaaggattcaggttgattcaggtcctatgttctctgctagtctctcgtatcaaccaaatgttgatttctttcctattccagttgtgcatctttgctccgaaatacaagaatgcttttaaaggggacaagtcaccatctgaagcagtagtagtagtatatctgcgtagacagaagtctattagagatgcttttgaggccgggcgtggtggctaacgcctgtaatcccagcactttgggaggctgaggcgggcagatcacgaggtcaggagtttcagaccagcctgaccaacatggtgaaacctcatctctaccaaaaataaaaaaattagctgggtgtggtggtgcatgcctgtaatcccagctactcaggaggctgaggcaggagaatcgcttggacctgggaggcagagattgcagtgagccaagatcgcaccactgcactccagcctgggcgacagagcgagactccgtctcaaaaaaaaagaaaaagaaaaagaaaaagaaaaatgcttttgagaaatctttccatattgtcttagttaagaatccaaaatctcacaactaaatgcctgctctgaatgaagaatgtattcaaatcccataaagtgtaattctgaagacatgttcaattttaattttccctgctgaattaaaaacctatgtaaaccttgtgctaaaacataagaaccaaaggggatggacagttcaggaaatgatttcatgtaatttgatgatctagcttatagtattttaatattatgactaaaatgagtaaaagcatagacaataaactgaaaatgcctatatttataaaaactatgacaataatcatccatacttcttttaataatatagtattgtcattatgttttattttgccttctcttcccccagtttttatttcactaaatttctttttttctctccctttttcgtgtgtgtgtatatatacaattggtctattcattcatttatctgaggaaccatttaaaaagttagctatcataacattttaccgctaagtatgtttttcctaagaacaaagacattttcgcacataaccacaattccatcattttacccaagaaatttaacattcataaaataattttatgtaatattagtgcatattccaatttctcagactgtccccaaactgtgctttataatagttatcttgttgttttaatccaggatccaatcaaatatcctgatagcacttggttgtcatgtctctttagtttctgttaatccaaaacaatcctcctggctttttttttttaagtttctcatgtcgttgatattattggagcccaaatcacgagttgtgttggacgctctacattctggagttgtcttttggtttcttcattattagattcaggctaaacattttggcaacaattcccagagcagatgcgtgcttcccgctccattttcttagcgcacacagttattccattaccaggtgatgcaaagtttgactacttgcaatgggtaccaactttcagtttgggaaaagaaacagccctgaaaatggatggcagtgatggttgtacaacagtaggaatgcactggatgccactgaactgtacacttaaaaatggctaaaacggtaaattttatgttatgtatattttaccacaataaaaaaaaaggcttgattatgtggttaaggtggtgtctgtcagtacacttactgcaaaaatatcttctcctctttgtaattaacaggcaatctgtgcggtgatacaggcaatcagagtgtacagatatctgatttcccaacagactttttccacaataatttttagcatatgtggggagtactttgttcaaaatttacctgaattttttactgtgtgcttatattatctatataagttaggttcatttgattctgtttgctttcaaatatttttactgggttttattttattttaataatatgtaaaatacatgtttcaaaagtcaaaagtcatatttttgaaaaggcttactcattcttatcccttcctcttcatcctcatacacaacctacagcaagcattttcattagttttagtttatgcttctgtgtttcgctttgcaaaaaaaaacaaaaaacaaaaacaaaaacaaaaaaaaatccccctacttaacagtatttcctagaactcacttctaaagatgacttcttggagatcttcctgatttttgtacagttttattgttttccattgcacagttgtactagtttagtacactcgtctcctatgggtaagcatttaggttgtaaataacattttgctattatctggaatgccacagtgaataatctcatatgtatgttgcttcatatttgttagatgtatcttcaaggtaaattttcagaagggagatatctaggtcaaagggaaaattaatatgtggttttgtcagattttgccagatttctctctgtaggcacggtgcaattttacactctaaccagcacagtatgagaggcacttttccttatagccttgtcaagcttttgaatatctgctatctgatgggtgagagctggtatctctctgcagctttcatttgcatttctcttattatgagggaagttgaacatcttttcatatgttatagaaggaccatttgtttatctttttctgtaaactatttttcatgacttttgctcatttttctaagtttgtgtgtatgtccttaaacatatacacaatactgatatctaaaccatatacacatatgtatatatgctagtataagtaatataaaaccccaagaaatagaaatatgtgaatggcttaaatgtcctcaaacatacaaacaaacttagaaaaatgagcaaaagtgattttcaataacttttaaaatgagtaagctctatttgggagattactcatttatcagcaatacatgttacaattatttttctcccaggttttgtttttaatttttgatgtttttttccctgtcaaaaaaatttggggggtggcggggcgtggtggctcatgcctgtaatcccagcactctgggaggccaaggtgggcagatcacaaggtcaggagatcaagaccatcctggcaaacacggtgaaaccccatctctaccaaaaacacaaaaaattagccggcatggtggcagacacctgtagttccagttacttgggaggctgaggcaggagaatggtgtgaacccgggaggcagagcttgcagtgagccaagattacgccactgcgctccagcctgggcgacagagtgagactccatctcaaaaaaaaaaaaaaaaaaaattgggggaggaatgtattagtcttttatcatgtttgggtttgttgttagggagtctttccctataccctggtaacaaagaaattgacacatgttttctatacgtgaaaggttttctttttcagatatagatatctgatccttttggagtttatcttggtggtgtgtttgttgactgactaaataaatgttccctgaatgcctaaaagactgaaaattcaagaaaacagcctgaacaaattcacagaggcagaaactagattagtggttgccaggggctggggacaaatggggagtgatgactaacgggtatgaggtttctttttgtactgatgtctaaaccatatacatacctatatatgctaggataagtaatataaatatgaatgacttcaatctagaaaggtgtgatacatttcttttaagtaccttatttctgattgagaaagtattttcttattgtagaaaatttagaagatgtagtaaaatagaaatacaaagaagaaaacagaagtcatctataaattcactgactatccaagatagtcagtactagtattttggaatatttcctcccagttgtatgtatgtgtgcatgcgtgtgtagaattttcccatggttgagttcccggtgtagaaaaagttttttagtcctacgttctcctttaatgttacattacaatccttcccatgtcattaatctttttcattaatataattgtaaatgactatataatatcagtatctagagaatttacttagcaagtccccaattaataggcattgagggcatacccaaatctttgctattaagaaaaacacaggaatgaacatatttacaaatagtctttacatttcagatgatttcctttagtaacttttttctttttcctgagacaaagtcttgctttgtcacccaggctggagtgcagtgacacagtctcggctcactgcaacctccccttctcagattcaaacaattctcctgcctcagcctcccaaggagctgggattacaggtgcttgccaccatgcctggctaatttttgtatttttagtacagatgtggttttgccatgttggccaggctggtctcgaactcctgacctcaagtgatctacttgtctcggcctcccaaagtgctggaattataggggtgacccaccacacccaggcagcaacatttttaaaagtaggactattggactaaaagtatggagacccttgatacacaccagcaaaaaacttttgagaaaggctctgcccattagcattcccattagcagtatacttgagcattataccaaaaagaagccattgagagtcttctcagctctggggaaagggcattatcttccaggccaggacactgtcccttgtaataagatcgtccataaggtcctcatcagatctatatgtccttcattccaatgaatcctactattggccattataactaacaactccccaacatttattttcagcaaacaacgctttttctagccaagtgtactggcaaaacgcagggctagagtataaaaatatttgctacaaagtgaaatgattaacaaaaatgtgtgcactttgtgaaggggacaattgtttcaaaaactccaattagcacacacaggattttggatgcttccctctactctcaagacttctgtgtgtagaattttgtttgaaaatcaacttgctgccagtaagtttacccatttgggggtctgcaacttaatagctgtttacgaaaagggaatccctttttaactgactgggacagagaaatgtaaatgggaacttgaatagaaatactgatctttcttcaaatctttgtttctgtgttacagtggggttcttttgttgttgttattttggggtttttttttgagatggactctcgcttttgttgcccaggctggagttcagtggtgtaatctcggctcactgcaacctctgcctcccgggttcaagtgattctcctgtctcatcctcccgagtagctgggattataagcacatgccatcatgctcagctaatttttgtatttttagtggagatgaggttttgccatgttggccaggctagtctctaatgctgacctcaagcaatccacctgcctcagcctcccaaagtgctgggattacaagcgtgagccactgtatctggctttatttttaaaatgaattgtccagataatagagtatgatcacttctgtaaagtaataattaaatatctttacatatattcttaaatacatagaaaaatccagaagtgtcaccaaactgccaataaaaattattgggatagggctgaggagacacattggtggagatcacggaatctctttcatgacttaattttagtttacggtgagcatgtactaattttataatcaggaaaaataataaagttagttattgtgatcgtctagggactcaacagacagttaactatgatctgaatttagaagtgtccaattgagatcaattcattttatgacttgatggtagctttggagacaggcagccacctcgtccccacagatacctcagagcaatccagtgtgcacgtatccatatcagagctgcccacggtggtctgcctgaaagccccagctgtcgagctgatccagggagatgtgggacagagatccccagactgcagagaagtctgccctggacaaacactccatcaatccacatccttcccagccaagagtcaccaaatcattcttaaaaagtgttagagcctccaggtttaccagtctcaaatatgccaaaaattgggtagagaaagggaagagtgaaaactatcaggaaggatggagtaggggtctgagctgataaaagttttttcttgtagttgttgctttcattttacaagtcagcttaaaactgtaaaaatatagataactggccaggcacggtgactcacgcctgtaatcccagcactttgcaaggccaaggtgggcagatcacctgaggccaggagttcaagaacagcctggccaatatggcgaaaccccatctctactaaaaatacaaaaattagccaggtgtggtggcaagctacctgagtagtcctagctacttgagaggctgaggcaggggaatttcttcaacccgggaggcagagatagcagtgagccgagatcgcaccactgcagtccagcctgggctacacagcgagatttcatcccaaaaaaagaaagataattattgtccatatgtgcttttgttatcatttaaaatatatttcaggaggccagtcgcagtggctcacgcctgtaatcccagcactttgggaggccgaggcaggcagatcacgaggtcaggagattgagaccatcctggctaacatggtgaaagcccatctctattaaaaaacacaaaaaattagctgggcgtggtggcaggcgcatgtagtcccagctactcgggaggctgaggcaggagaatggagtgaacccgggaggcaaagcttgcagtgagctgagatggtgccactgcactccagcctgggtgacagagcaagactccgtctcaaatatatatatatatatttttttttttttttcaggaaaacataacttagtggaaaaataaaagacagactctctatttgttatctgaaaacatgttttctatataaacagcacctctagataagtgcatttctatcttacaattactccacaaaccttgccattttcatttgaaaatttttaaaacttgcttggaatgcaaatgaaatctctttaccgtttgtcatttgaaggttgcaagttaaatattggagattgatcattgacaaccagtgaggaaaataaacatttgccagtttagaagtatgcagagcatgtcagaaaggataattaattagtatcctctaagcattcatctgaaattagtttttcattgcacaaacaagaatgatcagcttattaagttgccttggaaggattgtgagccaaagggtcaaaaatctcacattgactcatcctaacctacaacttgactcttccttttcaaactctatttatttttaaagcttctgtgaagaaaacatcatttttgaacttgtgtaacctgctggacggcatctgaggggggtgcctagggccaatggtgaggtcaaatgccttcagacaccagatgctgtctttggtcagttgctttccctctattgctgtgacaacacagcttcagacaacaaacaatgtgattggatagcagaggtagtctttgcttactaactaaaaaagagtggggttttttttttcattattgtcttactaaagctggatgattctggaaaaacaaagttatgaaaactagtaatcctgactggagagcagtcagagaagcagagaaaactattcaaagtccaaacaccaatgcaatttaacaaaacaaataaatacaaagaacattcctcagtagcatgtttagttgcttcagggagccaaatgctgtgcccatgtggtcctggaggacagaggggctcctgctaggtgatgtcccactctggggggactgacaccaggccctaggggcatgagcttctggagagggagtgtcccagcaacagcccaagattcttcccagaaggaagccaacaaacaggaggtaaaaaaagaacttccttttcttctccccaagggcattttaaaaaatgtcaaatggaagaattcacagttctcacatgtgttatgaatgcaaaaaaattgtcagttgagataagagaataccaaagcatccttttacagggaaaactctatttcaaatataagtgactctcagagtaaacagaattcaattttaaaaggaatttttttaaaacaccattggtttctggaggtcatgtttataagcgtggtggttgagagttcagtctctgatgtcagacttcctgtgttcagatccctattcctcaacatactggccatttatccagacacaagtgacaacctctctgcctcagcttcctcatctttgaaatggagataatcatagtacctttttctcatagggtggttgaaaggctttataagtggtgtttagccaagtgcctggcacactatgaacacttggctttatcattatcacttagctttatcattatatataataggctacatattatagccactatatccttatcaattcaggcccctggaccccacccaatccataagcaagatgccaggacaaccaagaatgagagaggttctgaaacaaagatcccctgaccacagaggataagagacagggtctcttttaggtctcccccaactcaaaagtctagcaacagcagggcacggtggctcacacctgttagcccagcattttgggaggccaaggtggacagatcatttgaggccaggagttgagaccagcctggtcaacacatggcaaaaccccatctctagtaaaaatacaaaaattagctgggcatggtggcacacctgtagtcccagctacttgggaggctgaggcacaagaatcgcttgaacccgagaggcagatgttgcagtgagctgagatcaccccatttcactccagcctgagcaacagagtgagaaagtgtcttaaaaaacaacaacaacaacaacaacaacaacaacaaaaacacaaataaacaaaaaaagtctagcaagaatatccaggcaggacatggaattcttccagcccacatggctcttgcagaggccaaagctgccagcagtcccctgggactgttgtaagcatgccagcaggacagagaggagatgcgtcatagagatgaccagcatggcctgacgcacagggatgaacctgcggggaaggcagtgcttagaaggagaaaagttgttttccctccaaccttgtctctggagcttgaagttgctctaaaagggaaccaagctgtttaagttttgtttgtttctaaaagttttgtttgtttttaaaggggggtggacattatttctgaaaaacagttgagaaatacagtggcataagagacgtgctcgaaagagactagggtcactccccccgaccccctttatttacattcagcaaaataaaacacggtggccttttcaataaaatgaatgtcaaaggcatagcacatatttcaaattagaaataatgggtattgcacggttaatttctgttttaccttccttggctcactggaaacttgttaggatttcttttccctatagcttcactggaatgcatataaatttcctttgctttgctgcagatattttgcttgctaagcataattccactggctggtcttccatccaaatgtcaaatgacttctttgttttatgtcttaagtgactaagacataactcagtgccactaataattcaagtgtatgtggtccgaaattcttatagatgagaaaaatacaggtccaaggaaactgactaatatcagaattttgagaagtagaagtatgggtcaactaaaaataggaactgccagattgacctggaatatcagcttaaaatctgaactaaacctggtttttgtcttttttaaatactctctaagatttactaatagaagtgatgctgctggccatgaccccctattagtaacatgaaccaggatgtaaaatgatactccctagtactttgacttcagtgacaacctgatggttcaagcatacctttgtcgtaagcccagaaagttactatattactgtgactttcccaggtcttctctgtcaagcctgtgaatttttttttttttaagacaaagtctcgctctgtcacccaggctagagtgcaatggcacaatcttggctcagtgcaacttcctcctcccgagttcaagcgattctcctgcctcagcctcctgagtagctgggattataggcacctgccaccactcctggctaatttttgtatttttagtaaagacagagtttcaccatgttggccaggctggtctcgaactcctgacctcaggtgatctgcccacctcggcctcccaaagtgcctgggattacagacgtgagccaccacgcccacctaagcctgtgattttatgatcctttatatcacatccttacctgcttttcctctaagtcatctcatttttcctaattttgcccaactagcttaataagttttaacttaggaaattatagtgaactctaaaatttaaaaataattcagatttgttgctggaaaatgaatgctacttacctttattagtttcagagtgagatgcacaggatcttgagcctacataaatacatcatttccaatttcaaagctcatgctctgtgcctgactccaaattgactgtgaaactgtggctttatgtttttactattaaggtggatgttgatgacatgtctgatgaacagtttttagcaaagtacatcaaagaattatgtaattgcatgcttactaaaactccaaaacagggcatcgactttcatatgcaggtgactgacagccaaattcacaacaagaaactatcgaaataatgacactactgaagcatctctcttaccattctgaatgagggtctgtgaccgtgtgaaccttccatggacagctgtcatgtgcagtggacttttgccatctttactctaaaaaaaagagagggagagaaaaacaatggaggtgctcatgagccagtgacacccatctgaaatacccctatggacactcctaataatgccctgaaaacattcatttatttatttattttttaagtatgatcaacatgaggctgcagtgagctaggattttaccactgtactccagcctgggtgacagaatgacattcttctaaataaaataaaataaaagtatgatcaacaattacaagaggcaaagataattttgaaaggaaaagataaaatgtacctgacctctcaagttattgcataacatcacatgttttaaaagcttagagaaacagttatctgaaacctttattcctctcctgtgatctactggagaaggaagtttccttcaaggtgtttttttcaacctttgtctatagtacacaaaaaagacaaatgtgttaccttgcatggtattctttaagctgaagctgaccaaatggctctgaatcactgcaactcttaaaactgacctgaggccggtcgtggtggctcacacctgtaatcccagcactttgggaggccaaggcaggtggatcgtttgagatagttcaagaacagcccggccaacatggtgaaaccccatctctaccaaaaatacaaaaattagccaggcatggtggcgcatgcctgtaatcccagctactggggatgctaaggtgggagaattgcttgaatccaggaggcggaggttgcagtgagccaagatcgtgccactgcactccagcctgggtgacagagtgagactctgtctcaaaaaaaaaaaagaaaagaaaactgatctggaaccctctactattccctccattataattccatttaaaaaaaaaatcacttttaaaataaaataaaacaaaaaagaaaaaatttaaacaaaagaataaagaaaaagaaaaaaacagaaaaaaacaaaaccataattttttattgttccaaaagagaatctcttactttacttaactcattagaagtcacaggactaaggcatgcaactgtttaggaaactgccttttgaatgaccagctgggaatgtgtgctgaattcatatatttgttactattcatgatcgaaattatgaaatttcctgacacagattaagccaaaacacagaaaatgtacaacagctatataccaatcatcattatactaaataccaagataccatatgtaactaagaaatagtaatttacagaatttcttctgaaaataggcccaaaagaaaatattactgttattttagaataaaagtatccccaatagagagaatgtattttcatccaagtattgttatcaaaaaaatctatgtaacacttatttttataagtctcagaggaaaaatttctctaagtctgagattaaaatacgaggttttaaaaatgcatgttcattttgtgatgaaatccaaatgcctgtattttaaaatgactgttttaaaaactccatcttggaaaacaaataataatttaggtaagtatttcttagagtggaccaaggactgcccacgtctgaatcacccaggattcttgttagaaatatgaattctgggccaggcgcagtggctcacgcctgtaatcccagcactttgggaggccgaggcgggaggatcaagaggtcaggagatagagcccatcttggctagcacggtgaaaccccgtctctactaaaaatacaaaaaattagccaggtgtggtggcggggcctgtagtcctagctgcttgggaggctgaggcaggagaatggcgtgaacccgggaggcggagtttgcagtgagccgaaatcgtgccactgcactccagcctgggcgacagagcgagactccgtctcaaaaaaaaaaaaaaagaaaaaaagaaaagaaaaaaaaagaaagaaagaaaaagaaatatgaattctgtaccttaaccctgaactacagaattggggtaagagggtcccatttttaacccctgctttggactgtgggctaaaataggttataaaaccaaggttttaacacaagcattttattatattctataagtctattccttagaaataaaaaaggaattacacatagtctgtgccaagaaaaaaaagttaattagaacggtaagttcatcttaattgaaaaaaaaaaacatgtatcattataattcaatattctcaggtagatgtgggaagaaaagaaataataggatcttttctccatcttctatgagtataatctgaatcagaacagactgagaaaggagagctgaagcttgataatacttttagaggaaaaactggagcaatcaagagaatgagatacaaaaccatcgctgaccatgagacatactgggaaggagagctcctaaaagttatctgattccagagctaggccttagttgtcgggactgcacacagttccaaggactgaaacacctgggaactactttggaataaggatttaaaacacccccttccaattaaaaagtgatgacacttcaaaataactaaggcgagagaaggcagaaattgtggagttggcattaacttgtccctaggtggtgctatttctttaaattttgctccagtgttttctcttaatatgaaaccataagtaattattaattaaatatatctaaagctataaatacttcagcatttagaaaatatcttcacaatattcagctaagcaattttccatgtctataaaagagcttaaaggccttaccaaggagtaaccaccaacttggtggtagctatctaagttgcaggcagagagacaaagcagaagtgatctctgaagtgtgtggtgggcaaagccaggcccatttcagggatagcaaacaccacaaccttcttttctctgagagtgcttgtgcacttgtaaagggacaagtaaatggagatgaccaaagttaggtaaaatgcaaagaacagccatatgatcagtggtgacaattgctttgcatccatctttgcagatctttgcctgggttcatctatagcctgagtccaggctatagctgatatttttttcttcacatagggaaacaggtagataaggtggggaaattgggacagaaagcattaagagtatcatggcagccattttgggacaactttgttcacatggtatgggtgtaaagggagctcattatttcaaaaagctatagaaaaccaatgaaactcaaaaggataatactttttatataattcttaaaagttagaactcagaacattaaagttgagactagggaaccctactgagtttcatgatctgagaaattgaaatttatcatgcaggggtactggctgttgctactattcctagaattgcacaaaaagataaaacattccttgcgttctcaaaagagagaatatgtgcaattcttccatctattcaaagcttttatgaaaatttttttcttaatttctagtctccctccaattttctagctacattttcccatagaatttagggctttgaaattattgttattttgataatccatttaattaagcaagaagcacttctattgagttaggcataatcaagccctaagtcataaaggaaaaatactgaggattaaaatatttacaacaaatattagtactctttcagggcagaactcagcattgcctaaggaagattaatctttgaactaaaagcagtgtttatattttcttgaccaccagtctcctcagaaatccattcactttttcttttattcctaatgccttctttcctcatcttccaatatcccatatacgttccctaaatttacagacattgttgttccccagggtcttgaaagcataatgttctctgtggcatggtacacccctggggtcacagagctcagtggccctactacagagcaataaaagctctatgggataacattaagtccaacctgcggttaggggtggggtcaaataaggtgagaaacccaataagtcttcctaattcaatgcaagagcctcctaaaatactggtgtgaaaaagccacacattgtccaatttattttgttttgttttgtatggttctaagggcaagagagatggaacgtggttggctcactcattcctctcctttcccttacttctccaacgttctaagtaccgtccctatcactgcctactcttgcccattccagtttccaccttcaacttctccaacacaacctattccataatttggtcctggtacatatagagaagggaactggtccacttcaagcagacatgtttcaactcccatctcttagagctaaatgatctaagagcctgcagacagaaaagaattgagaccatgcacaggctaaatgtcagtgaacaggaggtagacaacctggcaatggcaatttctgagtctgtctttctaagttgtatccagcacagctctatgtctagtgccttctttaacgcttactttgaatgcttgctaaaagagccttgagatgctacagaaattacaatgtagtctctaatggaaaagaaaaaatattttatactttctcatgttctacctatttacaaattataagtaaaccatcaattgattattgtatcagtaaagtatatctttattttatcacaattaaactcatatcatgaagtcaaaaaacaggaccagagtcaatcaatgtaagcaaaatgaggaactgtgaaatgcaggctgaacacacatccctcctcctcttcccatccatcttttagttgctcatgaagacatcacttttactattttgtgagaatagaggaaaacaaagtgaacatgtggataggtaatggctgcatttcaatatgctacttccctcaacttttggaaaatctaaacaaatacaaattgtcttgcaatctacaaacactttcaaaatccaaggagcaatgtggtacagagagataacaactttaattagacagctacctccagagtcagacaggatggctctatggaaatgttagatgatccgtgcatccagagtgaatctggaataactaaggaggattcaaagagatttaggaaatcggaggatacagacagaatagatgaagggagactgagaatgaaggctagatttgattcaaaatcctatttacacagagtcaatcataataaactcaaatctcagagttttaaaatggcatttcttatattctagttatgatcagcagtccacaggaaaaaaataaatattaaaattaaggaattatgcttttcagctccatttgtggaagggaagaaggggctgcaaaaaccaatgtatcacagaagctgaagtcccttatccaatctgaactgaccactggtcagttaactgggagcagtaggccggtgtgccagagagtagccttctagcctctggtatggggcacactgagagcattggtggcatgttttacagataaaatgaagtgcatcagacaactctgtgaattaattaagtggaggttggtaaagagagcgcctttattaaattccaataatttcccttcctttgaaggattcacaggatgtccttcagataccaggatggcaagacagatgtctacagttttgggaacgctggcagtttgaccacccacgtgcttcctgccccctcaacaccacgctctgcgacttcagcctcacgcaaagattccttaccaacctcagacgacagttccttggtctctttgatgcccccattcttttttgtctgctttccatcttcatgaaaacacgacactccttcctgtctcctctaactccttttatcatccctttctctggctctttctcctcctcctgttcctaagagtaaagggctgtttcactttctgtactcatgctattacatactctctccttgggcggtctcgtccctttctcctggtttcaacaatcacctttacatgaatgaagcaatctacattttttcttctgttctctaccagtctgccatgctagaacaccacatttgacactattgggcttctcagactggctataccaaaacctaaaaatcagcttgtcaaaaactaaatatattggtttaactccctaagcctactcttcctcctgacgtctttcttaatgaacatcaataataacatctatttttctagtgcttatcatgtggcagatattattctacatgatttatgtatgataaagctgtttaatattcacagcagttccatggagaagacactattgtttccctaattttacagataaactgagacacacaaagagcttgtttatgattatatagatactaaaagtcaaggctaggattggaatttaggcggtctggccccagaacggaacacttaactactctgctgcaccacctttctttgccggatttctttcttccttcctaccttccttccttcctttattatttatttatttatttttttgacagagtcttgctctgttgcccaggctggagtgcagtggtgggatctcaactcactgcaacctacgcctctcagattcaagcaattctcctgcctcagcctcctgtgtcgctgggattacaggcatgcgccaccacacccagctaatttttgtatttttagtggagactggcttttaccatgttggtcaggctggtctcgaattcctcacctcgtgatctgcctgccttggcctcccaaagtgctcggattacaggcgtgagccaccgcgcctggccaatttttgtatctttggagacagggtttcaccatattggtcagactggtcttgaactcctgacctcaggtgatccacccacctcggcctcccaaagtgctggattacaggcatgagccaccacgcctggcctctttgccacatttcaatccttacattagtcttcaactcctccagttcatgtcccaccaagtcttgctgattttctttctgcaaagcctctcccttcagtcccgttcccctgttctcttattacctcttaccaatgccagttttattgatttctagttatccactaatcagctcttctctaggtccactatacctgggttttctttttttcaaaagtgaaaatagcttttttggttttctggatataaaaataacatgctctgccaggtgcagtggctcatgcctgtaatcccagcactttgggaggctaaggcaggcagatcacttgagctcgggagttggaggccagcctgggcaacatggcaaaaccccgtctctacaaaaaaatacaaaaattagcagggcgtggtggcgtacacctgtaatcccagctactcgggaggctgaggccagaggatggcttgagcctgggaggcagaggttgcagtgagccaagatcccaccactgcactccaacctaggcagcagagccagatcctgtctcaataaaaaaataataataataaaaataattttttaaaattctcattgtatcacaatcagaagactaaagcaaatacacaaaaaagaaactaaagtctgggcgtggtggctcacacctgtaatcccagcactttgggaggctgaggtgggtggattgcttgagctcaggagttaagagaccagcctggccaacatggcaaaaacccctctctacaaaaaaatacaaaaattagctgggcatggtggcaggtgcctgtaatcccagcttctcgggaggctgaggcaggagaatcacttgaactcaggaggcagaagttgcagtgagccaagatcctgccattgcactctagcctgaatgacaagagcaacattctatctcaaaaacaaaagaaagagagaaagaaagagagagagagagagagagagagaaagaaagaaagaaagaaagaaagaaagaaagaaagaaaaacctaaatcataattttgtctctctgcagtgataattgttgctagcatattggtacatactccagagaattttctctgtttttgcatcatctacacacataaccataacattttagcattaaaaaagagatcatatttctttattgcatttcaatgttttcattgataatactaggtgttattagccattttgatatttgccgttctttaacacaaatgtacgtttttgtattagtttgtatttttctaattaccagtaatactagtttttcacaggcttaatgtattttttattctctcttgtgatctgacttttgctccatgttttctagtaatgatcactttttcttattgatttgtatgagctctttttatatcaagcatattaactatttgcttatcatgtatattgaagaaaattttccctaagttgctcttattttaatttcatgttagaggttttattgttgttgttttgttttataaatgtttaagacttttttgtagtcatatatatgattattttcctttttttttcctgcctttggtgttctgtgaccggattactgtttttaatgctcaggtctgatcatatgacccctagaatgattcgtggcctgcagagcctggagaggcccaagctccttgggctcaaaatcatccagtagatgagtcctcttccttggtcaaatcacatttcagctcatttctggctcctttctgtcatacaattaaaaataaaaaagctttttacagacaggatctcactaggttgctcaggctgatcttaaactcctgggctcaaggaatcctacacctcaggctcccaaggagctgggattacaggccgagccaccacacttggcatgttcataaaattatactctatttgatacaatcaattgctattctgaaaatttgtcacatctttcaccactattagaaattgtgaaaaaatataagattttaatagtgaatagagaaggttattaaaatagactgatgtgatattcttgaaattacaccttagaaatcatttttcaaaaccagagacagaatacactgggaccttgcttcaggatccctgtgtgctgggaagaagggaagcctgggttgaataaaaggtctcctagcacagctaaggatattctgctacaatctaaatgcattcaagtgatgtcgcccaaattatgaatgctgcgtgataagctccccttggttagctgtcacatggcaagctgacaagttacctagaggttttcctatccagaattcccacccctctttgctcatgctgttctatctggaacactctctctcaaattatctctatccctcctcaactcaactacattaatcttccaagtctcccctcaaaatcgatctccattttttattcccaagcaaaaaacaagtcaacaattgcttcttagagtttgcaatgctttatgactcttctcatcatatcttctcttgctcatgattacctgagtgcatgctacctccctactacactgtaagttccttaaaggcagagactgaatctcatcttagagcactctttcagtaccaaacagagggcactgggtagtccttagtaaatttgctgaataaaggaatgattgtgatgaccagctcagtgctacatcactgaagccactatctggggtttgctttaagaaggtattggctgggcacagtggctcacacctgtaatcccagcactttgggaggctgaggcaggtggatcacttgaggccaagagtttgagaccagcctggccaacatggtgaaacaccatctctactaataatacaaaaaattagctgggcatggtggtgcatgtctgtaatcccagctactggggaggctgaggcaggagaatcgcttgaacctgggaggcagaggttgcagtaagctgagatcacgccattgcattccagcctgggtgacaagagcaaaactccatctcaaaaaaaaaaagaaagaaaagaaagaaggtatctgagaagctctaaacccacactggagttggaaacaggcctacaatcattattaggccttcctttgaattcttagcaacactgccctatcagctcaacattcacctcagtattagcttctgggcaagtcaatatcctagagatccagtatttgtcctgacacattcactaagctaacaagaacacacggctggagccttggtacctttcagctgataccaccactcctgaagaaaaataacacaacttttttttttttgtttttgagacggagtcttgctctgttgcccaggttagagtgcagttgcacaatctcagctcactgcaacctctgtctcccgggtttaagcaattctctgcctcagcctcccgagtagctgagattgcaggcacccgccaccacgcctggctaatttttgcatttttagtagagatggtgtttcaccatcttcgtcaggctggtcttgaactcctaacctcatgatctacctgcctcagcctccagacaacttttcttatagcctccaaatccaggacaaggctgtgaggttccaactcactaaaacatggcataatttgcagcagttgattttgctcaaacagaagctcaatgcaaaggcattcaacacagagactaagagtgtcatacctgaatgttaacatctgccccgttgtttactaacaattcaagacacaaagcaccatgagtggaggcagcagcaaaatgcaaaggggtgaacccattattgtttggctggttcacgttagcaccgtagtcaatcaactcgttaaccacagcatcctgtccattgtagcaggcgatgtgaagcgctgtatttccatagacattgatttcatcaatctgcaaaagagtccaacacagggtgattaaagtcattagagccagtttactccattttccacaaaaagcataacggctgtggctagagaaaggaaatagccatccgccaatataattgttcagagcttactcttgccccagtgtggtcatcttgggaatgcttgtcaccccatggtaaagatcagcaaaaagtcaatgtggcaaaaaatgaactggagacagagaagtttcatcctggggagaggtatttttcagctaacaaaggaataaaaggtgaagggcaaagctgctttcaaaacaccaaaagagaagtaaatcagaggagaatgaaaagagtcccacactctaggattggggcacagaaaacctcaagaaatggtgggggatggcagaggaagtggctgcggagatggcaggggaggtggctgtggagtctaaacatggaaggcgggtcagaatccactctctgttttgctctggagtccgacacctcaccaggttgcattttagtagcagagcagtggtgccgtcaggaggtgtgtttcgtccacggctccctattgctttctgagacctgccctggatgcctggtttcctcattatggttttccataatgatgcaacttggttttcctttcttgggggacaggatgttccagcctcaccactgctcctgttctaccagcagaaagagaaggcagcagtctgccttttccagctcaagagtagacattgctgctgtttgtctctgccatttattcattcatttctgctgtaagtcatgacttagaaggctacatttggaaggtgggatgcagaaccttggccagtctttaagaacaactggttaatatatattacatagaatctttatgtctatatatttatctatgttgatatagaaagttattcagtttccagttttcctctgcttagtgtatgcccccactgcccttcatcagttgcccacaaaaactcaaaaagacaggatgctagaaaacaattcccctgcccttgaattaaagtgcaaacaggatttaactttagaataacagaaatcttacaaatacactggccatgcattgatgcattcatcatagctcacctccacccccaggttcaggagatgcttgacaacattaatctgtccattggaggctgcagcatgcagaggggtataacccttcttatccttacaggtcacttctgcgccatggttaatgagcaatgctacaacatccaagtggcctttacaaacaaagcagcagaaaacatcgttaacctttataggacaatttgctgattcatttcacctaaattatcaactattagctttcatcgccaccagtattttgctgagttatttgtaaaaagctggttcatggcaactattcaacaaatatttattgagtacctcctatagtcaggcataatgtaaaagctgtggggagaaaaaagatgattcatatgtgagccttctcttcaaggagatctaggtgatgcttgttaccacactaatgaataatggtgaggttttgccaagatattagtagagagcctttaaaaatgttgtattaaaatgaaagcaatgcttttgaaaacaattgccattcctcactgaaaagtttaacaatgacaattcagttaggaaaaactgataaaagaaaaaaaaacaattaatgagaatgaccccagattattgtttaatcatataaaattactgctgctcaactgtatttggacccacaaaaatggcaattacatatgcctcaacttaaaagtatcctcatgaattagaggccaaacagaaaacccttctagttttagctcctgttagcatttttttctacaatattttactctgttccataattcactatatatagaataagcctgtacaacatggtgaaaccccatctctactaaaaatacaaaacttagttgggcatggtggcacatgcctgtagtcccagctgctcaggaggctgaggcatgagaatcacttgaacctgggaggcagaggctgcagtgagccgacatcacaccactgcactcctgcctgggcaacagagcgagaccttgtctcaaaaaataaataaataaataaacaaagaaacaagcatatttgacctttatttcgggactgaagattgttcaatgcttcaggatcattgctctaaatatggctgaaaattgaagggtagaagacaagtactgactccaggactttgtgtgtgtgttggggtggggggaaagtattggcttgttttattaaaatttgactcttttctctccaagactttatatagaaaaaatttttttcgattattagtgctgctatcttaagctatttgccctggttttgcctattattcctatttgtatcctgacagcacacaaaacaatgatttgatttctttagagtcatttatccaaatgctttaactgtatatacatcagcagagagcaatcgtgaaactttgcattctttgagtcctatccacactagcttagtgtgtgttcggcctacacagctgtctcccacagtcactggctccagtcctgcaggtgccacgcagtcatttcatatgcttcagccaactcaaaaatccatgtcaacttttttttttaaatgctaatgcttgtaaaagtttaagattctgtttttttaagcccaaggattcactcagacccacctttagccacataatttatttcatccctgccccaacctactctttctccctacaattaatgttaatttttaaagtgatgataaaaggcacatatgcttgttaaaaaggattcagaaaggcaaaaaggtattaaaagaaaaccaaaatcatccacaatcataaatccccaaagacaatcaattaaaattttagcatataatattttccaagtttgttattgtacagatttttcaatgaaaatgagaattatattatttatactgttttataatatgctttcatttaacatatcacagactctgtgttaataaacactcatggactcatcactgtagttactgcaaagtgtccccttgtgtggatcttccagaatttaccaaaacaatctcctgtggatgggcattcaggttgtttacaacttggtgctgatagaatcctgtctatttttctaatggcaggatgttctccaattagaaacacaaagggaatatcttagttcttcatttcccacaagtctacacttagaataaactctgtgagatctctcatttgtcagtgggatttgccaacaaaagtgaaaaggaaaaacgtagaaatgtgaactctcccaagcgggtagaaatgagggctgcaggcttcagttttgtcgtcagtggactatcaggataatcaccagcgcctctggtgccctccatctataaaatagccagaggtttgtcttttcttcctttctttttgtttctttcaaaaatatttataaatttaaaaagacgaatggaatttgtgtccttgctttccgagccagtgctctttctttttaaaacaccttattttactgccatgacaagttaaaataagcacaatctgtgcagctttccaatccagactgaagcacattcaaagaggcccaagccatgattcattcctcctcttctttgtaggataaataaatatctgacaaagcaactgcccgactggagtgcactatgcatgccagtaaaaccaaccaaatcttcattcaattgcaacccaagcttgaaaagaagtcagactggagaaaacctacatggtcaatgagagacccatggcttatttagttaaggttatctgtactttgctttccatgcatggaatccttacccatgtatgctgcccagtgcagagcacgccggtccttcttgtcaaatgcattgatatttgcccctttggccaagagtaaattgaccatctgaaagataaccaacaatgaaatcaagcatacattctgtaatggtgaggcctcctcactgcctgcagatgatctgagccaaattaacatgaaatctaaaggcaggtcagagatctggagttctgacaaagtagaaatatgatgtcagagcaggacatgtgtcatgtgtgtcagaggaaaagactgaagtgacagcctactttttcaattcattgtggctctaaagttgagaatgatatagatgctgaaggtttggtgtacaaatattttcatcacattctttaaaatctcagcaagaagatcagtttccacttgtggctgaaagtcctggagggagcgttccaattctgaatgataaaaatacccacctccacgtggccgttcagagccgcatggtgcaaggctgtgcgcccccctcggtcggagacattgacactgctcagcaggggaatgatcacttctgcacatttgacagccttgttggctgctgccacatgaagaggggtctgccagttcttgtcccttgcattgacatcagctgagtgcttaatcaaaacctgtactgcttcctacaacaaaagcagagtttgcagaggtcactgacagacgttcaatcaatacttactggtgtaagatgcttcaccaaaccctggaactatggagagaaaggctccccaaccctacaggctggctccagacaagccaggtaatatttggtaaagatcaaaagagtggcaaagataaagacagaatcactttacctttctttgtcaagccaagagccccggcacatctctaaaatcaaataaaccttctaagtatatgatgatgtccttacaatgtagaaggcactcttaggccaaatgagaacacccatgtgcaagtgtgcataccagggtaaaataaccatagacaaaaagacctcagacattcttggatcagtttataaatctttggttctctctgccaacatcttaaccctcagcatcgtgtgatcaataagtggtcaagacgggaagtaacatctctgttaccatctcaacttaaagctatgagttgtttccatcttttccatgttataatgggtcacttcttttgccattgttgagttccttcaccttcattgggcctcccacattttttcttctattggcccagtcagctccctaacctcttgatctatgactttcaaccctggctatgcaatggagtcatccatgcagctcttaaaagcacagaagccaagcatgggcaacataacaaaaccccatctctaacgaagaaaaaaaaaatcgacaaacatatatacaggtgcaaaagtaattgcattgcttttaatggcaaaaaccgcaattacttttgcaccaaccgggagtggtgttgtggacctctctaaatcctagctactcaggcggctgaagtgggagcatcacttgagctcaggagtttgacgtgatcacaatgagctgtgatcatgacactgcactccggcctgggcaacagagcaagaccctgtctcaaaaaaaaaaatacagtagtttaaaatgattatggaattaaattcacagacatatggaatattagaaatggagaaagccctaaggttcatctgagctgaccccttcatttcataggcagctttattttataggcaagatgacagaagtccagggcaatgacctgtcagcctggctgacttatgggctcttgcattttctaacaggccattttctactaggcttactcagtgagtagtctcagtcaagcatcctgacataaatagattcaacagttaattctccttagttatttacatttttaaatcctaaagttttagtctgctacactggcttaatacatataatagaaatttaatataatattttggcaaaaacaaagctttgattaaaaacagataactacctttttaaaaactgcatttctcttttaaaagttttaagcttggaagctctttaacttggttttacaagggagtaatttgatggctatttagggaattaatttttttttaattaaagaagtctgccttctcctgtatcacatattggctaaaaattaatacccaggagcttgctctggcagaaatatacaaggtaaaaaagaaactaatgtgggggaagggaagctgaacacttcctgaatcaagaaaagattatttttcttctgttaaattttttttaatcaacttttattttaagttccagggtacatgtgcagaatgtacaggttatataggtaaatgcatgtatggtggtttgctgcacagatcaacccattgcctaggtattaagtccagcatctgttagctattcttcctggtgctctccctcccttctccccactgacaggccccagtgtgtgtcgttccttctcacatgtccctctgttctcatcgttcagctcccacttgtaagtgaggacgtgcggtgtttggttttctgtttctgagttagtttgctaaggacaacagcttccagctccattcgtgttcctggaaaggacatgatattgttcctttttatggctgcatagtattccatggtgtataggtaccacattttctttatccagtctatcattgatggacatgtgggttgattctgtctttgctattgtgaatagtgctgcaatgaacataaacatgcatgtatctttctaatagaatgatttataattggattgctgggtcaaatggtatttctgcttctagatctttaagaagtcaccacactgtcttccacaatggttgaactaatttattcccaccaacagtgcaaaagctttcctttttctctgcaacctcaccagcatctcttgtttcttgacattctaataactgccattctgactggtgtgagatggtatctcattgtggttttgatttgcatttctctactgatcagtgatatcgagctttttttcatgtttgttggctgcatgaatgtcttcttttgagaactgcctgttcatgtactttgcccactttttaaaggggttttttatttcttgataaatttgtgtaagttccttgtagactctggatattagacctttgtctgatggatagactgtaaaaatattctcccattctgtaggttgcctgttcactctgatgatagtttcttttgctgtccagaagctctttagtttaattagatctcatttgtcaatttttgcttttgctgcaattgcttttggtgttttcatcatgaaatctttgcccatgcctgtgtcctgaatggcactgcctagattttattctacagtttttatagttttgagttttacatttaagtctttaatccatcaagaaaagtttctttaacagtgtttttcaaactgtctgtggtaaagaaccagttttctaaaaatagttattatttcaaatccatcacttttgagccaatacttttgtaaaatacaataaaaagtaatcagtagaataataaaatgaaataaaaatgagataaaaactataaatgtaattattttattattaaagttaatgggcatgaaattatcaaattgccctaaaagtttctgaccacctactcttttcacaacagataagataaaagctcacagtccagccccagtgctcaggcatgctgtgaatcatgctccttcaaagcctttgtttgtttctttttcttttttttttttttgagatagagtcttgctctttcgcccagcctggagtgcagtggtaccaacccggctcactgcaacctgtgcctcagttcaagcgattctcctgcctcagcctcctgagtagctgggattataggcatgcgccaccacgtccagctaatttttttgtatttttagtagagacaaggtttcaccatgttggccaggctgatcttgaactcctgacctcagtgatccgcctgcctcagcctcccaaagtgctggggttacaggcatgagccaccgcgcctggacctttgtttctttcttaatgaacgaacacctgtgaggattctggtatttcccccaaatggaggcatcagcccagttaacgttctgttttaggattgtaggccttgttggatgacaccctgtagcaggctgtcctatataagatgcagaaataatagaaaggaggagctgtcatgggatgtcatatgggaggtaactggacatgccatttgcgagtcagtcaatttctactttttacaactctttttatttaacaaaaggccacttcaaccttgaaataagaagtagaaacatacactgtggcacatggaaaagatgagaataggaggcatgtgtcttagaaactatcatccttaatatttgtttctttactctcaaatgtgcattgcatttcagtggtcataaattactcatggaaaagtaactgtttatgactacacatagtccctgcagccataagcaatgtcaagttttataaattacaagttgctttagataggggtcaaaatgttatacaactgtctgtactctccacaaagcctggcagttgctttgcacatagtgtatattcaataaatttgggtagaataaatacattgctgtaatcatcagcaaagtctgtaagtaataatctgtaagtgttaattttacattactctgggctgatgtccctgaggctgctcttaagtcctgcaggcttatgctatattactgtaatcatagcaatttcatattttgtaagaattgtataaattgatgtccaaccaatttgctcaattaatgggattgttcctctaaaagtaccaaagtaccaagcaccaaaaaaactcacccattattttaattattattacagcacaattattctaagaactaggagtgcaaaggcagttcactggagactttgggatatgaaagaattctaagcgaactatttaagaagtgctgactttaaccattaggaacggcagacactaaagtatgaccagtgtttaatctcagttctcgaagtgtggcatgtagacgacatgtatcagaatcttcttttgaaaaggcaaatttctgggcctaaccacaggcttcattcagaatcactaggggtgaggttttagaacaggaagtttcaacaaacaccccagagagtttaaatgcactaaagctgggtaccgcttgtctacattctaatagattataaaatgcttactttcttcctattccagatatgacctatattctacacatgaacaactttttataatcacgaagataatttaaagaaaacaataacattctactcttccatataatgtttccaattctcctgtctactagcattaagcccacaataatgatcatgttttttagaggaaagggtagaacataagtttttaaaatttcaactgtaaaataaaatgcttatcctgctcagctctgggaaagatctgtataccagttgggtcttctgtctgcacagaagccaaaaatagatgtgctttattggctagaacaggctccataagggtgctaatgggaattgaagaaagcagcacagaatggtggttaagcaggcagcttctctagtcacactttcctccactttctggctgtgacatcaacttcgttggctccctactaactttctgagattacatttcctaaactagtattgccaatagcatccgtctcgaagggtggatcagaggttaaaagagaataatatacagaaagtccttagcatactgcctagcagatagtaagtactttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccatgttagccaggatggtctcgatctcctgacctcgtgatccgcccgcctcggcctcccaaagtgctgggattacaggcgtgagccaccgcgcccggcgatagtaagtacttaataaacactcgtaactacaacacctacatggacacagtgtcctcactcctacactctaaagataagatacaaccatttttaacttttctaaccaaaagacagtctctagaatggagaagtgaaaagttcagcaattctcctctgatgctcctctcaactggttatagcagaaagggcacctgggacgggccagccacgtctgcacataggccacagcagcctgcatgcctggttatctccccaaatactgtatactaaaactaaaagccacactttgtacacactttaggcctcctgtagcacacttaacaatgccttctaccaagtgggcttccataaacgtgcgttagactttctgggtttgtgtacatttcgttcctttcccctacagttgctcttttccaagaaagaaaagcaaaaaaagcaagaacaagctgaacacaggaaataatatgaaataggcttcacatgaacacttcagaatattcccactggcagccccaattcttgcttatctatgttagctggcactataaaagatgtttctctaatattttagtaagagcctctcttcatttcttcacagcctagggagtacacagaaaaaaaaaggagaatgagttcagagaagcccttagggagccaaaaaggagacagtgctgttgggctccaagctgtttccaacctgggaatcccagatgtgccagatgtggggagcaggttgggggtaggaaagggtcgtggaattgtgtctagaagggaaaacacaagacagcctggtcagcatcacataagtcttcaagacttatctctagagctcagttatattttaggagattttcaagaggtgtgattatgtcttgatctactttcttgtctatggaggacataatgtcaggcatggattcatatttaatcaatattatgatctgacacccttattgcttaacatactcaggaaatgaacttagcaatgcaccttatttttccagacacagaaatctgaacataaatcttgcctggatgaaaacaaggctccaaaattttgacttagactgatatctgtgttatatgcaattgcaaaaccagccttgattttgcaggtttcagtggcttagttggcttttagtgtacacattcccataaacatgcttcaactctgttcaccctgcatgcataaaagattattaccatcaacattctgatatggtgtataccagttctatcttaccagttgtacacagaaaattattatagcttaaattgaaaacccagtctttaatgaataactcaaaaaaaaaacaattcttttctaactaggcaagatgctagaaatacaacggcaagcaataggcatggcatacatttcaaggagcttactgtctagaagatctttttaattcaaatagaacaacaatttctatggtagttttgtattgtgccaagttggctgagttgaactaaatttcccagaattcctttccctgtagtactccctttagggttggccacaagagatatctgatgagttttggaaggcataagtgaaactacagcctaactggtatgctgttgggcaccaggtagtgttgcagcttcacatgatgacactaatcggctggatcaccacgttggcaaggggcagtgcctggcttgatgcttcttcagatcctgctgcatctccttcagtttctccaattcttgggccaggtgcatgcacaactccttctgcaagtcacccatgtccatgatgttggaggcagtgttagacagacctcagttccagtttgtccttgatctcccccattttacatccagcttttccactgtagactctgctgacctacagtgacttcagggcctcacagaatccaaggtgatagcctcacacagaccacagcagccctacacacttgtgtaagatctaattcctataataaatatcttgctctgtatctctcatggtggttctgcttccctggttgaacctcaaaccctgagagatcaattatctacattttataagcaaataggctttgaggacagacagtatagagtttataaacttttcaatgaagaaatggtttcaaacacatgaacatgtaatatcagtgcttaccaatctaaagaacagacctgtgccagctctcagctgaaaccatatatccatcttgacaagtgctaacagttaaattccaaaataccagtccaaaccttctcttttcttcccctcaaatctactttcttttccccaactattagttaggagaggcataaaataatggcaataagactaaattccaaagaagaaggaaatctgaatttaggacttccacaggacagcaatgtgcttggagttaagatgtcttctccaccgtcagctctcacaatggttacagagactccaattttcttttcctttcttttcttttctttttctttctttttttttttttttttttttttgagatggagtttcactctttttgcctaggctggagtgcaatggcgtgatcttggctcaccgcaacctctgcctcccaggttcaagtgattctcctgtctcagcctcccgagtagctggggttacaggcatgcgccaccatgcccagctaattttgtatttttagcagagacggggtttctccatgttggtcaggctggtctcgaactcctgacctcatgatccacccaccttgtcctcccaaagtgctgggattacaggcatgagccactgcgcccagccgagactccaattttcataagaaactgtccaacttgctgtgacagatactaatatgaagacatcatgagctcatatgtgacccaattatttacagttcagggtttgtttgcatttaattcctatctggctagtgattcttttttcctccctgcaaacctacagagggagctggttacttggagaagcaacaaaagcctttctcagattggaaggtcagtccatcattaggctgactggattcaaacacactaaagatacttacagaatgcagactggttgttgatggaaaatggatgttttgaggattgaagtctttgaagctagttgagctaacaaagatagagatcacttgggaaaggtcacagagtaatgaaatcatcttttttgtgtctttcttttccactagactacacacttcctaagggcagagaccatcggtcttagtttttttttgtagctccatgagctacaaagaaaaggtgcctggcatatgggaggtacatattgaattattttcccaactaaaaagacctggttcttgttgaagaggaaacaaatccatacatatttttaaagagacacttaaatttactaaagaccaagtggtcttaaaaggccaggaaatactcctctatgaaggggttggtctcatgaagctggtaatacccactcagtcagctcactgccctcgttttcccagacaaaatggaaataaaatgtgggaccatgagaagattctgaattctccagggtctgagccaggcaatttaggattattgacctctctcattccatgcgggatatttggaaggagaacacaaccaaccccttttaaaacctactaaaatcacaaagcgcagcaagaaaaaccatgactactaagctgtcacctagcaagtatatattaaaatttccagatagttgccaaagaggaaaagctgacaccaataacggccaaagacacctgcaacttctgtatattaattctcagcaagaccttttgctcctaggtgtacctggagaacatcaccttctccagtagcagaggagaagctgcatttggtaaattcagctatggaggtcagtcatccagcaccaagtgcatgcaaggtttgaacctcttgtatccctggataatgggcatctcctctgaccaggcttcaaggctgacattcaccagggttccctgccacccctgccttcacattgatcttctcatcctttatacttcccctgagctacctgatgcatttaccatggtttgatgatcatcctccctgtccctgagtgctagacttgtataaataattatagataatctatcagtcatcttcacccgaatttccagcattcaacaacaaattatttcttggatgcctagactgtaccaggcttgggatacatccaggaacaaagtacagatccctgtcctcatggagctcccactccaacgacatgtttgctgaactcagcgttagcaaacaggacccaccagcctcccggcccctgctcccctgctctgtgcctcttctgttaacagcatcgccatttacctaccagcttctttcccacctcacccctactaggtactaaatcctgccaggtttacctctaatgagctctcaaatcatggactcagctttatgccctcatcccagctgcttcaggcctcttttggtctcttactggcgctcctccctgagacctctccccctcagcccattcacatgctgccaccacaaaggttctctgaaacacagatctgagcataccactcccctgctgtgaccattctccattgctcagaggattccaagccctctgccatctggcccaacctccactatcagatttaccttctactatagcctgagttccagttatacctcactgaggcccccattcactcacttccttgcctcagtcctccctccttctcctggcctgctaagtccttactcaacctttaaggaccagatcaactgacatctcttcttggaagatttcctctattcaagcaggcagttagttgctttctcccgcaagtcaatgatgatattgtaatgatatgctttctgctttgcctcctccccaggctgagaactcattgaaattcaggatcatgctgtccatgttgaactaccccagatactccccagccccactcagcactatgtctggcacacaggagatactcaaataaaagctgttcattttgggtaaccctcttacattagaggtaaaagccttctgcttaccagtaaggattcttaattcgctagcaagactttttctttttctaggcacagtaggtattagattaaatatggtaatcactcacttcacttctggaagcaacagcccggtgcagtggagtcagccacatgttgtccttggcatttacacgagctcctggaatcaaacagcacaagttagaggcataatggggtcaagggaagccctgccgacgttaaatcaaatgctgtatcttgctcccatttgcctgacataaccaccacctcttcttttctttgtattagtcatgtgctgacaagatttgatcaaggctgaggggaccagaagaaatctgctttacctaaaaatctgggactagccagatattttggtaaaaagaagtcagtttccatgaggcttttggatagataggacatcaggcctataaattgctcactactttctcaaactatggggtaggcagataggctcaagcatgagccaaaaccagctcacactcagaagagtgcccatgctcagctctatgaagccatgccatcatcatggaacagaagctccctgcaaatgaattcacaggaagcagagttcacccgccttccatgacaccctcgccattctccatgatcaccagcccaccaagtccatgtctgaacagctaagacatctgatataagcttccttttagggggttcagggttttgattagtcttctggtcagagatgggatgttttataaaagggctacgaaaggagaggaggagaaaatatgtgtatctttgtagaagcagcaagagaagtcaattctagccttaggatgatgaggaagggagctcatgaggacagagagtggagaaacaaatcaaagaaactagaaagtaaggcagagaaaaggaaacacagaggtggcgcctcaggacaagggctgagaaagtgagtcaaggggaagcaggagctgactaatctccaagaggctaaggccagctgatagctggaaaatagaaacttttttaaaaggcagtggacttccatgcgtaaacgtgaactagaggtttagtttaaggcactggctaaaagtaaataacaaatcatagagcttacactattcttttctttaactgaagaagaacaaatgccatcaacagcattaatcacagaaaacaagaacataatccctaaaacaaagacagctggaatgcctcccatccaacctccactttgatttcattggtttcagatggagtcaggtacaagggttatcatactatgctgtcaaagttgagagccactgatgaattgttgcttaatttatccaggttaaaattatttaaatcctaattccactaacaccagcttgcctgaaggagttcaagctccttacgtcagtaaggaccacagtaaaatcagtttgggtgtgcaaaaatcaataggcatctctggcctcagtaacaggaagctgtgggctaaatgctgtggcatgaaatgaatgcggttttggaaggacagtgggattcatggtcagaagatgtagatttgagttctgatttcagcacctgctggcccaatgaccaagagccactaatctgcacagcgaggctaacaacaacagtaataatacttctctacccatttcaccaggtgctaaggagaattaagtgaataggaaagtgctttgtaaattgcaaggcactagaaaaacattagcagttcttatttccaaatcacctccaatgtctcattcacctctaaatctatgactcagatttccaaaggaagtgaaaggcatgatctttgccctacaaaggaagaagtcaaataggaactttaagaacacaaagaaccatcacctagagactgtagaaatacatatctttttaagagcaagagagactcaagtgctagagaatgctagggagaagaaaatccagatgtgattaagaacagcaaaattggttaattttaaaataaaattaccactaccaaaaccaaacttcagatttcttcttctaaatattagttccaacacagtgtcaggtgatggtcacaaagtctacctttctggtttagcaacacagcatttatcccttcagatcttccaacactctggattcaaaccttttaaaattacccgcctttacgtcaggacttttcttgcatcataaataaatatatgtatgaccacattgtgtggtagatttgaccacactgtgtttctgtctagtaagccgagtgcacatgtatttcttattttggggctgtttctttggcacccatgtcacaaacatcactcagaccatatgcagtcctagagagctggaattatttttattatagtctttggcagagtaaattttgtgctttaaattttttgtaaattcaaaaaatgaatgcaagtagaaacccaaatgtcaagacacatatggaaaggtacttctcaaaattcgtcagggagaagcaaatgaaagcagcatttacataccatttcacatccatcaaataggtaaaaatgataaagtgtgacgaggccaagatttggcaagggtatggagcaacaggaaaacttaacatacagctggcaagagtgtgaattggtacaacctcctttgggaaacaatgtggcattatctagtaaaattgatgacatgcatgcccaaccacctagcaattccaccccaatcatataccctagagaaactctcacacatgtacatgaaggtgcaccgcaacatgtttatgtcaacaagaaactggaatcctaaatgtcaatcaagaggaaaatggataacgacgttgtggtatacccgtacaatggaattctacactgtcatggaaaggaacagactgaagttctgtatatataaacagatgtacttttaaaatcataacaccaaatgaacaaatcaagctgcagaattatacctatggcataataccagctgtatttctatatgttgtttatggatgcatagatataaaataaaagtttaaaatatggctaaggagtataaatactaattctggatagtgactgcgtctagggaaagaggaatgtgaaaaggaatgaagtaagagtacccatacagctgcaactgtattttcaatgttttatttccttaaaaatatatagatatagatatagatatagatatatatatagcaaatatggcaaaatattaagagttcctaaaacttagtggaaggtatatggatattcactatattattctccatagttttctgtatgtttgaaatattttctaacaaaatattttcaagaaagctagtgcatttgaagttttatgtttcttaatgaaaataatgggggaggggggactaagctgcttttgtgtgtgtgtgtgtgtgtgtgtgtgtgtgtgtgtgtgtgtgtgtgtgtgaaacggagtcttgctctgtcacccaggctggagtgcagtggtgcgatctcggctcactgcaacatctgcctccccagttcaagcgattctcccgcctcagcctcccaagtagctgggattacaggtacctgccatcatgcccacctaattttttttattttttagtagagacaaggttttgccattttggccagggtggtcttgaactcctgacctcaggtgatctacctgcctcaggtgcaagtatttgtctaggataaataatttaaaatggactttatgtgtcatagataatacacactttcagtttcaaaaggtcctgtaaagcctctaaagtgtgccggttcacaccctcagaatgtataagattgcttagtttccccacatcctcatcaacacttgatgttatcaggcattaaaatatattgtttaaattttttagagacagggtctcactctgtcactcaggctggagtgtagtggcattatagctcactgcagcctcagactcctgggctcaagcaatcctcctgcctcagcctccagagtagctaggactgccagcacatgccaccatgcccagctaatttttaaaaattttttgtagagatggggtcttgctatgtttctcacgctggtctcaaacttctgccctcaagtgatcctcctatttcagccttctaatgttctgggattacagatgtgagccaccatgcccagctagacattttaaatattgcaaatctgagtcaataatactgtattatgcacttaaacatttgttaagagggtagatctcatgttaagtgttctcaccacacacacatcccaaaaaaccccaaaataacaagaacaaagggacacgaggaaacttttggaggtgacagagatagacatctctgtctattaccttgattgtggtgataatttcatgggtgtttgtatatgtccaaactcatcaggttgtagacattaaatatatgcagcttattgtatatcaattatacttcaataaagctgctttaaaaatcaataggccgagcgcggtggctcatgcctgtaatcccagcacttttgggaggtcgaggtgggcagaacacctgaggtcaggagttcgaggccaacctggccaacatggtgaaaccccgtctccactaaagatacaaaaattagctgggcatgatggcaggcgcctgtaatcccagctactcaaaaggctgaggcaggagaatcgcttgaacctgggaggtggaggttgcagtgagccgagatcatgccactgccctccagcctgggcgacagagcaagactctatctcaaatacatacatacatacatacaaatctgattgaaaaaaagagcatctctttgttttagtttctggtctaacaataaggttagacatcttctaatatgtttgattactagccatttgtaattcattttctgagaattacttgttcatattctttacatatttctcccatttttctgttgttttttcttatttatatttacacacttttatcattattattattataccgcattctgaaaatttttagttttatgcagatccaaatttggctttcaatattaaaactctttcaaggagaaaaatgatcccacgcatgctgaacctcatacagtgacccacacccggggtgtaacgacaccagcattgttcgcgtgtagcttcagagtcccttgagaaatttcaaggtgattagaaatgtaggcaatggcttctttcagtcagtgtttaagtcctccattcctccatttctctttttcatggaggttgaataggcagctgccaggaaaacctcctctcccccataacaaaaattattataacaaaaccagagttatctgaatggagacgcaagaagcatttcatcagtgtcatctcttgctgccagcttcctcatcctcttcctctgaacactttcaagagtcttgtttacatgtcagagggagatgtcagatggttttggctatgaattgaatatttatagctgattttttctaaaggaagcttcacattatttacctgcctgtcaggcaccattgtgcactgaaggacacagtctgcatgtctaatgatttaaaggcaaatgcttttgtacccaaggacatgttaaagcttaaacatgaaaataagcactagggtatattgattcttcagaaacaaaggcccaatccatcagacatgatctgtaattacaaactaaggatgttcttcatcttatccctgttacctcttaattttattttcatagagatcaggggtgaagtgaactctgggcatcttttccagaggcaatatttctgttctgtaagccatgtcatctagaaagaagtagaataaagaaaacggaagtggtgtgataagggtggactgagtgtgactgaaaaatctcacaagccaaagagaataatttcttcccaagcttaacttatctaaagtttggcttttaattgttgaagtaaacatgaaaagtcataaaaatatgattataatataacaaaatcagcttgctattgatttttttaacaaaccaaatcatacagcacaggagcgcttcaaaacaattaccatagaagagggtatgataattccatgaacgtgacaattgctcaaaacatttaacaaactctccttggagttgcctttatggccaatttacacacccaccagaaaatggcttattactttataattgcaccacatttgtaggccaaaatcagcattgcctggtttaatcacccctctttcaccagataaaaaatatcaaattcatcctcaaaggacgaatatttgttatgcataaggaatcaaaagaatgatgtgcccccagctctggaaataatttgcattgagagtaagaagcacattttgaaaatttttgggaataattttgcaggactaccacttgttgggttgcataaattctatggccagatgtggtggctcatgcctgtaatcccagcacttcaagaggccaagatgggaggatcacttgaggccagaagttcgagaccagcctgatcaacctagcaagaccccatcttaaaaaagaaaaaaaaaaaagtaaattaaattaaaatttaaaaaataaattctaataaattttacttagtagttatgcctcacaaacactcccgcattagagagtacttccagttttcttctttcaacccagaaccctataatccttacttgtcctcagagttttctctgtaggatcttttttttttttttgagatggagtcttttttttattttttatttatttttttattttattattattatactttaagttttagggtacatgtgcacaatgtgcaggttagttacatatgtatacatgtgccatgctggtgtgcgacacccattaactcgtcatttagcattagatatatctcctaatgctatccctcccccctccccccaccccacaacagtccccagagtgtgatgttccccttcctgtgtccatgtgttctcactgttcaattcccacctatgagtcagaacatgcggtgtttggttttttgttcttgcaatagtttactgagaatgatgatttccaatttcatccatgtccctacaaaggacatgaacacgtcattttttatggctgcatagtattccatggtgtatatgtgccacattttcttaatccagtctatcattgttggacatttgggttggttccaagtctttgctattgtgaatagtggagatggagtcttactctgtcacccaggctggagtacagtggtgcgatctcagctcactgcaacctctgcctcccaggctcaagtgattctcctgcctcagcctcctgagtagctgggattacaggcacccaccaccacattcagctaatttttgtaattttagtagagatgggtttcatcatgttggccaggctggtcttgaactcctgacctcaagtgatcctcccacctcagcctcccaaagtgttgggattataggcttaagccaccacacctagcctttgtaagatatttctactgtggtcctttttctgtgcactctgctttctatatctcaaccccagtatcttaactcttagccactgattggttctcactgatctctctgacttaatccagattcgaccagttcccaaacagaagctagagtcaggagggaaataaagccagaccctggactggcagttgtaagaaagtgaaatttccaagggctgaattcttcgccaagaccttgtcttccctgtctgctcagaggcattcagggttctatccacctggctaacaggagataatgccagcaggaatttagcaagcttgggttacaccatgctctgtaggttaatacaacaatggagaacacagctataatgggctgttctggcaaggccgaattatttgtccaacatggtaatcattagcacctcattcattattaaattaggaaacagtttggttggattccctaaaggctcagctgccagacacaagctcagagataaaatcatcatgctcttgcaatattatgaacttaatatataaattgagtaaaggactttttgggaaaataaaagtcaagtgaattccaagagtttgcctcagcttccacaggtaaataaaattgctaaaaaagaaaactttcccaatgctccccatgccctaagtcttcttaatttgatgagagggaggaggaaattttccatagcacattgaaccaaaattatgctaaagagattaagagctcagaaattccaagaccaaacaagtgaatagattaaaatatatgcaacagcttctcccagctctactaaatcagccagagttgaagagaggctggtggattctatgcccttgtgaaggtgatgtgaaaccatgtttgtcaaacaatcactggccccagatacaagaaaaaaaagagactggttgacttcatgctgcagaattaaaatctcccctttcagatgtagaaacaacaacaacaacacaaagttggcatataagacaaagttctgaatttgtacattcatgaaacattcctctgagactctgagaggtctattaatacaacatttaagaggtgggtgggctgggcacggtggctcacacctgtaatcccagcactttgggaggccaaggcaggcggatcacaaggtcaggagatcgagactatcctggctaacatggtgaaaccccatctctactaaaaatacaaaaaattagccaggcgtggtggcacgcgcctgtggtcccagctactcggaaggctgaggcagaagaatcgcttgaacccaagaggcagaggttgcagtgagctgagatcacgccactgcactccagcctgggctacagagcaagactccgtctcaaaaataaataaataaataaataaaataaaatacaaaataaaaaagaggcgggtatagctgatggggaccaatagatgtcataccacaaagttctttattttatacctccactgattctgcctacaattttccacgggccaaattgcaattgccagggcaaccagccaggtgtgcattggcccttagtctgtgccaacaccaaacaatacacatttgtttggaacatggccctgggacatctttagatttgttggaagaaaggcctattctcaaaagcacaagaaatgccatgtgaaatctaacctaagctccatgtgaccatcaggagcgtggggcacacgtgttttgaggcacagaacacttgtttcctggggaaacccacctcaagaacatgaacacaacaaaataagggccgtgttgcttatgcatcacagcacaattcttgtttcttgtccacagtgttcaccacatctgcttgaatgcatgtctcagctcctacctctgcagagcttactttaagatgctacagttcccctttccttactgcaaacaaaggcgaaaacttactataggccttttgactagtctgtaggcagtggcacttcctctagatgttaatctcccaaacataaaagaggaagaagaaagacagcttgtctgtgaataatctacagtgagacatctgcacatgctcaattcattccaggatttgtctagtaaacactcaagggagaaagcatataatggttttggaaacctgtttggtgagatatactgagcatacaggtttccaaaaattaaaccactggcatttttaaatctgatgaaatatttaaaatacattgaaaaataaagacaatagcatcacaaagaccagtataaacacaaatcagatttaaatgtttgctatactcccttctaaatttttaaacataaaatattttacagagagttgtagtagttcttttatagccttccctgaagacattttttacttaacctgcctacttagaggtaaccactaaccagaaatcaatatggttccttgccttccatgtttttatgctttcatcacatagtcacagtcatgtatccataagtataacagtattgttttgcagcccaacttaaatatatataaatatacaaacacatttagttggcatataaatctagggtgtgcatatatatatggcatatatacagtgtgcatatataatagcatatatagtgtatacatgctatacatagtgtttatatagcatgtatatatagagagagagtatatagtgtatacatgctatacatagtgtttatgtagcatgtttatgtagtgtgtatatatactcactatacatagtgtgtatatatactcactatacatagtgtgtataggtgtatgttcatgtagactttaaactagttttatttccttttgtataataaaaaaatcaaaatatatccaaatgtactgaattcatctacaatgctgggcctgactagacagccaggaatcagactttcaaagcaagataaaaatgttactggagaagtcatttttcaataagaacaacttcttgcatttttctttgtgtaatgataaaatcgcctatcacataaacttccatgaacataacaaaggaattttgcttgggttcactgtagtagtcaatctagtaaattggttatttaaatttttatttgcaattgacttttgagtatagcagttatttacctgacaaaatcaggagttcaatgatctctgcatctcccagaaatgcggccacatgaagaggggttcgtttctcagaatcctgaaatacacaacgtcaaagacatacaacaggtcagtggcagctggaggtcccttttgtagacatagtaagacgtgtcactcactctgtggttaatgcatgtggaagagtgtgaacaccaaacattcgagtaacttctggttatgcattttctctcaacataccctatagttacacataacaaagcattccattttctgtgtctgtgcttggtatttgcccacttgctgcttttactgaagcccagctgaggtcatagatggatcattatgccctggatgatgaatttcaacttacagtatttccaaaccttcaggatggttaaaaaaaaaaaaaaaaaatctaacctaccatagcaatatagttcaaagctttcaatgacttattttctttctaaggaaacatagtggaatggttcacaaggacattaaacattaaacataactgtggtcattttctcctttctatgcttgttaattgttgtttggaccactgcccattcatgaaatacttactgaatgcttactctatgccagaaaccatattctggggacagagggatgactacaacaggcctggtccctgccctcatgaaactcacattcaagtgggaaggctgacaatagtatactagacaatagtatactagatacacatgagattatttcagataaaacaccgtatgggattaagtgattcaggagatgggaataagagtggtcagtgaggcctttctgagaatgttgacattaaggctgagagctaaggttgatattatctctgttttatagataagaagactgtagctcaaattttaaaatttcctcaagattccacaggtatatagcacagtcaagatctgaccttcacccagcagacttcagtctgtatctttggcaaggcattgaacagattgtgctgaaaggcagcatggtaacatgcaagggaaaaaagcgttgcttcctcatctgtaaattggcgataataaaatctaccttagaggactgataagaggactaaagatcatataagtaaataaagccctaggcaagcaggagataagtgcacagcagtgctccatacgaagcccattattgtcattggcatagagagttgtgtgatatctttcctccaaagactgaaaacttcctggagtaaagaaccggcctcactcttctttatccccatagtagcagcatacttggtgctcagcataaattggctgaactaactagtctacacgtatggtttcttccactaacttctattgactcctccatagcaatggtaaccaaagcccatctgctatgtctttaaggtttctcctaaaactagcatgtatgttagtttcaagtttcttggattcgctgttgattttaatcattattcctttcataatttgattatataatacatctaacaacccttgattagcccaaggatattattccattttctgacagtccagaccctctgctcttcctctgtctctcacagattattgcttttagacatttcatgactcactaatatctaaaacagatggcaggcaggggacacaacaagaattgatcttcaaaccagtctattttttagaaagtctggtaagtaggttttataaagaatgcactaccattaagtagacaaaaaggagtttggattcactggaaactcatgttgtctatgtatggctgcaggcaattactatggaaaagtgaaaatagggcagtcatgcaactataaaataatggcatgcattggaaaattcagtacgatatatgactacaatcaaccttgttatagatatatcaccctatctttgaaaataaagattcagtatttgaaatcatgttagcttatttgagaatcaagtgtattaatttgtgcaatgaactatataagctgagaacagattttcacaaatgttttctatttctattgataaccctagatgcattttccattttagcctcatgttccctttgaatcctcgctatatctacttaaaattttctactgggatttttggataaaagctatgtaattacatgttcttttgtgaactgaattggtttcagggtttggttcaacaaattaaaccctgcctaagtgatttaaacagggactattccaacccaaattatgacttcatttgacctgaagcaaaggcaactctatttgagatcttggcctcaaataaaaagctaagaaaactccaacatccctccctaccttgcaaatctggttggcctgtcatgatatgactggttttgctgattctgtggccccttttatggcacagcttgttcaaaccaaagtttctataacataaaaagggtgtgttgcatgaatactgtaaaaattcttgatgatgaatcccagtgttcctgttaatatgtgcttaaaggtttctggtagtttccagaataactatgcgaattgatactctcctttagtgacatggcacagacaggtaactgcagagaagacttgtattcaggcagtactcctttagttctccaaagcagcagaaccacagaaacaatcacaagtgctattaagaccttaaccaacataatagtgcatttccactattgaccaagggttgctaacgtcttctcttctaacaaggaacacctgatcatgagtcaaagcgtgaatgaccgagccacagtaatcaccatgctggatagagagaaatcagccaggaggtagcactatgtcctctgcctaggtagaaggccactctactttgccataagctaaactaatggaataggagatggaatagaaggagggcgaaggttctggagaaaagagaatagtagtaataatactggttaaaatgggttctagcccaatgacatccttagggtgtctagaagaagaaacaaatctagctggttattatgaagtgcttttatttttattttttccaaatatctgctcaactattctactactccatctcaaaacattcctatcagaggagtcacaccttttacaactgtgttcttcagtcttattatcaccatttaaaagataaagaatctgagcctaggacagtttgtatgacttaacccaacgcagcaaactgatgccaaagaattaggtgtcctggctcccaacctgaaacttttttctttataaaaatgaaagtgggctgggcacggtggctcacacctgtaatcccagcactttgggaggctgaggtgggcggatcacaagttcaggagattgagaccatcctggctaacacggtgaaaccccatttctacaaaaaaatacaaaaaattagccgggcatggtggagggcgcctgtagtcccagctacttgggaggctgaggcaggagaatggcatgaacccgggaggcggagcttgcagtgagccaagatcgcgccactgcactctagcctgggtgacagagcgagactccatctcaaaaaaaagaaaaaaaatgaaagcaagagcatcttagaagttcatgtgatagtctaaaaacccttctactatgatccctaagaaatcaggaggaaaatgtgacgaacatacggtaaacatcattttaaatgaactgagaagaaattaaatagaaaggggtcagaaatggagggtaaatagagaaccaaagccgcaggcacatgaacttagagtgcagggataggtcaatacaccaggggcttggggcttaacacttgcaggcagtgagagataaggcagagaactagaactgcgacctccaagcaaagaaagacccttgaagtggccttgaagaaagactcctgaggtgaaatagtggacttggaaaaaaacaatgacaaacactcacgtaggcagatggcaaagagatgccttgtcccgggttcttggtaggggaataaaaatgtttccactgagcattcacatccccagagtctgccctcatgtggtttagagctttgaattcacattgcctgtatagtctgggaatttacttttttttttttaatccaggaactttcaagttgaaaatatgcaaaaaaaaaaaaaaaaatgggttttagaccaatgatacccctaaggtccctagaagaagaaacaaaacctagctggatagatatgccctcaatccagtcaacctgggacacccacagattaaatctccattgaaaatgaactcacaagcctaagccataagactcacgtggaaacgttcaccataagcaagagtcagcagactgaagaaccagcaagaatttgagatcacagaagaatgagatggagaacagggatgacatttaaaataacttaagacacaaaggacaaagcataagggggaacacccccactatttttgaaaaacaaacaaaatttggaggaagagataatgaagcaagtattatggaaagcagtaccaaaacatgatgctagacagcatctaaaattttggtctaagagggatcaaactcaaagaataaaaaaagaaaggggaggagaaaggaaaaataagcacaggaactttgggctacgttttacaatcatttattcagccatattatctagacatagatatttatttagaatctattatatgccagacattgtggtacacattagggatacaaaatttaaaatatctagccctctaaccctaaagaaacttgcagtccactgatcagtttctaaatgtaggatattagaataaaaacaatagcagggaagtggcaaatagtgatatccatgatgttaaatgatttgtgaacgtatcaaatgcaataagacaaaaatatcttggtgaatacttcccccaaacccatccatatccgaactggcctgtgcagtaagtctcaactgccaagaaaaaaaaaaatctcttctgaattgggaattaaacacatcttgcccaggactccctaaaggtcctattggctccagcttatctgggaatcttggaagccctcaagggccagccttctgggtcagttagtgagcctagcctctatcttacaggctggctcaggggtagttcctggatcaaaattggaatccagtaccaggacaggaccagagcagcattaacctatagtggccgagctaagtgcattatttgcattcatttccatcttttgcccaagtggactctctgtgatgaccaatagttgaatagttacataggcttttataacacccatgaatataagtggggaaaataacccaaaagcaggtgcagcaagattaacacacactgaaatggctcatcagcatagtttttaaagattgtccaaacatcacaaaaaggaaggtcttttttcatcacccagtagctctaattccacatagtcctttgcagacagattcagatgcatgagaaatgagaagacccaggttcctccagaaggaaggatggtaaaccctcccattctacgaatagccaaagatacacacagccagcaggggtctgagctaaatttgcagtatgtctcagagagatcaggcagaggaagttgagctgtctgtttaccaaagaagaagcagataaaagaaaatagggaacttgaagtaggtacatgcaaagtgagtttgacatgggcagagaggccattctggtagctaaaaatactgtgtagacaggcagactgaggggcaccctacgcctgttttgaagattaagaattgttacatgctttggaaattctcagctagaagtacatgatctaatctgcattctaagtaactgtcatacaccaaaacaaacattccaccctgtatatgaatatcttacataccaagacagaaagatggagcaatattaagaaaacaagcctatgaaatacagaagttaagtttgggccggacgtggtggctcatgcatgcaatccctgcacttcgggaggctgaggcagatggatggcttaagcccaggaaattgagaccaggagacctcgtctctattaaaagtaatttttttaaatcagctgggcgtggtagcatgtgcctgtggtcccagatacttgggaggctgaggtgggaggattgcttgagcccagaaggtcaagaggtcaaggctgcagtgaactgtgatcacaccattgcactccactgcaccatcttgctctgggtgacagagcaagaccctgccaaaaaaaaaaaaaaaaaaaaaagaagaaacaagaagaagaggaagaagaggaagaggaagaaggaggaggaggaggagggttccaattatcaatccaaacttccaaattcccactaaaattaaagaagctgggagataactgacaacctaggcccaactaccttaatgtgatattgaacagagatcactagaggcaagaagatgtctaaagaaactctgaacacatacacacaacaggtacctcggaagtatttcaaattacatgaggacaggagccaaacgacacaaaatgggaagaatgcttggccttaaggtggggaattaaaagaaggttaaagaagaaaggaaagagaaagacagaaaacaaatgccatgcttcttttgaaatttttcatgtttactttcaatttttaacatctcataaatacacagaaatacagaaagtaatagtcccatatgtgcccaccagcaaaaacaaacatgttaacatttttctatgtctccttcagaactctagtttaaaaaaatacttttagggataaaagtgccatcttcagaaatgcaaatggttctgaaaataatttgaagtatgtgtttgcatgtgtgtgtttgtgtgtataagagagaaaggtggggaagggagagagagagagaaagtgggaaggaggaaagggattaggttgtttttaattcttcaaaccactattaaaaatggtgttgcagtgtacacctttgtacatgtctgtctgtgcatacatgtgagaatttctctgaagtagatacccaaaaaaggaagcactggattagggtacacacacacattcaattgtattaggtatccctaaataacttccaaagtattaatagttttactaatttacactcccaccagttacattttagttccttttcctaacatcctcgccaatatctgatgctatcggctttctttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgctaccacgcccggctaattttttgtatttttagtagagacggggtttcaccatgttagccaggatggtctcgatctcctgacctcgtgatccgcccgcctcggcctcccaaagtgctgggattacaggcgtgagccaccgcgcccggccactatcggctttcttactccttgccagtatgttatgcctgacatggtacattctggttttttcaactgcgaactgcctatatgtatctttacctattgttaaatttggttattagtcttttccttgtgtgtggagttttttatattgtttaattcaactttcaatgaaaattcaagttatgtattcacctagacacaacagaaatgaatcaatgttttccccaagttaccataagagaaaaatttagatttacagtccttattcatccctaatgcatgcattgtctcataaagctgaattttccttgtgtggagcctcccatgcctcaaaggtgacagcaaatctctgtcccaacatgctcccaccaccacacaattgtattcaaccatcacactctgctggtattgtaacccattcatttgaatgtaacatggatatatatttctcatatagaaaatatagatatattttctatctctaaacatgttcaaattatgttatactctcaatatgatatctaactcctgaaacgaagaatcacgcacaagaattaaaatgatgataaaataagaaaaataagaatgccaaagacatttttattttatctcccttacataactagacactggatattttattgcactaatttctaaaaatcaaataatgtatattgagcaaaacttgtatcagagagtttatattttcaaatttgatccttaaaacaatactgtgaagtaaatatgagcatccccatttcactgttgaggaacctgagattttgaggtgatgagtaacttgtccagagtcacaaagctagtaagtggtaaaaccaagattcaaaaccagatctgattccattgttcacgctcttgctggcttttggatggttacaagccttggtaaatacaatgaaagttattctccattataattagcatgcttgccctaaatactctagacccaagggcaaaaggcttgtatgtaaaaaagtacaagcaggcaagaagaataaaattggagaactaacattacctgatttcagagcttattataaagttacagtaatcaaaacaatatggtattggtgcaaagaaaactctggtgaaagaatagccttgtcaacaaatggtcctagaacaatgagatattaaactttgggccataccttgaaccctaaacaaaaattaaatcaaaatggatcacagaactaaatgtaaaacttaaaattataaaatatctaaaggaaacataggcaagatcttttcaccttgggttaagcaaagatttcttagatatgacatcagagcaaaacccataaaaggataaattggtaaatggaattttatcaaaatgaataatgtccactctttgaaacacactggtaagagaatgaagataagccacagactgggggaacatatttgtaaagcatatattggataaaggacttctatctagaacctacaaaacaactctcaataactatgaaagcaaacaatccaattaaaaagtaggcaaaagatttgaacagatatttcaccaaagatatacagatagcaaataagcatataaaacaatgctcaccgggccgggcgtggtggctcacacctgtaatcccatcactttgggaggccaaggcgggcggatcacgaggtcaggagatcaagatcatcctggctaacatggtgaaaccccgtctctaccaaaaatacaaaaaattagccgggcgtggtgtcaggcacctgtagtcccagctactcaggaggctgaggcaggagaatggagtgaacccgggaggcggagcttgcagcgagtggagattgcaccactgcactccatcctgggcgacagagcgagactccgtctcaaaaaaaaaaaaacagtgcccaccgtcattagtcattagagaaaggcaaattaaagccatattacatacttattaaaattgctaaaattaaaaggactaatgataccaagtgttggtgaagatgtggaggaactataacattcaggcactgctagtaggagtgggaaatgatatagtcactttgaaaaacagtttggcaatttcttaaaaacttaaacatacaactaccatataagctaggtatcgtacccttgggtatttactggaaagaaatgaaagcatatgtccatacagagacttgcacatgagtattcctaacagctttatttgtaataccaaaaactagaagtaatccaagtttccatcaaaagatgaatggacaaacttatttccacataatggaacactactcagcaattaaaaggaatgaactatggatatatgtcacaacatggatgaatcaaaataattgtgtgagtgaaacaagtcgggcaaaaaaaaagtacatattgtataaatccacgtacataaaattctagaaaatgcaaactaatacacagtgacagaaagcagatcagcagttgcctgacgggcctaagggagagactgggaggggtagcagggagggatttgaaaggggaacaaggaagcttttggagcactgtatatgttcattatctcaatcatggtaatggtttcatatgtcaaaacttcgcaaactgtacactttaaatatgggtagtttattgtatgtcaattatatttcaattaagcggtttcataaatacataagcaggcaaataaaacacattctcactcttacgtaaagtaaaaaaaggcatatttaaaagttaaaaatacccctaagcaacaaaatttattcagttaatagaagaaaagaaatagcaaaatcgaattaaccaatagtgggttaatttagaggcagctcatgttatgccctggttatgtgtggatgtaaaagtgaagttcttacaaaagaatggcctgttggcttaaaatctacaggctttaaaaataggcacaaccagccaggcgcagtggctcacgcctgtaatcccagcattttgggaggccaaggtaggtggatcacctgaggtcaggagttcgagaccagcctggccaacatggtgaaactccctctctactaaaaatacaaaaaaaactagcctggcgtggtggcacacacctgtaatcccagctactcaggaggctgaggcaggagaattgcttgagcccaagaggcagaggttgcagtgagctgagatcgtgccactgcactccagcctggccgacagagtgagactctgtcaaaaaaaaaaaaaaaaaaaaaaggtacaaccaagattcctcttcaaaatctcttaggttattttgtttcctaaatgaaacctttgacaaatgtgtactgagtaaggatgtagaaaataaatctagaaaattaagtacaagtgggaaggtaaatggtttatgcctaacctttgaatacactgcaacatggcagcactggattgacatagaacccttgggatcttaccactgtgcccagacattcccaagtgacagaagcccttttaaagggtctctgctggggaaagttgataaagtaccaactatttgtaaggccctgatatcacttggccaggaatatttcttgagagccagtggaaacagaacatgggaaagggttctggtccttaagtcccacagaatgaaaaactggccaagacgctgtgctttggtgccagcgaaacaggaatatacaaccacccactgccaagataatcatcaggagcttctgatgaaaaccgaagcaggtcttcggagtaccaccttccccgacagcctaaaagctaataaagttcacaattgttctatgcatgaccccaagcatattaagaaggagtgtctttaaacttaacgcatttgttgaaaagttttccattccgttcttgaacacatggtgggaatgttttactgctaagtgtatttaaggaaacccacagattggaactgctctaaccagtgaggcgagaagtctagtttcagttacggccccaccacaggctcactgtctcttttaattaattcattaaccaatttattaaacaaacatagattaatgagaggcagataactaaaagaataacataatcatctgggaaactatctcctattgatgaaagggtaaaaagaaggcagctgctagtttttcaccactgtaaggggctagcaatggtgaaagtttgtcatcagataaatgaacacacagtgtcaggatcaaaatcacaggagaggaagctagaattacaaaatatttaaacttaacctggaagggcatcagagacatccggagagtttaatcgattggctgaaggtcacacagctcttgatggcaatggtggaatctttcattcatacaatagacaaaaacatttactggggatccaccatacgccaagcaccgtgctcagacctgaagatgcagcagccttcaagggacagggtccctgcctttatgacgcctgaaagaatcttgctttcttgactccaggcaggggacattctattacagtagactaatgctagattaaacacacccatcagcaaagagcaaacaaacacacacacacacacacacacatacacacacatacacacggtattagaaaaagttaaacagaaagaaactgtgcaatgaaaggagatgctcaaaggcatctgctctggatataacaataactcctagctatggggttcccccttcttcctttccactccctggaattaaaagcaaaagcttatatatagaacagtttctgtggtccacagaaaaccattttaacagaaatgattagtagttctttccaagtttttttcaacctccaggtggatattttagaaacagagcttatgtgtaatactcacaataaaaatcaacaatgcagttttctggccgaagatatcagatcagcacaagacactaagatgttaacactaattatctctgggtgaataattttatgggcattcctcactttctactttgtttgactgtgtttcaagacttgcagtttacaaacaagaaaataaaattcctcttgtaaataataaaagactttcctattaaaaaaatacaggtctgctctagcaaaagcttttcttaagtaatcacaaatagtaaagcactggacattatttcctgtccaaagacttcaataccttgtagtaggttctgaataattgatatgtgagtgtgtttctttgaaaacgacaaaacattacatttatgattaaacatggcaaaattgtaatttgtctaatgattcataaagttgccaagtactgttctatacagtgcatcagctgattcttaagaaaatccagacagactgatcaagtatgtattattgtcctcattttacaggacaggaattaaggttgactcagagttaagtgactcacccaaagtcacacaccaatatttggtgaccctggatttcctgactccacatccgctgctctctcaacaccactaggtaaggcattaactaaccattaagaattcctctctaagaaagaacctgcttcatcctcctcacagcattttggaggcctttggttctacccaaatcttcctttcttatctaatctttcttatcaggtggcctatatgatagacacacacacacacatacacacatgcacacgcacacacatacgcatgcactttcattataaaaaaacaaactctggagtcagaatgacccaactttgaatccctcctctgccacgtatgagctgtgtgactttgagtaaataaatcaacctgattactcatttttctttttcattctaaaatgaaaaataggattacctacatgcaggcacagattagatgtccaataaatattagctcctcttactactattatcaatgacatctctgtggcttatcccaatttttttagttctccttgatgactatagaggaaaataaggagatgcagacagatcctggggggaacaagtttactggcaagaagttatatttgtttacaagtagaagcatttactctgcccacagccagccaatagcagtgcttgcctgcctcctctcccctccatgaagtagtcaaccattgcatcttgtatcctggccattgtagcctgtcctatcccaacccaaaggtaactgaagcctctctcatactctagagtcgggccttccattctttatccttaatctcataggacctgcagcagtctcttcccctggtagaatcccctaaaacacctatatatcagcgactctcactccctgctcagaatatatccctgctgccctgaaggcctcctttcccatccagtctcaatatctgagcagagtcagatctggttaaaactggacagatgggagcttccctgggggtttggatgttgtaccctttctctcctcacccaaagctgaaaaccttcaaataagtcaaccccaagccagaacatcctcaccaaatctttctgacacttgtcaggaaaattctgcaggccaagactcctatgttatcaatagaagccccttcttagtaacttaattagaagtaaatccaccacagactcattacaggtcctcaggcagataaccagggggtcgctttctgtatcaacaaaaaaaaggaagtattcttctatgccctttctaaattgagccagtgggacagaaaaccgaacacactacaaagattcctaatggagtattctgcttagtgaggctagacctcaaaatggcaggcttcgaagccccttcattacagattgacacgagtgctcccagaattgggagatggctacgtaacagcacttttcgaagataaggcatatgggagatgcatctctacctccagggcaatgtcaaataaacctacacatacttgagcacacccagcaaaaaaacggtcactagggatgcatttagccttcataaacttgggctgtagggggtgtttttcccttttaaagggaaaaatttaaagtttaaagcaactttaaattgctttgtatttcaggactaactagtattttttcacatgggctaagaggccctagaatccacacttgaaaaaccttgcctctgagagaatcaagaatgcaagaatagagtcttctcctacaaaaatctcaaatactcatatactcaacaccagagaggacacagggatattgcattccatggatggattaaacactaatatatatttggatggtttgcttgcttgcaattactatcttttctctgttgtgtttatgtgttcatggaagtgaataatttttaatttaaatgtatcttgcttaccatatgtatttctgaaagtggtctacatatcaaattgtgaaaaactgattattttttccattgaattataaaataatgactagaggacacggggttcaatcagctgaggatcctggggcatcacctcatgtctactctagattggaaatctttgtgtctctctctgggcaatctgacctcaagatggaacagatccaggcatatctctctagcacatcagacttccacttcctctagatagggaaagttagctcacaccatgctacggtctcgtgacttggagggtctgctcctctatcacctaccttctttccaccagcccctagtcactggcgtgcttcatactcagtcttgaaatccccagaagaccccattactattcgtgatccatctggctaaatgccttagcccacagtgtgttctggtatgtggcattttcctctctatagtcctcaagtcaatgctaatcttagatcactccccaacttcacccccaagatgatatgcttatgttttaagcacagctgttccaacatgattttctcttcccaccctaaatgtgacaagacattgaggcttcattccctgaatgccactgaacaaagccaacagagctctatgacctttggtctacctcttatgaaccgttttatttctaagaattggtatttcctcctctatgaacctgatgagctccttctaccttcttcccaccaaagccaagactgctggcagtggtgcattcctgtccaaaaggcgagtctcagacggaaatgtagaagtgtgatgctttgaaatacggcacaaaacaactccctcttgagaaccaaggacattagacataaggacaatgttttattttaaagccacaaaacagggagcctctaatttaagatttttgggtcactcgaaagtcttttcacactgagctcaagtgtcctttcctctgaaacctcttctggttctccaccctgcatcccctcctccatgctataggcttctggacagtaccatcacatctaactgcctgctttcctttttctgcctgcccctaactgggctatgggtacagggcagaaacagtcttattcatctctgtatcaacctaacaacacatctggcatacagtcagtgctcaatatatgtcttgcaggaatagaaagaagtcttaatgcatcttaaactttttatcaaagcctatgccacaataagaaaagggtctgcctatatgagggcggcctgcaggtttctgtggtgagacagagaaccggttgtctactagggtctggatggaatcaatggcttggttttttttgtggttctcatctatccctaaccttgagtgaagatagcaaccacctcagtccatcacaggcagggcttggccttgtttcaaagctgtttgaccatctcagaaccctcagcccttcaggcttcctatcaattctgttgttctaaattagagccatgacttgaacctgacttacccagtgggtgagaaaaacaggcttgctaaggtggtacctagaagctatgaggctgggttagcattccacagcaacgatgctcacctgtgtcccctcctatgagggctgcctgctgtgcagttctggtttctgtgagacctcaacctgcaataatccttagagagtgacactatgtccacaaccagtcccacagtgccagttcctgggaggccaagtggcttgttgaataggaaaccagcactgagttttttaaagatgtgggacatttacttagtagtctctggctagccccaacatgcgcatgaaaaaattagaggctcccattagaatgaaactactggtgtggaacatttccaggcgtaggaaatctagatgttggaacagtcatggaaagtggaagaagtgggctggtgatctttaacaggccagggcaggcccagtgctgggagggaggactggggagcagaaggttaacaccaggctggagtgcagtggctcactgcaacctccacctcctgggttcaagcgattctcctacctcaggctcccgagtagctgggactacaagcgcacgacaccacgtccagctaatttttgtatattcagtacagacgggttttcaccatgctgggcaggctagcctggaactcctgacttcaggtaatccgcccgcctcggccctccaaagtgctagaattacaggcatgaagctccgcgcccggccaccactatttcttaaaaggtgagggtttaagagattacagtgggggagtggatccatccgagtgcttcagaaagtacaaaaagaaaaggaagccgggtcacgtggagtccttactcttctcaatccctcaagaatttcccagaaggatggactttcctaagaggctgcggtgtgctgcaggcccagtcctggtccagccctgtcgctgggctagaaccagagttggtggggaagttccattcccggggagcgaggctcctttattcccacctggctgagtgggggctttctacattcctcgggtcccgggaggcctggcctctgacaccgccggctgcgtctgggtagcaagaccccttggtgcctgcggttcttgacccctctctggcagcacaaggtcaaaggtgtggggaggggcgggaggcgcagctgcggggtccctggagttccctggcggggcctggtagcggaagacctttccctctgaggcgcccctctgttctctgggggcggccacactgtggggtcgggcaggtcgcacccttcccccagctgaagagcagcgctcagaagagcccttcccccaccgcagcggctcctgggtgggaaagaaacaaaggccggcttcgcggccgctcggagccgggagcatgcgcggtgagccccctcccctgctgctgcggggttcccgcgccccaacccctgccccggacctcaggtcgctggcccctcctgccccggacgtccgctttctcgccaccaggcctccgctcatttgggcctgccgcctcctcatcttctgcagcccaaccctcagcctcctccatgcattcccagcaatgcctctcagaagtagttgtcccttcctctgtgttccctgggttttgagggttttttttttccatttagtttattctaccttggtttttagccatctctgaggatggcagtacatcctagtgggccctggaggcggaagaactgggttcaaaccctgccccctgccacttggagccatataaccttaggcaagttactagatcctcctctaaactactgtttatttgtctgtaaaatggggctaatagaatcattctccctacctcctgaagatgtgtgagatggaatgaaatgatgcttagaaagcatttggcacagttcctatcacatggttagcactcagcaaatgttgccggttaggatttaacccatgttttcaccctttcctcaacacgccccttctggctggctggctgaattcgaaagactgagcaaattccagagtaaacaagatggcaccatcggaacaagaggaaggagaatatgtccaagggccaggtaaacatgctctctaacaggtcccatgactggagatgctcaggatcagaggaacaaaatggaacgtgccagactccgtgggaggtgtcacctgacagaggagctgaccggacaagccttcatctttagtgaacaaaatctaatccttggcacagccacttgtaatttctggggtgacagaaaggtcgagtgagcacgaccacagtgagtgggtcacaagaagtgtctctgatctcaggttacctgtgatcaagtacctgtaagcagctaggaatagtgattgggaaccagaaggccaaatgtaagaggcactcagcactagagatgctcagaaaatgctgttccatgtctagaagatgatggataagttagtcaactgctggagttttcctgggagcaaacaccataaaatacaatttgtggaagcattactgatgagatatgatgctggcatatatagcatcaggaaccatttaccctaagacctaagcaatgaaagaaatgtttaatagtaactatgagcatctattggtacgtgatagcttttaaacttggacttcttttagttcaaaatcatttatatagtgataatgtaaatgatttgactcattttatgacatgaacagaaggattttctaataatttttacaatgaacatagagattccaggcaagtttagacaaaaagacatgacactgttcttgccttaagttcatactttagtagagggaacaaacataactttgtaagttccaatatcctgttttaatctataccaaagcttaaaagttgaaccctaaatctgcctgcagattttgcttgactgttacagaggtttgtaaaatctaaagtggaatatctttattggggtatgaatggtccagttcagtacaacccccaccactccctaacaccttctttacacaatggcactgcctcctggattctgaaagcttttgagttggcaagcaggatctgtacttttctttctaagtatgcttatgcctttggccaaaagcaacacaatttggacccaataaactgcaatccaaagacgtgctctgaaggacatgtaatgccataaactgttatgggcagcttttgagagccaagcattgtgataggttctagggatacaaagatgaatgagtaaggatccctgttctataagcacttaagatacttaaatgacaaaggcaccaaatgaaagcgaggaatattgaaaagaggatgttatgtgataaggatatggctacagaatttaaagtttgctgattctagacaaaaagtaaattctttagaaagaaatattcctagaacagagaagaagaatcactgacaatgattgttttaaacatatgccagaacctgctataagcatttttcatggattatgctcagaatgggatatccccattttacagatgaggaaatagaggcacggagagattaattacctaacccaaggtcatataacagctggtagacagcagagccacacttggaaccaggcactctggccaccaatgctcacactcttagccactattctatgctgtatcctagaataacctatcgctaggctatattgacttcttgcaaataccatttaggaaccaaatattttcttttcaagataaatcaagtcaattcttatgtgatatatagtgtcctgagagaaattactttgtccaagaataaaagcataacatcataagtgacaggtctagtttttaagctaatagaaattaatatatgtggtatttttgtttataaatcagtctgagtttatactgtgtgaatcattttcccaaattccagtcactcttgcactgtgctgagaaaaatcaagcctcctcaggtgatgtgtatgcacatcaaagtttgaaaagcattagctataaggtagaaataagacatttgcctttcagcagcgcctgccaccaatcagccaaaagaaaaaaaaaaagtctttttgaacacatacatttttattctttcataaacttcatatacatgccactatattatcatatttaatatgcaataagatacacataaaatatacattttaattttttaaaaacagattgaagtagatatttcattgcccccagtggatcatctggcacacttcctaagatgcctatattcccctttttggaatctacataccttacatcaaggatcttatctaagagctagaccatctatcttagatgggtatcttccaatcatcgaagacttcccagaacccaaatcaagaataatttctacagttaaagaaaatactgtgtattgttactttgtcaatgaagcccaccagaatgcatctaagagcaggggttttgggaaatctacatccaggtgatgtttttaaatagttcaagaccattcttctatgtcttaatttacaaacattctctaataagcatgaactatacttggttgcttcacctcccgtggctgggcatgtggaagaaactgaaaaaatacttgttaactgcatgactgtcttccagccaaagtgatgatctttgtcatctggtttcatgcaaaacatgcagattttcccctttaccatactcttcttccctaagagtgagactatcccagaggcagcatgttgagcagagccatctctttttatctagcattctattgggcagaacatgaatttagctacctgtaacatataattcagagattcaagagttttgcaaaaatgacttgtctttggagccttgagccgccctgtcacaagttcaacaaccttgtggctgccttgctgaactgaagccctggccacatggaaaggccacatagaagtgttcaggctgacagccagcatcagccaccggacatgtgagtgaagtcacctctagatgattccagcccccatctgtcaagtcaccccagctgacaagtctttccacagaacagagaaaagctatcccactgtgcctgttggaattcttaacccacaaaatccatgagcatcatcaattggctgttttatgccactaaactttggggtggtttttatactgcaatagtaaaagtctctgtgagattctgaagtgctctctgaattattatagaaagacaacattatgtttagtgttaaatggccttatttattttcaaactcagggtaaccaggcagtcattgattattaaaatatacaggggactctaacaacaagatttattaaaccccatcatcatttcctttgtgtaccagcaaacagccaattactacatgtgcagaataatggtggcaattgtcactttgctgtcccctgcgaagcaactctttagttctgtctcctctctcagaaatgaattgctccttctcctcctctagctcttccccttcttctccctattgctcaggctgggaactcaggactcatttttagatgctctctcttccttgcccctcacattgaatccatcatcaaatcctgagtggtctaccttcatgacacacttggaagcaatctgcagctctccccatgtagaggttagaagtaccgtaatccatgtgagtggcgccccctagagctcatgagtacatggcgtcatggccactgcaaacaccctacttcaggcacatcatttctgccctgaccccaactatggtcttcctgctgctctcacagcttctactctccctgtcacaatctgtaattcacacaacacccagagtgactttccaaaatattctccagaacattgtgcacctaagtggaatccaaactcctcgctcagctctgatgaccggcccctttcttgtctcctctccaacttccttttctaccaccttccccctccttcactctccttcagccacactggccttaattttcttctgggaagttgcactctctcccctaaccctccttggggcctttgctcctgtctttatccagcctgaaacattccccccaatcttctcatggcccccaatttctcatggccagtctcagcttaaatgtcactgccacctcaagagacctttcctaactaccttttgttagtatcatagcacacttggctttcttcatagcagtcttctcagtttataagtacctattcattcatttcctttacctgtttacttcctttctctccaatacactgtaaactcctgatgcaaggaccaggcctgtgtccaccactaatacaaccccagcacctgtcatggtgcctgacacatagcagattctgtcagtatatgttgagtgaataaatttacttgcatactatgtagcagtggattgtgataccctactccactcccacctccagaacatctgttttcctcccagttgaccacggaccaatggttctcaaagtgcagtccccaaccagcagcatcagcatcaccggaacttactagaaatgcagattctcaggccccaccctggacctcccaaatcagaagctctgagggtaaagcccatcaatctgtattttaacaagccttccaggattctgatacacactcaagttagagaaccactgccacagactattccagagactctaattctagagcagtatgtctcgaggtatattccactggctctgagggatcatcccagctgttaaaaattttttaaaaaaaagagggaggaggccaggtacgtggttcatgcctgtaatccaagcactttggcaggccatggctgatggatctcttgagtccaggagttcaagactagcctgggcaacatggcaaaaccccatctctacaaaaaatacaaaaattagctgggcatggtggtgtgtgcctgtagtcccagctacctggggggctgaggtgagaggtttgtaggaaccgaggaagttgaggctgcagtgagccatgattattccactgcactccagcctgggcgatagaacaagaccctgtttccaaaaaaaaaaaaaaaaaaaaaaaactgggaggcattcaaagccaaatgacattgagaaacacggtgttcaagaaagttaaacagattcccttatggcaggaattctcagaacctttaatatgacagttaccttgtaaatcactaaaatacaaggaaatttgtggtagaagtgcttcccaagtttacttggccacaaaactccctttctttccctcctaaacacttgtcagacttgttctggactctgagaaacacactttggaaaatgctgtcataatgtagtcttccctagagaaaatctttctaacaccattccaattcattgtgcctagagcaatattaataatgactgagtcactggcagcaacttctttaagctttgtgcatctttatctttcttagacttgaaaataaatgcttaatgctaaacacattttcatatgtctttttaatatcagtaaaaagatcagatttttgttaaagtctgaaatgttcatgaaggcaaatatggaagggtagaaactggtggcaatttcaagttgaattaaaatgagatgcagagtttagagtctctttcctgtattagagtaggcagcagtgagattctctatttaaattgtgaaagtttctttaatgagcatcagagaagcggcttcatgtttggggcactggaagagccttagttttctcccctagttgatggggccgggggtggtggagattccctgatgatggagtggcaaactgtgcaggtaaattattggtcccagctgacaatcagtacttgagaaggctgaggcagcttagaaataggaagttaaaatattcatgccaagcatccagcgtttgtttaatcagggctaatgattagtttcttaatgaaattttacaagctcagttgaacacagaaaacatttgcttctctaaaagcaaacaggtctgtttctattataatcagacatctgaaccacagaagacccccagcccttaggagtacagaggtgaatctgttcaggaacttccgagttttctttgaagatgatagtggccaaagagtgatgggagaaggaagctggcgatcaacaagatttgaaactgcaggatctaatgccacagaccctgacataaactttgggcagttgtgctaaacacagcagctctcaagtagagggacagatgatcaaaggagctaatatagtcagtggttatgctagaatgtctgtttgggagggctttggagtgacagtctaactggaactacttttacatttctggcaggctgttcttacttaggttatatgagaaaattaaataaaatgaaatttaaaattcagtgaaacaggagaaggaaggatgattagggagaacaaaagggatttttagatcagtgaaactattctgtatgatattataatggtggatgtaagatatgcacttgtcaaaacccacagactgtacaacaccaagacagaattctcatgtaaactatggactttgggtgatcgtcaagtgtcggtttgtcatgatgatgttcatcgattgtaacaaatgtgccactcttgggtgggatgttaatagcgggaggaagccaaccatgtgtaggggcaggtggtataggggaagtctcttaactctgcttaattttgctgtgaacctaaaactgctataaaaactttaagccttcttttagaaattcaattaaaaggtttcaaaagatgttttaagtcatatttagtataagatggagaaaacaattgcctaagtcaaaaattactcccattattattaccatgtccgttatttttcttcttttttttttttttttttgagataatgtctcactcttgtctcccaggctggagtgcagtggcatgatcttggctcactgcaacctccacctcccagcgtcaagtaattctcctgcctcagccttccaaatagctgggattacaggtgcccaccaccacactcgactaacttttgcatttttagtagagaggggggcttcaccatattggccaggctggtctagaactcctgacctcaagtgatccacccaacttggcctcccaaagtgttgggattacaggtgtgagccaccacgcccggccccattattattcttaatagcttgaagaaagtggttgataaaggtggtaggtaagctgaaaagctctcccgccaccaccaaatccccctacccatgtacttcctgacactgttgagtgtaggagtctagtgctgtaagagccctggctacaccaggaacgtgcagtgatggaacatttctacctctattgcagtactgacgtttcctctgtgatcttggcttacatgtctgtctcactcacctgattgtatgatccagcagggcaggaaccctgtcctattcatcttattttgtttgtttgagacagaatctcactctgtcgcccaggctggggtgcagtcacaacctccatctcccaaggtcaagcaattcttatgcctcagcctcccaagtaactggggttacaggtgcccacgaccacacccagctaattttttgtatttttagtagagacagggtttcaccatgttgcttaggctggtttcacactcctcagctcaagtgatccgcccaccttggcctcccaaactgttgggattacaggcttgagccaccacacctgaccaactgtcctattcatcttatagtcccaacccctagcacagcaccaggaacacggtagatgctcaataactgtctgctgattgaatagaagtgaaacagccaaggttaaatagataatttagctgtctgccctatatgttttaaaattgtttttccatactcaagtttaataaagtttgaggaaatatgctaaccaaatttattagtttgcattaaaaagacctgttttgaaattgttaaatggctaaagtctgactgtatctttagaaacaagatattcatagtacagccccaacaatttctataagcaaaatgcaaaacaggatcaatcatgtgatctttctagaaaagtttcacactgagccctagactactaagtcattattcaaaattatgggtggtaaaatcttccttaactttttcagtgacacctacaattatatcacaaaatattcaaaaccctttctaaataaaactttgtcctctagcaagtattcttttaataggaagctcacaaagaggatatttaaatgtgtcctaaagaaaacccaggcactgcagtaattctgtacctatatttgaagtcgagttgtcatgttatagcaaaaacagacttccctgacatttagaatcttgtcaaaagccaagttctgaatattactttagggcaccttgacacatttgttctctagtttccctgcttgagagaaaaactatcaaggttttctaatatgggagacctatatattgaaatgtatcatttctgagggaaatctatttttaaggtaccgagaacaaagtcaaaagtccttgaaaaagagatttttataattaaatggattcaatggtgccaagtaaaattcattccctaaaaatacaacttacagcccgggtgtggtggctcacacctgtaatccaaacactttgggaagccgaggtgggtggatcacctgaggtcaggagttcaagaccagcctggccaacatggtgaaaccccatctctactaacaatacaaaaattagccgggcatggtagcacatgtctgtaatctcagctactcgggaggctgaggcaggagaatcacttgaactcaggaggcagaggttgcagtgagctgagattgcgctactgcactccagcctgggtgacagagtgagacttagtctcaaaaataaataaataaataaacaaacaaacaacttacaatggtgttatttttacaaacagtacagtccttatgaaaattcttacatggttctcttgctatcccatttttctaaggtatatgacttaataagtttttaaatttttttaatggtggtaaaatacacataacataaaatttaccatcttaatcattttttctaactcatgtttattatttgtacaatcgttagcacaggtcagaatcagagagcctaggacaaaaggaggttgatagagccatgattaaaaagctgtaactaagaatggatccactgtgataaaagcctacaaggaatatcataggaatatgaaatatatgaagtaaatgctcatgtatccacatagatgaatctggaacatataatgttgagtgagaaaaagcaagttacagaccatacaaactgttcacatatgtaacgtttttaaagatacacaacactgtttattgttctagcatttatgtatatatgtgcacataaaggtattgataaaattagagtatataaagacaaggataaaacttcaggacagtggttccccctggggagagaggcggggagggaggtgatgtgtcagggagattaaaagaggcttcagctctgttcatgcgttcctagccagtgctggcaccactgtaggtgcaggtgactcaaccataagcaaagccatgatgagctcatggagctgaacagttagtggagaaagacagaagacaaacaaataaattcactacatatgtcaggtggtgagaagtgctaggaaggagaagttagaggttgattaagggttgctattttacatgggaagatcaggggaggtgtcccagataaggaggcattcatgcaaaaacatgaatgacacaagggtgtgagtctatgtttacatatggaacaaacctttaagtctataaaattttatgatggttcttttaaagtaaatatggcaaagtgttaacatttattcttagtggtgggctcttgttgttttttgaaagtttgaaaattttcataataaaaaaagatttttttaaacgcactgtctattactgaaagatgaggaggcaggatgtcagacatctctggatcttttccaaatgaaatatcttgagcctgtgactggaggtcctatttctttaagtgttcttacatattgggacttcctgagaaaagccggtaatgggcaatacttcccaaccattaggttatgcatgcttgtttgcctatctgtccatctttgcttcccaaataaaacgcatgcctgctcaaacatggagtgtcccctgcttgaaagagacaaggtcagaagatgaagagtcaatcctgcatgtgtgttttcagtaggagaaaaggcatatatgaaaagcaagtgaggatgcaaggtataaatcaacatgaagcactgatgacaaaagacagatgctggagggaaaaacacacagtgtcggtaccactgagctgaagagccaccatttagtatgtactagtgtcacccttctccctccctcccccaaagaaagggacatggtatcatgttctgttcccaggtgctcaaagcagaaaaaagttgcagcaatgtgattccttcaatgctttttggagttaacataaattgaccaagaaagtacacaatgaagtattcagggtgtcagctctagtgctacatctgtaagaagtattttaaaaatatttggtgaatgaatgaatgtaactgaggttattcatgacagtattacataaatgatacatatttctgtactcagagcatttcctaggtcacaaaaggctattacataccatggcagagactgctgttttaccccaacatctctcttgctttcataataggaaccctgatttttaggttcctaaaagtacatcaccacctaatgcagttccggacaatatataagcaattgtgtccttagtggaagtgtccttaaagagggagggcatacccttcttctgccttcttccttcccactagttggaatttggatgtgatggctggggctcaagtggccattttgagcaaggagatagaagccatctaccaaggatggcagcacaaaaggaaacaaagattggactgtgacaccatggagtgtcatgctagtcctggacagcctatctctggacttgcacatgggaaataaataaacttctatcttattcaaaacttcgaaattttagtaaactacatgtctactttactgaaaactacggttttgctgtttttgttgtttctctgttgaatgcagccaaatcttaccctaactgatatacatacatcatctcatctccctaaccacaccttataaagtttattatgatgcccacattatagaactgaggccagaggaggttaattggcttgctcaaggacccatagaacccaagacttctatcttcaagccaagcccagtgctctctatactcatagttgtattttggtgtgactgatatggattatttaccaataaatgaaatatattaagtgaggacatagcagcttggctgtaaaggaattatatcagcaactctggacatgagcttgtaggagtagggaaaaccagaaagaggtttagaaaggggaactgagagattaggaaaagacagcctgtgttacatgcagaaagactttagaaagtacaaagtgagaaacccatttatactatcctacactgccagaaatagccttctgagcagacagttggcaagtgacccgggtataaccagctatgcaacctcctggtaaaaaatcttacctacctctccaaccccctaggcttcttaccctaactgaataccatatacacatttcaggtcttttaaagtcagtgtttcaagggtataataataataataataatacatctacaaacttacagttggaaggccctctggctgtcataatcatatagttatttaacatttgaaacctaaagcaataggtccttggtaaaaatcagggccggcacaattagttgatctaaaatatactttatatccttttcatttaaacatgtcttttaagaataatctgggtatgtggttacctctgcccattcacttttgaaacgtaagagttattacttttccaaaaagcttcttaaaatttttctgattacgttttttcattgtaaaagaaattggaaagtaaaaggtatctgaaaagttttaattgatttttagcttgagcaaaactaataatccattttccataatttattatataaaatgtgatgatggtagaagaaagaaaagaattctactaagatggcaacaggtcccaccaacaccacttcctcagggtccagctaatcccatgagaagagcccttgcaatatgtaaaagatgggagcgccattatgcttgtcaccgtgagtagtaagtaccacgccactgaaatgtgctctacacttattcaaactgacaaatacaatgaacacattttaaaagtcaaatctttatagtaaagcaatttgggaagctagtttgctttctcgtgagtttgtgtgtgtgtttgtgtgtgtgtgtgtatatatttatataaattttttaccatttctaaatataatacatggtcagtgtaaaaaaactttaataatacataaagaaataaagaaaaaggcaaaaatcccaccaccaagattcagctataattaatgttttggagaatattcttctagatttcttcttctatacccacaaatacacatgatatctgctgtttaacaactgtttcactcaaaaatatatcttgaagagcttacctttcaatatgtaataaatacatatgcagataaatacaaagcacactttttaaagataacatgatacaacctcatgtggatgttctgcaataaatttaagaaataacctattggttgtttgcaatttctggttattataaaccagatagcaacaaacatctttttgtatatatagttaaccaattatttctcttagggtgaatcccccacagttagaatgttgatgcatactgccaaactgccctccaaagggtagtacaaattactctccccaaaaaggcatcagagtggttgggatttgattttcatctttgccaactggagggtcaagaatgacaccacgctgagcacagtggctcacacctataattccagcactttctttgggaggccaaaacaggaggataacttgaggccagaagtttgagacgagcctgggcaacacagcgagaacttgtctctacaaaaagttaaaaaattagcagggcatggtggcacactcctgtagtcccagctacttgggaagctgaggcaggaggactgcttgagaccaggagttcaaggctgcagtgagctatggtcatgccactgcactccagcctgggaaacagagtgaaaccctgtctctaaaaaaaaaaaattttaactaaaaaaaaagaatgacagtatatcattgttttatttgaatccttagatgccatgtgaggttgagaaaaagataaataaccaaataaagaaatgggcaaaggacatgcagaggccactcaccaaagaaaaaatgcaaatagccaaaaaatatattagatgtttacttgattgacaaaggtaaccaccttttccattatttttatcttttctattatgcttagaaagtccttccccataccaagattgcagaaatattttcccctttttgtattccgctgttttcatctttttattttctacatcttgaatttaccttggtataagaaattaggtaaggattcagctttacatatttacatctatctagcagttgtctcaatgccatttattaaataatccattccagccccagtgatttaaaatgcttcctttggctgagtgcagtggctcacgcctgtaatcccaaaactttgggaggctgaggcaggaggatcacttgagcccaggagtttgaggctgcagtgagctataaccacaccaccgcactccaatctgagtgacagagagagaccctgactcttaaaaaaaaaatgcatcctttatcctataccaaatgtccatatatagttgcttctaatcctggactttctagtctgttctactactttgtctattcctgtgccattaacatactgttttgattgctatcgttttgtaatttgttttaatatattttatgaaaccctcccctcatcagttttctttttcaagagtttcctagctagtctcacatgtttattcttctagataaagtttagaattattttgtcaagtttccccactcaactcctaccaccaaatcgccctgaatttatacattaatttcaaacaattaccatcttaagtattgtcttctttctacctaataatgtgccttatttattcacaattacatcctctgtccaaatgcgtatctaatatgaagaaagggccatatcctttatgtttacatgctcaaactacttacaaagtacatttttaattcttatatttttctttgtactacaaaaatgtccagtaattgcaaaataatactaatgccatacacttgaaatgtttctccatagctccaaaacatccatctctagtatgtgagggtacaaatcatataccattataagatttgtctctcttttggaggctgggtgtctggcctccatgtccagtgctggagagctcaggcctcaagctgctgagcatcctccataggataattagtgatgatgcaaaccagacctgcctttgcacattttaaatggccgtgaagccacatctttgaagcctgctcagtgctgcctggagttcataaatcattctttacagggtataggtcagggcttccaaactacagccccacatcctgggcaggggtccaacaaggggggcgtggatgagagtggatggggagtgtgacaatattgtcaggcatgtgctgagagatgggcacctaccctcaagacaaaaagcaccattctcagatctgtgaaaaaaccatcagctttcctccacctcccccaccccggcccctaatcagcgagccagaaacagtgtcaacgtttaaagtgcaggccactgctcttcccagaacactggggcccttggcttcgcaaccatggcatttactttccagatgcatgtggccagagaaaccttcatcactgaatatttgctgatctcatccacagttagcaaaacggtgacctgcaggccggatttggcccacggatgtgttttctttggcctgcacattgttaggtcatcttttggaaccgacatttaacaatttagagatttcctgtattttctcttaaaagtctgaaaagcctgggccacactgcacctgcattcctgcagggtgcttgatgagagctgagccattcatcactcgtgatcactgtgcacttctatcatttatgggacctgagtgtgccaccgccattccctgcagcctccttactcccagtggtttctgattcaggtcttgtttagaaggtgcccaagtctctaagccggcaaaacatctcagtccttcatcttcatatcaaattatttattaaaaagaaaaaaaatcaagtaggatatatgtaggtgagaaaaatacataaaaatctagaagtttaaaaagctgggctacatagtttgtatttctaatgtttaagagtcttagacataatataatcaagcagagaaaaacttagagaaaaacttaaagaagatattaaattgatcatcccaagttctttgagtggagccatattgagtccttctgggtggatttttaaaatatactctattttaaaagaaatagtgcaacacttcaacatacacatacacatgcatacatattacaagcttgctattgtaaatgtgccttatttctttgaaaagtcccctcatcatatagtgtctattttttttctcacttggctcttgagattcaataattaatccatctgaattaattcctgtagtcaagaatggcagctgtaataggtttctctcttgtttactatacattccttagcaacataagcttagcttgcacctccagatttattccattgtattcacaaagcatcccattttggaactggagagagtaagcaaaatacaccaatctacttgggtcaaatcctattagagcaaataataagtgttaacagctttacaaaaaaaattttttataaagtagatggattaaaatgatcaacttggggacaattcaactgaaaaaaggatatttttgaaactactgaaaacaaaataaaatggaggatgcactggatattaaatgatattgaggcatcgttgttaattctatttggtatgataatgtgtgtttctattaatgatactttaaaaaacgaaataaacatcatggatttgctatcatgtgagactcacaacccttgggactataatctttcacagttgtaagagactttaaacattacctcgtccaggcatggagaggaagtttcaatttacgtgcacttcaatttcatagtactatcctgagaagaaattttagtctctaagactcaaaggaaaaaaagtgccatgaaccattagcaatgttggccagggtcacaagataggagaatggggccatatgtgctaccatattagtcacctttcaaacttccagtctagcggtctttcagggagcttacttcttgccaattcgactcattgcttctctagacagctctgtctattaagttaattcttatcttttgagctaacatcttattttctatagcttacaaccacatgacataatgacaagcctagtctagttccgttttaatttgacagtgttaacttaaactatttggggccattctcttgtcctctccaagtgtgaaacatcaccagtttcttcaaccactcttcacatagcatggttccctccccatcatcatcattcaccactgacaggcgtcactttgtctctgtccctgttccagtaggacacagtaaaagtgtcctcttgacatcacattgtcataacataatcctcaaaatgcctttattgaattcaaattttggtttataaaatctctgccttccaaattttgaaatcagatgctattctccatcttgagctcagtttggttagtcaggtggaggcttctaaaatctttctagctatctgccaaatctgcgtcgatttaaatagatttctcagagtgtacaatgatcatcccatatttccaggccctggtatgccattaaccacagaaaccataaaaagactcagtgtgcccctcctgacccttcagtggctcctcaattcaatctacagattttcaatcttacaaggagaatttccagtcttacaaatgatacctgagggaaactaactaagctggatgcttcctctattcaacaatttatcctcattgggagaaatgaactataagctaccaaaaactggctcagcataagcaataaagtagggttgagtcattcagtcaaatgtgctgcaaggactggactaggcgattgagcagatgacagtgaataagatagtgaccatgtcatcaagcatatacagttttccctcagtatatgtgggacattggttccaggacccccacatacactacaatctgcacatattcaagtccctgagttgggcctgcagatcccaaatatatgaaaagtcagccctccctgtatgcaggtttcagatcccacgaatgttgtattttcatcctgcctttggttggaaaaaaatctgcatataagtgacctgccaagttcaaagctgtgttgttcaagggtcagctacagttttaagcagtagtcaacagtgattaatgcagtacaaagagctgtgggagttgagggtagaagtaggtttctttggctgggttgagaaggtggtagagaagagagcagaaaggaagtgagaagtaggacaacttaatggaggaagtagtaggtatggaaggacacatggaattggaagggtggagaagtgagaaaagggtgagagaatagaataaatctcaatgagtcaagtcatgtggttagtggggcacagagtttataaatactattgggggaaataaagtctggaaaaacacagaggccaagctgaataagatggctttctatatcaggatcagttaatgaatgggtgatttacaccagagaacatgtgacccatcaaaaagcgtggagaggtgagggcagggaaaggtgaaaaactcagaacctaggacagaaaagcataattaagtgaataaatgaggggaaagaaagaaaagcaaggggtaagaagacaaatatggccttccaagttagtgagtagtggctcctgcactatttattttccttccttgacatttaaatacatggttatcagccccttttcccctttgaaatgcacctccaggcttagctctccaatccttatgtgtcctccatctgtctatgccttttcttaacaaccacttctcttaaactacctaatccacccccagcaaaaatagtcactatgactcatccccaagggcattggcaaaagaaaaccatgacaagaggacatgctggataagtgtggggtcaaatgatctttgtacacacctgaaggagcagaaagggggagttaaagggagagtctaaagaggggtgagtagaacaaaagggcctgtggatcccaaaaagtggtaacatcaacctaagaactcaggccctccttgtgttctttatccattcattcattcattcattcaaccactcttgtgttcatttctctccctccctccatcccctgcttatctgttgccacacacccaacagcccacaaaggcaaagcaaattcctatatatctctcaagcctcaggttacacatcactttatcaggtcctcatgattaaccttctccctacatagcatcccggattttttctttcaaaactgcatcacagtgtaatttctcatttgttgacttctctgctatgttgtaagctctatcatggaaagggtgccatctcactgctgtgtccctagcactgagcacacagtctcaactcaatacataactatggatgaataagacatctcccagacaaataagtggcatcactagaattctctaagaccaaaaattggtgtggccaagattgctaactactcactaaaatccatgccgtctctttgggggcacacagatacactaattccttactctccctcgtagctaggtatggccatggctaaattctggtccatggaatataagtggaagtgatgtatgctaattccaagctgacccataaaaatccttccatggtggccgggcgcagtagctcacgcctgtaatctcagcactttgggaggccgaggcaggcagatcacctgaggtgaggagttcaagaccagcctggccaacatggtgaaaccctgtctctactaaaatataaaaattagctgggcatgatggcgggtgcctgtaatcccagctacttgggaggctgagacaggagaatcgcttgacccgggagatggtggttgcagtgagccgagatcacgccactgcactccagcctgggcagctgagcgagactccatctcaaaaaaaaaaaaaaaaaaaaaaatccttccatgcttttcctccatgctctttttccctttggggtggcaggactgcacacaacccctgtggtgatcttagaggccacatgttgctacctgggatcctgtttggaaaaggaccacccctctaatatgttcataaagagacctaaacttcatacatcatacatccatcatacatttaggggtctatgtgtaacagtagttaacctatctaattcagtgataagttacaactgaagttaggctcccctaacctttaccagctagcaactgttttgtcactttcccaaaaagaaatgaaggccattcaggggccagtacaaacttttttggtatgtatgacagaacaaaagttccatttgctcatgatcattaggaaaatatagtaaccatggcttgggcttccctgggcttgggccacagccacaaaacaggctgggtggattcccgtgatgtcagaacactggaaagggagcttgctggcctggccttggctcagaagcacaggtcgcaacccgcaggccctggacaaatgcccaactgccttctggagtagcctgtccctggcctcatctgtgcttaccttgcaaaaatgtcacaaaccattgtcctgttgtgcttagtgccagctggggagaagctgccaaaagcttttgcaaaagccacaccaacctgcactgccatggaacaatggctacaccaaatgactcgccttctgaataaagcattcagccgaccagacagacgtaatccacctccctgtggcaaagctcctcttacactgaagatgtagttgacaacttctgtttctacttaacactagagactttaaagagaactcctctccctggtggacttcagtatttcacaattgaattacattaagagaattagtagcatgtactgtacataattgcttgttcaactcaaatctaggaaactactaaaagggtaaatcattgactaaatcattttacctttctttattgaaggtttgtttttttgtgtcaggaccttccagatacagtgattcttaatcttttgggagtcagatacctttttaagaacttgatgaaatagtttgattcatttcacacaaaatatgtatatagtgcacatatctactgcctgtgacttcagagggcacacaggatgcctagttcacccactgatcccagacccagagtcatgaaccttttagggcaagggtcagcaaactttccctaaaaaaacagatagtaaatatctttggctttgtgagccacttatagtctgtttcacaactacccaattctgctgttgcagtgcaaaagtagccacagataatacataaatgaatgagtatggccgtgttccaacaaaactgtatttatgaacaccaaatttgaatttcaggtcattttcatgtgtcacaaaatattattcttctcttgatttttttctcaacacttgaaaaataaaaaccatttttagcaggaggcctgcagaaaaaaatgtatgatgtaccataggttgccaaccactgctgcagggcatgggttccaggggttcatcaccttggaaaaaaaattgcacctctattatcactgacttctgattggaatttagcatttccttccactatgaatgtaggccataaaccacagtagcaacatcagtaactgtaatgctgtcaccagcagaaatcacaggtatgttcatataacattagagttgttgcacacaactcaaaatactgattatgctcatcactatatttaaattatgctcactcttagatcttctgctgtatctggttatttaaccagattttttttttgaggtagggtcttactctgtcaaccaggctagagtgcagtggcgtgatcaaagttcactgcagcctcgaactcctgggctcaggcaatcctcccacctgtgcctccatcactatgcccggctaatttttctttttttttttttttttttttttttttttttttttagagacagagtttcaccatgttgcccaggtctcaaactcctgggctcaagtgatctgcccaactcagcctcccaaaattctgggattataggcatgaaccactgcgcccagcctaaatgtgttattttttttaaaagcacatatattaccatattacaaagtatatttttaatatttgggtaactgtatctcaataactgatttccattgtaaccctagatattttatttcttatatagggtttaagaacagtgtcctgagaaacagtctggagctttcaccagatatcaagagtccatggtatataaaaggttaagagtcctttcctgctccaggctaacagggcctgagtagcaaaaccacagtatctcttaccagagtattcacatcttcagttttatggatgagcatccggatctcctctggatcaccgctgaagattgcctgaaccaatggtggctgcaaacacaagagaatgggaatcagaactaaaattaatacatctgatcacatacagatgcagatggtgagaagatttgttccttaaaagtttattgaaccattatcagttggcagacaaagatgaataagactcagaccaacccttacaagaagtccagtgggggagatatttacataaagaaataactattatacaatctgaaagccaggccagatagtctctaacctgaactatgaactacagtgaatgtaccatgaacaccacccatcactgaaactttgataggcccttaaatccctgacaaggaaactactaaatctgtggttttgtgcatacaatccctgttatgaattgaattgtatccccaccaacattgatatgttgcaagccctaacccccaaagcgactgtatttggagacagggcctttaaggagataattcagattaaaagaggtcgtaagggtgtggccctgatccaataggaccggtgtcttcataagaagaggaagagacaccagagctcacgttctcattctctctctctctctctctctctctctctctctccctcttcttctccctctctctctttcttctctctcacacaggaggaaaggccatgtgaagacacagtgaaaacgtggccgttggtaagccaggaagagaggcctcaccagaaactaaccctgattttggacttccaacctccagaactgggagaacaaaaatttctgttgcttaagccatccagtctatagtattttgttatggcagcctgagcaaactaagacagttccctatgattcctctacttcttgttagacaatgttccttgttatcctcaaataattccattcctagaggatgctaatggccatgtttctggccaccggaacacttttgtgtcggtatttggaaaacccttgaaatcattcccaaatgcctcccatagctttagccaacaagtactgtcttaaacatgattacatctactgcttattaaaagtaagtggcacgatggcagtttagggaagaagaggggggtgttaccaagctcttattattgaactcatctacattaaacaagaccccagcatgcagtagaaggatctatatagtgtgatggaaacacaaccaaaagaacagctagctccacttgggtaggaggctgggtgaagacaagggtgtatccaaaaaagcttaaggaaggcaccttaatgaataaatatgatttgctgacagggaaggaagacagaggaggtacaggtgtgcaaaggtgtggatgtgcaaagaacctgatatgttactgaccagagtgtggggtaaaagaggaacagtggcaggctttagggttgatgttgggcttgcctgcatggcaaaaaatgctattcaaagccagtctcacacttgctagccacatgcaaagcccatttctacatgcaacttgggggtgagcatgatcatcgctgcctaacctcctcatgggattgttattaggatcaaatgaggtagtacatgagaaaatgtcctctaaccagacaaccctacatagatgttttcattaagaaatgtttcacgatgacaagatggagtagttgataattttcttttaaccttaagatccttggtaattatgcacacacacacattcacccaaaattctagaaatatcttagtcctagtagtcgattagatgacagcagtttccccaatgtgtctgaccataagaatcaccggagatgcctattaaaaaaaatagtcccagatccctttcctaaggatataatacattcagggtggggacctgcaaatctagattttaacaagtacctatcaattcttaggaactggtggcaagcactggcctcaggtgaaatcactagtgtcacataccttgacctcaccctgtgatctgctgttgggaatgtgagttgtcattttccctataaaccctcttttctctttttatcctcctgttggctttcttacaggttatgttgctgtttattgctagtttgggggaccaatataagtactatcagtaagacagagtaagattccttgaggaaacactatgtaaaaatgtcaaggtgcagaatggatatttcaatatgccaggaatttgtccatgggtttctcctctgccataaaaattcccagcaaatgaacatatatctctttttctttctcgaaaacaccctctcaattctgcttcttgacaaggtgtatggatagtttctgaaattgccaacaattaagtagcaggaaagaagtcttgaaaagaatacaagtttactgctagttcagtcttagctacttactctgcttaaagacaggcagatccttccacactccccctaactacctgctaaccaagtctccgttcgggttacatctgccccgtggcaaggaccacatttcacacaagacacagagccagacacaaattcagggtttcgacaaaaaaaaatattgaatcttgtttatctgctccataattctccatctgctgtgctcatggccaaatgctcatgtgtgcatttctgcctttttggaccttaaaagaaaacaagcaacaaacctccacaaccagagaacgataagtagaggcagtgtctgacaagattttcatgttaaatcaggagtagtcaatcaacagctgaacagttaagattccggggaacaaacccaacacagtagttaatgcaccactacttagtcactttaagggaacataatgaggtgagcagagtctcccagttgcgagtgtacggaatacatacattctgttgcattcactccgtcctcacacttctgaagaaaggcaagcattccaagctatggctggaatgttaccaaggagaggcatcccaaaaaagcttccagagaagggcgccagcacagtcctcagcagggagtggtgcctctgggactaatgctgctaaaagctactttatagagaattgtcaaggcacagaatccccaggagccattaggaagaagaggctgagctatcattataactcttccaatactgaagtcacatatatgcatacatatgcacctaggtacatatgcatacctatctacactcaggcatgcatgcatagagacacatgttgagtcatacacaaaccccttctacttcccgtggaataaaaaagcagctgttctccacatcccaaagccttgctatatggacatctctagctcaactgtgccatgtggctactgagacatcgccttcacaattatgaatttaagcatcatgggatttcaaactagaacttcacagataacgtgctttgcttcaactgaagctgtgtgtttgtatggatataattactgaatggaatgcataatgattcttgagcaagtaatatttattttttaaatattatgactgcttcttctttttttctctccacactcccaaaaacattcccagagagcactttggcactcctttttgttggaattttaatgagatcctgctgttttatttttccccaggtaaacacttaacctaagaaaaaatattggggaaaagatatatctaaatactatattatatgatgtttaaggcaaagaatattctaattacaatattcttgctcataagtattaaggacatatattctgttgttcattaatttggcaaccatcataacttttgcagcttttgtcttaacttaaataaggcttagaagcaaagtcctacctgcacaagagcagagtcccaagccttggcatatacagatatttctttttaaagtttcacacattttagcactagcatatataacacgagtgctttgtgtacagtagggtacagagttgaataaatacaaaattgtaacaagggtcaaaattgagaaaaacaaatagtggtaggaaaaaaggagattcagataccatgaaatcattgatcatcatcccctaaagaaatttaaattcctaagagaggtatgcagtctttttagcttcaattgctagaattttcttagcatgcttagcagctgcaaaatgattgtcagtgctgcagatattggtgcagtgcctctggtagattcagaagacagaaggacacttcctgggccaaatttaccaaaagcacaagtgggatttgttgttcagatgggacctgtccttgccttcaaaatcaccaacaactagccccctactacctttccaggagtgttgacggctgccttctagaggtgaatgtctgccaagctgatgacacttgacccctctaagatagaaatggggaacagaaagaccccttgatcttataaattttgtagctgaacttgctaacccttggaactgaaatctaatcagccgaaagccactttctctacccacatcccctatcggcacatccaataaaatattctgtttttattctcaccctgaaaacaaactgggaaaataccagacttccaaaaataaaatgctaaatcaaatatgtactagggatagttattctcaaactttgaagtagagtcaaaattccactagggggagcaagatggtaatttgttacctgggaggtaaaagcaaaggttcaggatgtgtaattaaggaagtaaggtaattgaaaaatccacttcattaaaaacataaaagaactcaagcttctgaaagagttcttagtcataagtaaacatgcacaccatgcacatactaaaacaaacaaacaaaaaaacaccaaacacaaaaaattcctattgatccctgaggatccaggttttagaaataagaataaaactatctaaaacctacgtgctaaggtatcattttcatcatctgtgaaatccaattcaattattatgtcaattccatgaaaaaaatatgctactgatgtcatcagacacaccctccatttaagaatgaagcccatcatgggttctacaaagagagccaagctagtttagagtatccactccatccggctatgaagtcatcaatgccctcccacatcccgcaaaatcccctaatgaaaccaccattttgatttttgctaaaaccactgtatagtatatttcactttccctttgccagagttgcatgctctgtactaatgaattggctttggaagataggcagagtgacagaggctgtcattgagcattggtaactacagtcaatggtaataagcccaagcagcatccagggatgctccagcatttcattctagatcctggtgtgttgcttgtgtttttctgattagatcgggaaaataaagactccaagtctaaaagaaaaacattttgcattccaatcagaaatgggtgttgggaatcaatcaatagccaagaaggaaaatttgatattcctaaacatctgtccctccttgagcattctgagtacatatgtcattaaagtaagatgggagtgtgttatcagtagctgatagctgatacagcaataatctagccatatgaagccatcaacttatatgaacaagctgaaacacttcgttaggtaacaactgttttttgtaggagccagtgcttgcacttttgtgaaaggataataaaaatttgttcaagtcactagatttaatgaacaaaacctgctaactgaattcatgtgagttctgctgtatgatctcctgcaaggatttcattgagttcttcctgaatatagatcaccctttacttgagaagttcactccatcccagaaagataatgattatcataaaatcaaaatctgttcctcttaagtaccataaggacaatacaaaaatatactgagtccttataaatacattttttaaaaaatcagggagtgaggcaggactgcatgtctgaaaatgtctcctacaggctatgctgcagagtaaatatatataatattttccattactattaaaaacagaaaaaacataaaattccatgttatagtcatgccctccaagtagcatatttgttaactctatatttaacattatgaaaaaagaattacatctaattagaaaatggagaaaattaatttattacctaatcttttcccaatgaaaataacacatgggtactgactatgaaatagttactcaaggaccaactaccccaattacccaatttttggaacatttaatcctttgttgctccttcctttcctgagattctctttgggtgtttctctgctctttaataccactagttatcaccctcacccgatggccaacccaaagtaaaacaaaattcaactttgttaccagttacagacaaaaagttgggccaaaggaagtgatggaataacagtatcagttaaattgaaatctggaggcaatgttaatttttattgattaaaatgttaatttttattgacctcctttttttccatagtagaaagattaatgctatggtatcagactgaccaattattaaatccaatccatttccgtttcagttttctcatctctaagatggggttacaatagccattttatagatgtgtttaaaaaataacgtaacggccaggcgcggtggctcacacctgtaatcccagcactttgggaggccgaggagggtggatcacgaggtcaggagatcgagaccatcctggctaacacggtgaaaccccgtctctactaaaaatacaaaaaaaacttagccgggcctggtggcggtcgcccgtagtcccagctgctcaggaggctgaggcaggagaatggcgtgaacccgggaggcagagcttgcagtgagccgagatcgcgccactgcactccagcctgggcaacagagagggactccatctcaaaaaataaataaatacataaataaataataaaaaataacacaacatatgcaacacccccagcacggggccagatgcctggtgtgcacgcaataaaaacagggatgattgtttaccttaacaagctcaaaaaccttcatagacaagtacctttatgtgcatcctaaaaaaggaaaaataagagatcttgaaagatttcctaaaatactacagagtaaataaattgagttaggattataacccactcaacaccacctctaaagcagaggggcccatcatattgggagagaagcttttacaggcctgggagcaaaaatcaaactgagcatgacttggcctttgttacactcagcaacctcgaaattgtcacacagtccctctgtactcagaagtctaatctataaagccaataactcactgaactaatacatcatttcttcttgactaatcaaaaggtaactgcatatattcatgccagcttaatgggacctgagattgtaattttactacttaaggttgtcataaatacatgtagttacacctttcttttgtgatctcctgatagacacaaaggaaatgaattccctgtttggagctgtgacgaagtctaatgatttgcctgttagtgacaaagttgagactagaacttagttttcctgattctcgcagcttggtactttctctcacatgtaatataatatatatataattcatgatcagaattcagcttcagtttcaacatacctcctatggagaaatattatacactaaggaaaaagctgccatatatgagatacattctctctatacgtatgcatatatatttacacaaatagtggccaaatgcatatacatagatagatagatagatatagatataattccttgcaacaaaatggctaacaataaaataatcttaccaaaagacagaaaacaaagggctacagtctttcaaagttgagggggctccgcatgggtctgagttataaagatgaagaaggtaggcactaagcagaattttgaaggatgagactggggactggagagtaaatctttcatgttggaaaataatagaagatgaagttagaaaaatgaataactgggtggggggagcatcacatcagcataagaagctttaacctaatctttttggtgcaatcatatagctcattaccacctcaaactcttgggctcaagcgatgctcccacctcagcctcccaagtaattcagactatgggcacaggccactgttaaacctggtgaatttttaatatttttttgtggagacagggtctcgctatgttgcccaggctgctcttgaacccctggcctcaagcaattcttctgcctcagcctcccaaagagctgggattacagtcatgagcactgtacccagcctttacctaatcttatggacaaacaggaatgggggtcatgagcaggagaaaggaatagagttttcccaagaatttaatctggccaaagtgtacactgagtactggagaaggagagattggagttagaggcccagttagaaggctgttgctacaatccaagccatcacaggaaagaactttcccatcttttttttaatcacagtctccccaggtgctacttacagggatacggtgaaaacaacagatatagtttttggttctttaatgtctgctctattcctggatgcaattttggcccagcatcttggccactttccttcactctttatatatagcccaaatcccttgcctccgaaacactaatgtttccaggtgaaactgaggttacttcctttagttctggaacatttccattttttcccccacagaacctctgcggatgtaagctctgttttgtcagacttgtcacttgatcgctgaatttaaatcataacatttcaaaaataggccacatccataaagagaaaggcaaatcaaaacaaggcagacagcctttgccaagtgccatatttctatcaggatctgctgccaactacccacagattttttcactctgtctagtttcaaatggcttgagatcaaacctaaactttagctaagataattaaattgtgttggggagttaacttttaaagaaagctaatttgggcaaaaaggacaatggatccaggaggttagttcatacagaacatttaaatccatgtaattttagtgaaacaaaaagaacaactatatatacttctgcaacagtttcctgttttgaaaaattggtatagaggttttatttctcatcttggcttgggttacattctttgtataactgtatcttactgcatattgaattcatgtagttgcaaacatgagaggtggatttaataatgttaatcaatataaaccactttagtgatctttgtggggaaaaaagaaaaatggccagaagatgattttcagggttgtaggtatattcagtataatttatttgtctgttcaaatagagacagcagttcagttttagggtgcactggaaaacatgactttttattactacctggtatgtgcatcacttataaaaaagacaacaataaaaaagtattccttataaaaaatagcagaaaatgatccataactacagaagtatcttcttgtggtcatgagtaattttaatttttgagaatctcacaaattggaagctaaataaagcaattcaagtgtcctttaaaaacaacaacaaaatcagcatgtagaaatgaaaggtactctcagaaaggtggcaatctcctgctacatttgaggaggctggaactactgtatacaagatatatggattaactcagtcacattaaatcattcatgatttaggcaactccagattgggtttgtctaaaatctgttagcacctgggttctttccaaacaccagcaagcaatttttacacaatcaggtctttccaaagcccatgacaattttcctttaaaccctctccttcccttctactgttcttttctttgaattccacgtgcattcttggaaagacagcaagcagttaaactctcaccacctctccacaggtgagggactagggacatgtgtaaaacggagtcaccttcctgttctggccattgtcaattttttttttcctaaggcatcttgttatagcaaccattctaaaattgttatagcaaccattctaaaatttaaggcagtgggttgatcaggacctgaattagtttctgcctgagatgactggaaggtcccctactccctccccagccagaaaaagtcacatggaatgaaaatctattagagaatcccctcagtgtagtctttcaggaagcatcttctcatttccccatccaaaatcatggtaaggacatccagtgacagatgtcaaagggaaaggataaggcagcaggaagagagaggagcctaagagactggaaaacattcgataatataaaatgggaaaatgggaaattctgcaaaaaaaaagaagtcatatcatatttcctttcacagacaccaacccagtgcgtagctcctttatttctttacacactaccccctccaacaggggataaaagatatgttttctaaaacttaatttggtacatttcagataaccacattcaattcaacaaagatgtattaagcataagacatttactgagcataagaaattcagacactggaggccgggcgcagtagctcatgcttgtaatcccaacactttgggagaccaaggcaggcggatcacttgaatccaggagttccagaccagcctagacacatggtgaaaccacatctccactaaaaatgcaaaaattagctgggcacggtggcgcacacctgtagtcccagcgactcgggaggctgaggtgggagaaccaactgagcccaggaaattgaggctgcagtgagccatgctcacaccattgcactccagcctgggtgacagagtgaaatcctgtctcaaaaaaaaaaaaaaaaaaaaagaaagaaagaaacacagaaaaagaaaaagaaagaaagaaattcagacactggaatgtcagagtcagtctctcccttgatgaggttaccaaggtgtaacaggaagtatacaaatacgcacagctagaatgtaaggcacaggccgcaggagaagtgcatggagaagggagagaaattgtacctggcctcctgaaagacgcagcctctgaaatgaatattgaagactggggaggatttaaacaggtagagacggatggaatggtaagggactttcccttcttcatattcagaaggctgtgagcagaagctagggagcctgaacatacacagggaacagtttcatttggctggaggaggggagaagtgaggtaagctgagtagtagacagggatcctatcatggaaggtcttgaataccaagctaagaaatttgagctctcttctgtggaactgggggagcagtgggtggtttttgagcaggggagtgacctaagatttgtgctttagaacaatcactctaaaaatggattgtatgatgacctggaggaaaaggctggagtgtcataacaagttaggaaactgcaataatagtctgcacaaagggctctggggatggagtaccgctcagttgtcagaggaagcattcttctggtggtaatatgtgaatctaaaaggtaaatttgaccgggcatggtggctcacgtctgtaatcccagcactttgggaggccgaggcaggtggatcacctgaggccaggagtttgagaccagcctggccaacatggtgaaaccccgtctctactaaaaatacaaaaaattagccaggcatggtggcgtgcccctgtaatcccagctactcgggaggctgaagcaggtgaatcgcttgagcccgggaggtggaggttgcagtgagctgaaatcgtgctactgcactccagcctgggcgacagcaagactccatctcgaaaaataaaaaataaaataaaataaaataaaatgtaaatctagctccacctttaatgtagcaagggctagcctcctcaggagtggctgcctacattcaaaacgattctcaccaacttcttccacaggacacagggctcgggagcagcgccagcccgacatcggcggaggagcaccggaagttctgcagcactggctttctttgctcttccacctatgcaagctccttctctcttgtggcttgccgagcctggttagctctgagaccggaagttctgaagtcagctggcatcctacatctgtgcaacctacttctctccccatcccaccacagaaaccagagcctcgaggcttttggcttgggtgctgccttcacagtttaggttttggtaagaagaaagcttatcttcatgtcatgagaaagaaaaaaaaatgtatctttacgtaacgagctgaaagaacaaaacaagtatacctaagccaagtacatgctatctttatttctttatttccacactgaaatttagtcagggataaaacttacttttttaatcacacgaagtttgaaaaataggaagtactatgggaaacacctaatgcatcaaaacccctgtgcattttatctttgtcttatgtttgctggattttaatcttagtaggtttcctgttgcaacaatacaaaaacagataaagaaaaaacttaataacctttcctaccacaaatgtgaacagcccgtgttcttgttggtaggtacagatacagatatatgagattatcgttatttattatcagaaaatgggattttactatttcccacacacacactttttttgagatgggggtcttgctatattgtccagggtggtctcaaattcttgggttcaagcgatcctcccacccaagtatctgtaatccaagtagtctggattacagatgcataccaccatgcctggcttatttccctctcttacaatttgcaaaaataatgatgtactgaggacatcccccaggtcgatagctacaggattaaatcatttctcttaataactatatataatactattccattgtatggatatgccataacatattcaattattccccttcgaatgggcatttgggttgtttctagtttgtaccacaacaaacaagcctctatcagtgcttatccacattgcacagagaagtgctaccagagccaaaagcattttctgagtacctacaatatgctatttttatgaaatatacaaaagaaatgtgtgacatagtcctttcctaaaagactgccaaatatagttggggaaataagcctaacccacacaaaacacttaaactgtgtaagacagtactgaaccatgttctacagacctcatgcaaatggatgccaagttgtccttctgcacaatgacagattggagaggtaatctggaggtgcctttagccataatattctaggagccttcttgattcagaaaaggggaagcatgaaaggctaagaagccagagtggtgtctctggaggaggcaggacttgaacaaggcctgaacatggtttagatggaggaaggaaaaaaatgtattttggaatgacaaatgaggcagggcacagcactgactttagacatgtatatgctcaggagaatgtcctgagttacagcatttctaaacaccctcttctcatactcctcccaccaccaccactcgccagactctgcttaaagatataaaaaattcccaagcttggctgctgcagaacatcacactaacactaatttaaaatgcactacttccagacagcacgagcttgaaattacctccaaatctcttccttccctgtccttctcatgccctatgctaccccctgccaaaacacatacaacgcttgctgtgcccttcaaacaacagtagtcatttaagctgctcctgcccatctggaaaataatatgaataacatgaaagaaagcaataatgaagtgactggaatttagcaaccaaaaagacctcagttcttttgataatcaaaaactttgttaaaatgtttacatcgacagtcactacagtgttggtctttcactctatgttgcaatagtatgtttgcaacttctccaaatccatttaaatgaaaatatttaataacaagttttaaattttatcaattgttaaatatgatttgaaagtttagtgtatgtcctgatatatagtatgccttgagactgaatataagtagctctatgggaaaattctgaaaatgaattaggaataagtagattaatgtgcttttagtctcaaagactagagattaaaaaggcatgggtaatttttaactgagaggtggtgccacagagaagtctatgattctctctttttcattacccatcccagtttaaaattagcttgcagcatgttttttaaacattaggaaaacaagatgcactcccagaatgttcatgtgaagggcacgtgtgaagacataatcttgacagtcatattacagaaaataagggagtgagttactgagtttttaacaaggagagtaagttactgagtttaaataaaacctaatttgctgtgtgtttttatttagcagaattttgaatgcccgttgcctccgtggcactaggcaaccacaaaggcaactgaggtctgagacaaggcatcagggagataggatcctttggcctcctctggcccaactgacataactgaggttggttcctttcctggtatccacactcccctctcctcaccaacaatccccctgacgttggctctgaatgatgtggagaccctgttagtgtcgtcgcatgttaaatctagatttgggaatctgcactgcacaccttatgtcaaaactcagagctgttgtttttatattttgtttttgtgttttgtgtttttatttcagatgcaggggatacatgtgcaggtttgttacacaggtatactgtgtgatgctaaggtttgggcttctaatgatcccatcgcccaagtagtgaacatagtgccccataggtagtttttaatctcttgccctcctcccatcctgcccccttttgggattcacagtgtttactattcccatctttgtgtccttgtgtacccaatgctcagctcccacttgtaagaacattcatagccactgttacctcatcaccatgtaacattccaagggtttaaaatgcacaatacaatcatagttcttttgagatcatggttgactgtcctgacaaaggagaacttttagctgcccctcctccacccagggatagaagtggacttggtgaaaggcaggtggcctgtgacagcagtggcctgcccaggcacgcagaggcttgctctcacttttagagtacttggtacatttggcactgtgcagcaactttttgcttcttgaattgtgaccaatcaaaaatgatgaaacaaggccattgaagggagtggaaagaaattaactgatgcgccaggagtcctggtctacccttgatcagtaggtgttacataacggagggcaagtcacagagcaggcagaaacctctgttttcttaccagaaaagataggtccaaaatgatcgactcctccaagaacaataagggaaaagatgagatttcagatggaaaaaaaaaaaacccaataaggggtggtctaggtgactataatctcactctgccagaagagctagacgaccaagcttgatgcacacagcaggggaagtagcaggaccaagctgctcagaactggtcagagtagtggacaatttcgtgcagatcttacaggcctcttttttgttttttgtttgttttaagatagggtcttgctctgtcccccaggctggagtgcagtggcataaccacagttcactgcaagctcgacctccctggggtcaggtgagcctcccccatcagcctcccaaatagctgggactacaggtgtgcaccaccacacccagctaatttttctaaaaaatttttgtagagagggggtctcgtcatgttggacaggctggtcttgaactcctgggctcaagtgatccacccgccttagcctcctaaagtgctgggattacaggtgtgagccaccacgcctggccttttttttttttaagacctaaatggatgcagaagaaatttggctgatgttttttggctggattgcatatcaaaatcccctgggaaactaggtcccaccccaataagcctgaggtagtgttagggatgcaaatcctagcacaagcgcttgcaaaggctctccaggtgactcatacagcttcaacatacatgcagcactgaatctgattcttcatctcaataccttcgaaatcctactcctttgaccccacagtccctcttcagggaggctgtcctatagaaataatgagatatacagacaatttttgtataaagatgttcataacaacactatttatgacaggaaaaattaaaagggaaccaatgtcaaagctagggaaattattgagcaagttataatatataaaccaaaaaagatatacaaatggccaaaaagcacatgaaaagatgcttaacatcagtctttagagaatataaatctctaagaactacttcaccatttctggtgtgtgtgagataccatttcacacacactagatggctaaaacaaaacaaacaaacgaaacccagaaaacagtgttgggaagaatgtgaagaaattggaacattgctgattggaatgtataatagtgcagctgctgtggaattttatttagctatttagcttggtagttcctcaataagttaaacatggaattaccatataattcagaaattccactgctatgtgtatatcccaaagaactgaaaataggtgttgaagcaaaaacgtgtacctaaatgtccacagcagtactattcacaacagtcaaaaggtagaaacaacccaagtgtccaccaaccggcatcaactgatgaatggataaaccaaatgtggtacagccgtagagtaaaatattactcagccatgaaaaggaacagcgtataatgatagatgctacaacatggatgaaccttggaaacattatgctaagtgcaagaagccagacacaaaaggccacaggctgtatgattccatttatatgaaatagccacacatagaaacagaaagctgattagcagttaccagggatcgggagggaacgggaagtgactgcttcatggatacagagtttcatttggggtggtgaaaatgttctggaattagtaataatggctgcacaacactgtgaatgtaccttttaaaatggttaaaatggtaaatatcatgttaggtgtattttgccacaataaaaaaaattatgatacataaaacagaatattttacttattaaaattggccttttgagggagtttaatgagatgaggaaaatgtggaaaaaaagcagtctatgaaactatatacagtttgatctcagcttcatagcatataaatatgcacagaaaaacaaggactagaagaaaatttataaaaatgctaaacagggttattggcagatacactttctttttttgtaatttccaaattttctataatattatgtttattattattgttaactatcatttttgtaaacataaaaagaaaaattttctttaaagatgggaccactgacactttgcatcacagctaggaaaagaaaatgagaataacgaagggtctggaaacatgtgacataatgattcaggtagggggctagacaagagcatagagtggtgaaggctgcaacaatctggagaatttatgtcctgtccaaagataaaattgtggctccagatcttttgagttttcaagagatgccagagctccagacgtttcagtgaaatgccctgatttttaaatgttggcaacttattcaatatttttcaaacaccacaggccaaacaaaacacatctgtggaccggatgtagcccgcaggctccagttagcaaattctagtttataagaacaggaatgtttaggctggaaaagaaaaacctttgaagggatatagtactagtaacatcaagtatctgaaaaatgactatgtggaagatggtgtaggttaattcatgtgtctctagaaggcagaacccgatctaaaggctgggtgttatcagagaagcagaatggggcacagtctataagggagaggtctctattagagcagctgtccagcaagaaacagcttcaaaatgcagcgagctgcccatccctgatgtgctccagcaaaggctacataaccaggattcctgctttgggtcagaagttggactaggtcaaaagctcccaattgtggctgcacattagaaacttgaaacaaagcatacagactcctggaccctgtcccagaaccacagagtaaggtccaggagtgtgtatttttaaaaagcatcccctttgggtatatacccagtaatagtattgctgggtcaaatgttatttctggttctagatgatttagaaccacttaatctttgactgtaacactggaattctagtattctgatccatggttttacccacctggccagtaaggaagggaaggagggattgaggaaaggaagaacaatgtaccagagctcattatggagcaggccctgtgctgctttccttatgtcatctcactgtatttttcagaacaacctggtgagttgcgaagtgatgtcctccaccccatttccctgagaaagaaactggggcttggggagtttggggatggcccaaggtgactgccagtcactgggaagatctttccagctccagatcccatgctagttcaactatgccatattgccctcttcttgcccactcaacaatcatttctccaagtgccgatggtgggccaggcaatgcattaggtggcaaggattctgcaatgatcaagatacagtcccaggctcaagaagcttcgaatctagagaggaggaagaaaagtaaacagtgacatcacggtggaagcaacagggtcatatgggagggacacccaacccagccttgtgtcatcagggaaggcttcagagaggaggtgacagctaagctggggaaaagagattcctaggtgaaggtgtaacatctacagagacccaaagatcagagggagcctaagcctaccaggtgtggggaaatgtgactagttcagaggctggagtgtgggatgcaaggagtgaaattgtaaggtggggctggccacgctgagactttgtcactaacctcagagaaacaggaagcaagtaagactgaacagaagggggtgacatatgcagatgcacattttagtagctcagactggctgcggagaggagaatggattggcggagagaacacaagggaggctgtggcagtcattcagctaagaggggatgacaagccacacaaaagtggtggcacgacagaagatgtgcagcatagagatgatgttttttcactcattctttcagtaaataatattacagagcccttcttatgtgctggccattctgcctaggctggacatacaagcatgggtgaaaacaaacatagtctctgctgccgtgaagttcacactgttagcgctctgctagggaaaagatgtttagggaagtaatttcaaaagtattaaataaggcaaggcgtagtggctcgtgcctgtaatcccagcactttgggaggtagaggtgggcggatcacctgaggtcaggagtttgagaccagcctggccaatatggcaaaacccatctctactaaaaatacaaaaatcggccaggcatggtggcacacgcctgtaatcccagctactcgggaggctgaggtaggagaatggcttgaacctgggaggcagaggtaggagaatggcttgaacctgggaggcagagattgcagtgagccgacatggcgccactacactccagcctgagcgacagagcgagactcctccgtctcaaaacaaacaaacaaaaagcattttggttgattatgttatcaataataacatagtagggaaaggatgtacaggactggctcctccatcatcaattgtcaaagagtcattaagcataggagtcacataagataaatctaaagagttattgcaaggccagtactctttagaattacgtccctcatgttcatacataacagtgtcaatcagactgtctgctctcagtgtatttcattcaaggaaagtaagaaaaatttacctacattttaattcatcattctttgaagagaagtgatggatttaaaaatcgtgataagattttaagctaataaattaggaacattctcaaaaacttactaaatgtggccgtgcactaaattaaattaaaactcttcttgtggcatttgagattgttgctaggtgctgaagaagcaagtttggatctaccccaaaattggccacagagcaagcaactggaaaatcatggcatggagggaagggggcaggtgtctgaaaactgtgctatcaatttattcaataactccattcaggttgcagtcctagttcaccaatgaggccaggacgttcttaccagagtcctcattgtttaaatcacagccacaacattcttttaattcttttagtctatcccagtgtaataatcacccatgattaaacagctgtgcctgcggatggcacattaagctgcttctcttttagaggtgatttttattttttgccacctctcagatgacccctctgatttttatcattctggcatctcaaaggccagcagagaaaaacatatattagaaaatgaaaatgttcccttccctttctgtttttctcttgaaacactactcttaacaccagctcaccactgatctcaaatcactgagaaagatcctcttctcgtttcttcctttgccatggtgctctttcatgagattatgatagacctttccccagtccaccaggaaaagggagcacacaccccagattggtagcactgagtcaaaatctgcttgcccagaaatgttatagaaaaaaggaaatcatgccccatatgggttgaataatcccaaccttaacatttggcaactcaaagaaaaacagaaatgaggaagacacatacgagttcttacaagccagcctctaacacaaccagctttttaaaaatgtactggattcctaaaagtaaaattctaaagtcttcctcccccttctataaattgtacagccaggaaagaagaggcgacaccaaatggtgacagggagttttgttgctattattgggctgttggttttatcgtagtattacatagtattgatgaacttttaaaaaatcactttcctcgaactttctaaatatgttactgtcaatgctcaaagagaggtctgagatttgttacgtattttagacatcttctaagtaactccacagaagactctcaaaacaaaagcgtgacctcaacctgcctataggtgccctagtggagaatgcttgataccaggtgacaacccccacgcgccccaatagtgcaagaacaaagtggaggccagagaaggggctggtagtttcttcttagttctcagaaggcttatatgatgatccactcacctctccttccaccttaagggaagaatggaagataataagcaaaacttctagaaagagcaattagcccttcaacttctaatatccaggtggttcagttcccagtgagagaggtaagtgggcaatggtaagctgtgccacacaccaggtatcttatttttcaagaatagctttcttggccagaagcagtgtggctcacacctgtaatcccaatcccagcactttgggaggccgaggagggcagatcacgaggtcaggagattgagaccattctggctaacatggtgaaaccccgtctctactaaaaatacaaaaaattagccgagcgtggtggtgggcgcctatagtcccagctactcgggaggctgaggcaggagaatggtgtgaacctgggaggcagagcttgcagtgagccgagattgtaccactgcactgcaggctgggcgacagagcgagactctgtctcaaaaaaataaaaaataaaaaataaaaaaaagaatagctttctctttaatgctttcacatgggttctaatggtaagcttggagaagaataacctgaaatcccatgtaagtgccccattttctccaggctatttgtctgcctctctcagaacatagtgtgattcatccattaggctatctggaaaataggcatttagaataaaggcaaaggggatataacaggcaagactattagaggtagctctaagctttgctttgtgccgctcaagtgattcatgaatgcaattcatttccttgcctacagttcacattctcatggctgttcagagatgaaaagacaagacgttctgagtagtttcttcgaatagaccaaatcctgatgctgtttatgagccttgagataaaaaaactctgacttcatagcaactcttaattatgtgaatgtacaccaagaataggataaatataaaatctatagataatcatgaaaaacaagttttagttggcatcctgcttcagccctgctaaatcatttaccagagtaaacctggcttgaaaacactttcaattccccaactgctctcaagtgggagtgcaaatgaacagagaaatggtgggatgggagtcggagaaaggcctgacaaatatgtagtcagagctgccacatccattcctgtgcctttagcagacatcactaatcaagcatgatactcttttccatcttgaataagcacaaccttagactcttcctcagcactcaagcagtccaggcaatcattaccagtcaataacagctggcccatttgccgttccagtttaggagaaatctggatgatccaccagttatgtcatcagttaacttttaatttcatcaagaattaaacattggttgattggtctttcatttaactacttcattttcctctaagaactaggatagtttatggaaattgtcatgaaaagctaaagcacattgcttctaagttctctaagatggacagataagcatgctgtatcagcacacagcacaagattgtcttgtgagtcaggggagcaaagaatcagatgagggtttagcctaacagggagtgaagatatgactgcggctagaagttgagggctgctggggactgggtacttggagacctcacttgggggaatatgggcaaagccaggaaccgcacagagaccacaggaatccactcctactacctaagagacgtcttacagaaattcctttgagttaaagtttcccctgttgaaatcacctctgagtgagtgaggagactatctttcagtcacaccttagtggagaatgtttacttaggttgttttttcttgactcctaaaaaaagaacagcagcaagaggaagttgggtgtttcgaatggagacaaagaaagaaaacaaatgtgatttgaggcctcctaagaaggactgtcttgaatccaatgctgggcttgagatgtgttgagaagcacttattgagctactactgtatggcaagcacttttcatacattatattgcttcctcttcacccctaacagtgagttacgattaacatcttccgtttacagatgagaaaaccaaggctcagtaatgtaagtaacctgactgatgttataaagctagtgaggggctgaggtcccatccagaccaagatttctctgacgccaaagcttgttctgttcccattacactgagctggttcctctgggaaagcatcaaagacacacttggtacactcagaaataaatgttccttaaggccaatgcctatctgactctaacaccttcttccagagattaggaaggaagcaaattgtcctcatgcaaggcaggccttaagagagaaggatcacccccacctgttggaacatcttgtcttggagagattagggggccacgggttgtggactggaatggcatgtgtcatcctccttcggctcagatatcattcctcccttatggagagaggcagcttcaaagggggtcagaaacagaaactgagcacagtgaatgagaggctggagaggcaaatgtcctcctgccacctttgatggggcagaggcatccatgtggggcaggatgtgctctgtttggtggtattggagagggggtgtctagaagctagtcctgtcctgctccatcagtggggtttacctggggatcacacactccctcatagtatgtagacgccactgtgcacctgcatgccgagaaaaggcagcgggccaggaggaccccctgcctcttctctaatcatatcccacccacccctatgccatgacctaggctgcagctgctctctaaggactccttggtcctgcaccctcaatattctgggagatcacaggagttgccctttgggcagatccaaggacacccaggagcagcatcaccagcacacgtgggcagggaaggcatagttcctgccacagaagcagtgacacagggagcaggatacctccagggtgagagacaacccagggatgttgtggggaaatggggagcaggaagagatggcaagtaacacacactcagtgttttctgcatatcccagtgaatcctccaactatccccattctgcagaaaatttcaataacttagccaaggagccaggatcaaccaggtacttccaccaaagtacctgtaacagaagacaagagtgaacgtctttccctacatgtctgcctgaaaaatacgtttttaacttaacattcacatgaattttacagtctagtgctgccttaagatatccatgttcatttcaatggaaaaataatgtctttagttaactaacttaaaaaaattaaccatctgtgaaatcacgctaatcccatgagtacatttctcaggggtaccacctcgaggggcacaagaatcttgggccaagtcagggccacaccatcctgctgccccaggcaccatgagatgctccttcttttcccaacttggaggttccaggtgttcattaggagatgcagcaggttataaaccataactcagagaagaggaatagtggggggcagcaagcaggagacgacgcagcacaaagaagccccaagaaaggtgatcgacagatccagaccaacagagccaaaggaacacaagcacctcgggactccaatcactttgccctcctcaggtttgtgaccaacactccggtgatgaagggctagtaatcaacagtaagctcatgcacgggaattcccttcactgagcctctctctctctctcagtctctctctctctcacacacacacacacacacacaccccacagcaccactttgggggaaggagaggagatattgcagagctagagttttggaactggaacaaggagggactttctggtggatcaaagtatgctagagatcaggcagtactagagccaagagtttgcaaccaggcagatagggatccagtgggagcacactggcaccaaacacgaaagtcatctggcctctgaaactggcttttatgagccagtaagtgtgtgagcttagatcatggataattttcaaagaaaccacttgtatcacacagtccctattcgagaacccaaaatgcttctgcactaaatatttgaacccctatgtatttaatggttatctagtcagtccattgttgcctagacaaaggcaaattctcaggaatctaccaagaccataagttttagaagggcagggattcggtcactgtggtcaccactatatccctaactgctagcacatagtaggccctcaataaatctctgctcatgattcattcacattcattcaaaataacacatttgttcaccctgcctcttccactctccttttatagggagtattaaccaaaaaggttattgcaggctctcacagaagaacttctacatgagtaaaaattctgcatcacagcaactgcagtggtgtcatgtcagacatgtttttgctcaaaagaattcagttaacacccacaaggaagggaggtggacacgtacacacacaaacacacacttcaatcaggaactcggtgatcacatgcccacggtgagagagaaaaaaggaaacacgaccccacagcttcctctgcatctcattccagaaagcttttcacagtgtgaacatctcacagagctgactgggattctagtgtttaaagaaacatatttttcatacaagttggcccctaaatgcaagccaacttcttatctggtgctcaaagaaacagcaatgcggctccaactctgcaggccaaagtggctgtgttggcctccacaagggatagtatacaggcctccatggtggcaccttccaaagagattttcaagagtaattttgactctacaagacttctacctcacacatataggggcttagccacccagcgagctatgacccctctaacacagtctggtatatcacccaaacaaggttagcctgaaggaaggagaagttctcaaaggagagcattatacatcttgttacacaagcggtctataaagtaagtctgtttaatgtagacaatgttatttttggcatatcatcttccaaccagttttctggttttcaaaataatatctacgaggtgattactccagagagcccacttggaatttttctgattttttttctaatttatttcagcacatgttatttcaagatctctatgaaacatattaaacacatttaaccttacctaaaataaaaccaactcattagatgatataaaaaacatctcattagcaaagcactgataaatattttctctcttccagctaagcattgctcattatacacttgagcactgtgcagtcttatcatgccacaattatcagcctcatacgctgagcctaagcataaaactattattgagcaaataatggaattggacctgtacactgctaagctcctgtagactggctcatacaatctggccgatttatatagccagtttgaaccaactgcacgttttcataaacaggcaattctcacacttttaatgatctgatttattagaccttctaagtaaacaagcttagaactctttctctttttaaaaaggtacatacagcaactttaagatattatatgtgtatgtatcttggcaatactacagcacctttaagagggtatatgtatctttgggaagatagactgttttctaaagcatagtctaggtttctctaatgctatgtgaattttagaatcactttaaggcaatcaagtcactttggagacaaagaaagaataagatgaaggtagcaactgaaaagcaacctcagataagctatagctattttcatattctttacccccataatttttgtgggaaattactataaggaaatgatcagagatgagcacaaagatttatgttcagggtgtatattagggtgttggttattatagaaaaaaaaccaaaagcttcttaattgtccaatctcagggacataataaaatatggcacatcaaaatgatgggatattatgcagctattaaaaatgtcatttcaaataatttttaaagacttggagaaatatttatcatatagcattaagtgacaatttaaaaaaaacagtaaacaaaactatatccaaggcctagcctagtgtctggcacctggcaaacatgcaaaaagaattttgttgcattaagtaacatatacaatgagatagcaagtctatattttaagtaaatatgtacatacatacataaagaggaagagtaagagaaaaaagaccaagtcagtagtatttatgtcttagtgattagattacaagttattttctccttttttcttttgctcatctgtatataccacatcttacagttaatacctatcactgatatagttgggaaagaaaagaaatgctataaaaactaaatgtgaaaacacacatttacatgaaattgcattttaaatggaattttaaaagagtaattagaacacagaagcctgccaatcccagcagcaacaacagaagcaaagtcttgaattggaaggtcacatatgcctgttcccaaatagatgctccaaggcaggccaaactggaattctgggactagaagaacagctggatttttttgtttttgttttgttttttttgagacagagtctcactctgtcacccaggctagaatgcagtggcacaatttccactcactacaacctctgcctccagggttcaagtgattctcatgcctcagcctcccgagtagctgggattatacgcacaccaccatacctggctagtatttgtatttttagtagagacagggttttgccatgttggccaggctggtctcgaactcctggcctcacatgatcctcccggctcagcctcccaaagtgctgggattacaggagtcagccaccatgccaggccagaacagctgtatttttaaagcaagtatatgcttcatttttcactttgcatcagaatcttctgtgttgagatgatgtataaaatctaagccaaattgaactagttttaattcatactgtttactgaacaacattagcccaatttttcaactgaagatttttcttgcttttggtagagaaaaggctattttgcatgtcattggctaggcttcagaaaccaaaggttttggccgcatgaggttctctcagtgcagggggttagaaggtaccaatgcctcagtgtaacatttgaagtgggagagtgtgaggtagtaaatccatgtgtttccaattttcccatccctgaaaccacagattagagaaaatctccgcaaataatttttgatgacctcaaatggcttcaattaaatgaaatcaaatcaaatatttctagttgaatactatgtattgttaataaggatgaaatgtgttcttgatcgaccgagtatctgaaaaaaaactatctggctctttaaatgatatatatttaagccctgtcactaagtagccatttaattaaagtaaatgtctcagcataaatcctgctggcacagggtcatgtaggtttaaaaatcaacctgcaattaggactttcggcctaattatgtggcaacaaacttagctaggagcagtgacatattgagggtctttaaaagctttacacttttgtgccaaaatttatgatgctgtttcctcctcctttccttctcaatttgtatgcaacttcacaaccttgattaacagcagcatctggcagttctcttccaagcagctgtgatgtagaggaaagaacacaaaatttaaagtcaaaccaatcggggttcaaggacttgctctgccccttgctggctccaactatgccctggatgcctgtcttagtaaaaccaagaagacatcacctacctcttctggaggcttgtgaggatcaaaagagtaactcatgtgaagatactgggtacaaagtcgtcattcaaaatgcagtctggtatagttttcaaatattagtgtcctaatgtggaagtaatatgtaagaatggtgcttccattcaacagaggaaatgagtcatttcaccctaaaggtctctcacttaggaagagcagcaatatttcctccataattcatgctatccagtaatccacaaatttctttggagtttcttctgtgaactaattaatacccaccaaaggatcaatgtcattgcagggaaaatctgtggcttcttagtctgtcctacctccctccattttaggagctgtccctcctaaatccttgtgatccagatgaaactgttcatcgagacatttccctccgctgttctcatcagcagggctgggtgcattatccaggctgaccagagtgctttttcagaaattgatttggattgtgggaggagagcaagggtggcccgtttctaagatactgagttcaaagtgcatgtcatcatttctcacttccccttctataactggaagacagtagactttccattttgcactaacatcagcccacacataactaccttttctggactttttccagcagaaaaacatttccaacctcacaagcatcagcgtccaggaagcactactttatgccatgaaatctaaggcagccagaaggcagggtctggctttgtcagcaagcacattggttaaacacacacacacacacacacacacacacacactccaaaaacaaaaacacacagaaaatcactcctctgggggaaaagaaaaaaaaaggactcagtgaccatcaaaaacgaaaaggcagagctggctgatctgcaaaagctcccagacaaaatcaccagcactctaagaggactctgaagatgaaaaaggtttgactattttctcatcactgtttgccaactgagtctggttttgctgatgaaaacagataatttcatttactttccacttttttttcatggtccaatgatctctcacattactaggttatctaaataatcacaattgtctcctatttactgatgcattgtgtttttcaatccatcaaaaccagtaaagaagcaaataaatatccagggtgtcaaatataacataaatgctaccaggatgtcattcaaaatagagccatcttttaaggctcaaaaaccatccagtgatttggattttcactaaggttggatagctcccaaaatggattttgatgggggaacatatccatattctttaatatggaaaatgttgggatcctcatagcccaccaaaattcaagtgattgaactagagaaagagcagtatttgcttgaatgacataatagactctcctgcagaggcagcaaaaatagcacattcaattgggtatctgaaaaacacttgaaattgttgtataaaacaactgagaaattaaacaacaggaaaatgtctgggcaacaagtccagaagaggtgactttcccccttttgtgcagagctataacggttctgagccactcatctgctctttctcaaggaacacccttgagatttttatcctttgaggtaataaaagtatgagagcctcatttaacaactgtgggatccaggttttctcatccgttaaatgaatgagttggaaggtatgtatttttgtaggttctttccagatctaaaaagtctgtggttcagcacagaatacacaactctcacagagtttccaaaaacattggagcaattggcccccaaggaaagaacattcagccacaaagcccttcactcctgtactgaaacatttgttccctctgcttcctattgatggatagaataagatgggcaatagtgctagtatttacataagagtttttactaatgaaaatcaagatgaaaatactagaataaaataaaagaaaagaataatggtcaagatcaggacaccaaaacagatggattctcatttgcctgggatactttaagagaggtcttcctctcctaaaatgtcagagagatgggaagactatcctgtacctgaaaggataaaaaagatattccaatagaaggaatgaaagatgtctactgagattattcttctccaacatttttccccttccaaattcccaggagcaggtgtctctgccttctttaagacagcaactactgatcctcacctacacccctccattctccagggatgtctgaaataccagtgggacttcctgctattccctgctacctttctggatcttagctgtaccactccccttcacccagtgaacatggcattctgcagccaaagtgaaccatttacctgggttttcccagcttcacatcttggctcaagctcttcttttaattgctcccaaaccaataactacagttgaagggccactttctccataaagccacccatgacacatcctacagcccactttgtacctcccgcatatttctgccatggactgatgaaaacctgtacttttggagtttaagaaagggatggtgagaaattaaatattgactgcccaagggatagagaaaaaaacacagttgcctgatgccactttagacttcctggtatgggagggtaaagtcccttttttttttttttttttttttttttgagatggagtcttgctctgtcacccaggctggagtacagtgacacaatcttggcccactacaatctccgcctcctgggttcaagcaattctcctgcctcagcctcccaagtagctggtattacaggcacccaccaccacgcccagctaatttttgtatttttagtagagacagggtttctccatgttggccaggctgatcttgaattcctgacatcagtgacccacctgccttagcctcccaaagtgctgggtgggattacaagtgtgagccaccatgcctggctaaagttccttttttttttttttttttgagatggagtcttgctctgtcgccaggctggagtgcagtggtgcgatctcagctcgctgcaacctctgcctcccaggttcaagcgattcttctgcctcagcctcccgagtatctgggactacaggcatatgccaccacatcccgctaatttttgtatttttagtagagatggggtttcaccatgttggccaggatggtcttgatctcctgacctcgtgatctgcccacctcagcctcctaaagtgctgggattacagacatgagccactgcgcctggccctaaagtcacttttttaaaaccattttcaagtggatagttctgtggcattaggcacactaacattgttatatgacatcactattgaccacttccagaacataaagtcgcttttgcttaaactagtttggtgggatttctgttacttgcgtccaaaaaaaaattcctgactaataaatgcatcatatacattagtaaaggtaagaaattcagaagggctttgagagctgttttaaaaatgataaataaagcaaaattttctggcaccatgaaagcagacgggaccccaatgaaaggttcccgaggacaatcatggtctgcaaagtgcaggaaaaataattcaccagatggatcatgtggtgtaaatcactgattttttttttaatttttatatttgtaataggagaacgcaccaggatgcaaaggaagctcaaatctcacctcccaagggaaaaagacattctacagagaaaattagaattgtgccaagagggcaaatctccaaaggcagggagaggccttagagaatacgaaggaagtaacaagagtgagtgaatgccttctaacaaaaatttccctttattttaacaagctatagaaggctgttcttcatattaaccttacatataaaaataatttattaaaagtttaattgaagaataatcaagatcaattttttcatgtcagcagaaaactctatgcaaattactttgaaagtaatctaaaaaacttacacaagaatgaaagtgtacaatatttttaaatgtagaaacaaagatagcagtcatatcctaatcctttctttgtggcaggccttaattccctcacagcttttatttcttctttaccatgtatttaaatttgaataacattatatccaattttctccaggaaagaaattcctgtcattaatatggataaatattttattataaattctacagtgttatgatccaataaggagttagactagccactatgatgttcttggtatcatagttgttagcctagaaaatgggttctccatataacggaaaggtttttcttatttctctgcttttttctccacttatcaaagtattgtcattgtgtatttcaagatgagaaatatgatgtaaagaaggaaatgcaacagagagttgtcataggtagacattggtcatttgcttggtagccagactcaatcacaaatactctttacctttgtggggaggctccacagctagacaatgaatgcttcaattaattcctatgtctggctgattatatttctgggggaaaaaaaatgggttataagcacactctcagctaaagcatttagtttgcccacagcaatcagtctcagaaggactttaaaattttaaaatgctgactttaaatcagcattaaaacctctgagacatttaacagcctttattaaaggggcattcaggaatctactttatgttgactcacaggtaggcttagaactgataatttgctatcccagtgggtttttaagatcatgttatataatgtcaaagtcatttttacaaaaacaacttggagaacatactctcctaagttaacattatttgaattattgtaaaaatagctgctagaggtcgggcacagtggctcacgcctgtaatcccagcactttgggaggccaagacgggcagatcacctgaggtcaggagttcgaggtcagcctggccaatgtggtgaaaccccgtctctactaaaaaatacaaaaactagccaagtgtggtggtgcacacctgtaatctcagctacttgggaagctgaggcaggagaatcactggaacctgggaggtggaggttgcagtgagccgagatcatggcactgcactccagcctgggtgacaaagtgagactccatctcaaaaaaaaaaaaaatagctgctagataaggtaattttttttttcagagacagagtcttactctgttgcccaggcttgagtgcagtggagtgatcatagctaactgtagcctcaaactcctggacacaagtgatcctcccacctcagcctcctgagtagctgagactacaggcacataccaccatgcccagctaattttttatttttttgaagaaatgtcatctcactatgttgcttaggctggaaatcttttttaatgtaatattttagttactctttgactagtaagcctgaccgcagacttctgtcacagcctctacaacacggaataaagtccttcctaaagcataacttagattgcctcaacttttcatctcttccagggaaaattccctaagaatatgaatgcattatcttcaccaccctcggccatctttcactcatccagaaggtcgttggtaatgggacagcatatgttatactgtgtctcttttcactggagataacctaaagaagccccagagtgtaaagtgatagacaggggaagaaattacattcgatcagccaaagctgaggactagaaagcacaaaaagtcagagaggcaacctggagtcacagaaagcacccagtgttaagggtgggaaggctgggctctgggctcttccccctcttgggtcaggctactttaacatcagaatctcacttctgccatctataaaatgttctactgcactccatggctaagatctcatcctacaccaaaatcctaacattaaaatgcttcaatgactcaaatactctcttctgtgattctgctatagctaagaacagcacctggaggaaaaggagaaataaataaaggttcaaccaagagactggtgtcctaaggcagataatgtgagactgtgataactgccctgtgtcctggggttgcccactaggatctgctttgtacttttatttttctttatcccccatggtacctgctggtgccttgtaagcagactcaagaagaggaggaggagggtagggaaggaggcttctaaacttcttgagccatagctgaaaacacaaaggcaggagacaaaacaaaactaccaagaatagtgtgtaatgggaactaaatattctctttaaagatcaaaaacttcaaagaagatggaagttttatttaagccttcagatccccatcacttgtggatcacgcagctttaaaaaacattctctgccctcattcttctggaagattgagaccttcctctcgcccaaggacacatcctctcttctctgttttccccttgttggtttttcagtgggtgtgacagtcacaaaataagggttctggagaagtttgggagaaagggcatcatcctcatcacctagggctgtgctcattctgttggagtttgctttcaacaggtttctttaggcaatccgatcacttcatgttcctccatcagatttccttctcttaatcctaattttttgtttgctgctattattttgataaaactacaacagagtttcaaggtagttgatttatttattttatttattttttatttatttattttttttttgagacggattctcactctgtcgcccaggctgaagtacagtggcatgatcttggctccctgcaacctccacctctcaggttcaagtgattctcctgcctcagcctcccaagtagctgggattataggtgtgtgccaccatgcctggctactttttgtattttcagttgagatagggtttcaccatgttggccaggctggtctcgaactcctgacctcaagtaatctacccacctcggcctcccaaagtgctgggattaaaggtgtgagccaccagacccagctgatttcttttttattattaaactatgaaatagttgaagcatacaaaacagtttagataataatgttacaggcacccatatacctactgctcagatcaagaaatgaaacattaaagatccaagcaaagccctggccccattacctacccttccacttcacagtaaaccactatcctgacatcagtagttatcaatcccatgtaggtttttaaatattttctggatgggcttatgaccataaataatgtagttttttaaaggtttacataaatggatttagagggcatatatatccttctgaaactcaccttttccattcaacattattatgttttggggatttattcatgttgatacacgcattgctagttcattcattttcaccctcatatagtattccattgcacgcaaaatactacaagttatttctccatgtcagtatgtgtgtttcctttttgtttgtttccatgacaaacaatgttatgatgagcactcttgcattaatttccttttacacagatgcaaagtttttcccaggggataaaaccagaagggaaatcacaacctagaattgtggggtgtgcacagcttcaacctatctccaaataactgcaaatagttataacaacttacactcccaggagcactgtatgagggatcctgtttaactatatcttcactacatttgtcactttcagattttaatgtttgtaatttgatggctatatctatttgttgtgtgctttcacctatcacttacataatggaaaagtttttacaagacaaaacaacttttaagatatttactggatgtgaataataaaaagacgattccacgaaggtataaacaaaccccgaaaagtagtagatacatgtccgtatgtgttatagaatgcatttttaaaaagaaatttccatctgtatttatgaaatgttggtttctgaggggctggttacatctatggaaaggatcttggtcccttaaactgttccctgaagacattctgcattctggaaggtaaatcgagtcctggacttcatcaggcagtgtgcaagaagcaccaccaccacatggcactgatggaagtggccctccatggctcaaattgtgaccatagtttgaagacactcagattaaaaaagttaaatggaagaaagagcagaaacagggaaatcagctttgatcaactgtatccacaattggctttttcctccctgtaaatataataattttaatgatacagcatttaaaattatgtaatcttttagggatcattattaagaccaaatacagcttttctgagcttatcccaatgggtaagcctgaataaggggtagaaggagatggtcttaagagatgctcttcaaaaatctaagattgtccttgtgtattttcatagcaatctctccattaaaagcagatatctagagaattgtcttttttcccctttttgtatatttaaatttctaatgcttacatgattatctgggtgatgaatttaaggtcatttttgttttattcattatgctttttggtttgttgcgcttttctatacagcataactaacacccaatatatctattttttaagccccataggatttaaaatacaaatgactcaattttctttccttttctaggaaaaaaggtgaagggttggtaatgatgataaacattggttgtttctaaagcacctcttttctaattatatctgtgtatacctgacacagcatgagatcatttattatccacatttcctagttgaattatagaattgttatagatcataggctctaaaaatcaaaacacatttgaagttcctcatggatacagatggtgacttcctgttaggaagaacacaacagttcagaatcttgtctagattcttctgacacaaaagaggattatattgccaaagcttttaatgtgtgtgatggggagggagaaaagggaagaggagggagatgaccttgagctttggatttactatgacccacttctaggtggatgacaactgcctttgtggatctgagagaccaaagatttgaaaagaaaggacttatgtggaaagctttggtaccagatttatgccacatatcccagttttcttttgctattcgagcgtaaaccaaaaaataatttagcctaattcctgtaggtttaataatttgaaactaagtaaataagaacattaaattaatcttatgtttctacattgcatgactttttctttttgttgttgttgttgttgagactgagtctcgctctgtcacccaggctggagtgcagtggcgcaatctcagcttactgcaacctccacctcccaggttcaagggattctcctgcctcagccttctaagtagctgggattacaggttccaaccaccacacccagctaatttttgtatttttagtagagaaagggtttcaccatgatggccaggctggttttgaactcctgacctcaagtgatctacccgcctcagcctgccaaagtgctgggattataggcgtgagccaccacgcctggccaatctgcactgcattacatttaaacataaatcaggttttgggaaatctgattcccaaggaagaataatttacttttagaaggactggaattttaacccagaaacagacctaataatttggcattcaacaaaatataactttttcccattggacttaaaaggtgatatggggtggaaattgctgtttaccttaaaaatagtttgcaagccaaacgttctcttctaggcctatgaacaaattctcctagcataaacttctgagagaaaacacttccaattatctaaaaacaaataattcctcttttctggctatattaaactctctatgcatctttctcccaaacttcaatgtctcactaaaaacaggcttttatggctttccctggagaattatcttacaaatcaatggcatagcttcaataactctttaataactttcctgtcttccaagacaaaaatgatcagtgctcttcattacagtaaacccatttacaagctgctgtgtcatctataaatcccttggttagagaccaactatatatattttaaaatagaatgttagaactgagtgtgtcttagagttgatcctactcaggctgcataatcaaatcccctggacaggctttgggaatactgatgccagggtgtatccacaccaattaactcagagccaattaatcaccaattacattcatttaaatcagatagggcccagtcaccaatatttcttaagagtttcccgaccaggcacggtggctcacgcctgtaatcctagtactttgagagactgaggcgggtggatcatgaggtcaggagattgagatcatcctggccaacacagtaaaaccccatctctaccaaaatacaaaaaattagccaggtgtggtggtgcacgcctgtagtcccagctactcgggaggctgaggcagatgaatcacttgaaccagggaggcagaggttgcagtgagctcagatcgaccactgcactccagcctggcgacaagagcagactccgtctcaaaaaaaaaagtttccctggtgattctgatgtatagtgagggtcaggtaccactaatccagtccaaccacctcattccacaggtaaggaagctgaggcccagaggtattaagtgacattcctgaagtcacataggtaattaggcatgttgccaggattagaacccacatcttcagattctttcttctctattacattaccttctttcataactctatttctccttctgagattacatctcagaatttgattccaaaaagggaccacaatatggacccaattccctgggagctcccagagacctgctatctaacagccagtctgactgctgcttttaccctaggagttcactgctgtcaggacaaccatatcaccctgtgggctggaacacacctccctcctgccatcctcagcagaaaacagcatcttaattctcaatctatattaatggttttctttattgcttctaccaacccctgtcctctgatacctctctttaaaggaaataataacaacctcttctaaaaaacttcattcggtggtaaactgaatttccagtgtagtgatgaactaaaagccttcatataaagaaatggcttcagggcaacttcttgaggaaggaataatttgctgacaggtggtctgaagctttgctttcagcaatagctggaccgaggactgcagaattagagcagggacctggaagcaggtgaggctcctaagtattgggtgtcccattgcatcgctggccccttcccagattctggaaagaataaacataattgacaaactagggtttagtgaacacctcctggtaaacacgactgaaggtgtgaaaactcctcaagggccatctcctttgcatattctgccctatcctatgtgcacatcccaattctactaaactattttaaaataacccaaaaagtgtttgttttaccaaaaaaaacaaaaatcctttgggggcaagaagaaaaagacagctgacttgtgagaataaggcatcagaacaacgggagagttgaatgatcactggaccaggaatctgaagacatccattccagccttgctgttgccactcatggctgtgtgtgttgggaaaagtccatgtctctgggcttcattttcctcataggtaaagctcagataatacctaacctgactgccccatgggctgggttatgaagatcaaataaagagacaattaaatgtagagataatttatataaaagcatatttataataagctgcacattaagaaagaacaaagaagatgaagtctgtatcaccagataaattaaaacattcagcactaaattccaaaacaaaagagctgattatagaatgattcagcaatataatagcatgcttaacatcccaactgtaagtcagacagacccggaatcaaatcttagctgtgtcagtttccctctctgagcctcagtcttctcatctgtacaatggaaattatggtgggatttaccttggatatttgacaaggttgacattagataattacataaagagcttagcttagtggctggcatatagtaagtgctcagcaaatgttagctgctggttattgctatcatcatagctgttattgtcattacttcccctacctcacagggtggtggtgaacagttaggaacagatttttaaagcagtgacaaatagaaatcattcaagagatggtcatcattactctacctgagtcacgagctctccctcctgacagaggcagaaatattactaaaggcacattttcaaactcttcgctttctcaccaagagatttccttttgacctggtccaattctttattgactttgagtaagatcaggtagactgtgagagttctagttaaccaccctcacatttctgtcacaggcacagcaatcatccatctctaggggccccagatgctaagtgtatttctcaaggcagaagcaggagttggtccccttggtattagctctgtgtcctacaactaaattagggtggccggcagggatccagctgattagcagaattatcagacaccacaggcaaaggaaagaaacaaaggatcgaagttatctgaagagcagttacagcctggcgcggaggctcacgcctgtaatcccagcactttgggaggccgaggcaagtggatcacctgaggtcaggagtttgagatcagcttgaccaacatggtgaaaccctgtctctactaaaaatacaaaattagctaggcatggtggtgcatgcctgtaatcccagctacttgggaggctgaggcagcagaatcacttgaacctgggaggcaaaggttacagtgagcagagattgtgccattgcactccagcctgggcaacaagagtaaaaatctatcacacacacacaaaaagagctgttacctgaaatgtggagttatgtgctgtgtctgtgcatgacaaatcactgatcctactgatgtgttcacttgaacagagaaaacacaggaggaaagaatcacaaaaagttaaggcataaaacacttgatgtgaagtttcacacaaaacacatgcaaatataatatgaataatattctctgaaagtgctagaaatgttagttgagttctttgctctgttaaagttctataagtaatgtgtatagagacttattaaatccaaatgaggaaaaaatgaaaatgaattaagatcattcataatcaaacctcccagagatgatgctgttaacattttgatatactttcatacatgttcctatctgtgtatgtgtaaaaatagaaattttccccaaaaggagttataataactctagttaattaagtcctttaaaagcacaggggaagatagaagacttaatgaattaaataacaataactagtttctcattttgattatcatgtaagtaaaatatatgaaaacatagtgtttgtcctttagcaatattgacagataatatttataagcacttatattgtgccaggcacttccctaaagtctatatacaaattaactcctttggttttcacaactgctctaggaagtaggtactgttcttgttcctgaagacaaggcacagtaagattaagtaactttccccaaagtcacacagtagatacaatgctaaactagggctagagcccatgcagtagggctccagtgtccatgtgcttaaccaccttcctatgatgcttcttgacagaggtccaacatcgatgcagaattggaaaggagtaactcccttgtgcttatccatatcttgggagtgaataatatagagtgattgctgagctaaccataaaactgtcaaacatgttgaaaatcacaacgcacccagatcatctaggaaataaatactgattaaaataaacagaacttgcatttcacaagcaaagacggaatgatggttgtcttggaaggtgggatagaggtgtgcaatgcagccaacacgagcttttttcagggatgcactgtctgtgtttaggtttatgacttaaaggttagactgccaagaatttttttaaaggttgacacatctgtggctgcatttccccagagcaccataaaccacagtcttgccaaaattaaataaaaggattgactgttcttcttcctctgccttaagaatgtcaccatttgaactgtgtggggaatacagctactatgaactcaacattcaggaatcattttctgcttgggttgtaaccagaactccttattctgtgactgtggtcctactagtcccaaagggccagatgaaaggagattcaaacactcatcccttccaataaagatttggaaaagacaaaccatgtggagctaggaaggcacataattctatcacaggaactgcctatgatggggtctacctaaggttatgccatgtgtaggtcaccagagtgaccaaagaaaagtaaaattaaaaagtatttttatggcatgttatcagtacccaatgggaaaagggagcaggagagagtatcttaatcaggaaagctaacaactacaccaaatttccccttcatctccgtagtatcccacagtaacagtttctttctttctcatgttacagtgggaagcaaactggcactggtggagggctgtgctccacgtagtcattcggggcctcgggtctcttcttccagtggctctaccatctcccgggaccccaggatcctctgctagatccggtggacaaaccagcagaggcagaggaaagaatcacatgagagatttcatgaaggcaaggccagaaaatggctgcatcacccctgcctatattccattggccagaactcagtcttctggctctacccacctgaaagaatggctgaaaaatgggcccagaagaaaagaatacaggaaagacagcattatttctgccaagaggaggggaatgaaatcaatccaaattttgacaaaacaaacagatgagcctttacctaagtcactggcagatgcggtgcttcttacggataaatcaatctgagggctgggcgtgatggcttatgtctataatcctagcactttgagaggctgaagcaggaggatcgcttaagcctaggagtttcagaccagcctgggcaacatagcaagaccccgtctctaaaaaaattaaaaatttaaaaagttagccaagtgtggtggtgtgtatctatagtgccagctaattaagaggctgaggtaagaagttcattgagcccaagaattcaaggctgcagtgagctatgatcgtgccactgtactccagcctgagcaacagagtgagtccttaactctttaaaaaaaaaaattgagctaaggctgaattatcaatcaattaagaatgtcctaccctgcatatctttccatggctctgcccaacatgatatgatggtcctatgttcctctaggccagtgcttctcgacagggcagtttgccttggcaagggacacttagcaatgtctaaagatatctttgattgttagcttaagggaggggtgcaacagccatctagtaggcagaggcccgggatgctgctaagcatcctatgatgcacagggcagcccccacagcaaagaattatctggcccataatgtcagcagtgccaaggctaggaaactctgctcaaagtcttgaatgtagggccttgttcatgcatctgtcatgacacttccattcatgggccatttttgagtacctgctatgtgccaggtgcttcacttatcacatggtcattgaatagttattttcatatttcttcttcccctcccccacaagactgcaagggacagggtaagaacaggattggtcttagcacataatacatgtcgaataagtggatggatggatggaaggatgactttgtctcctgaaccactgcatcccatgctctgaccctttgagtatatgaaggaatttggttatcaagacttgctattctgaatgcctaacagaacaagaaggtgataatctagtttgttcttaagaaacccaatgttcaaaggagcacatgacctaagaggctggtaatgaagcacaaagcttcaccttagtaagtgagctgatcacaaaacttcacgcagacccaaagatataggaagttgtatgtacctatgtggcagtggcttggtgaactccatttgatccgagccctgtataagcatctactattccagctccaataacatggcacctgaggataggcacaatcccaaaagtgcttgtcatttgaggtctgtccattcaagagaagaagagccccttaatgtcatgtctaaaatagaaatgttctatctatttggaaattttataatataacttcagtttcaactcagcaatgccaggtagaaatgggagaaataagcaccacatatttacaaggatgttgaggaaaatcaatctctgaaaaggactatgtgtcaaggatctgtgaccataattaacaattgtttttgaaaatctctttttaatcacttgtgcaagtgctggttttgtgggagatgactgtcagctaccccagctctggcctggggctacctttcagcccatccctcctagaaaaaaggttctcttaatggcagggagtccatttgatcaaaatgtaagttcacgaggctccttgcctggctttgtccccttctcgcctcatttattccactgcatctgttttcccacataagagagcagaactctcacgcacttctcacaagcataccaagaagagatggaaggcattgatacatgcatgataatcaaaacacaacctcatatttgtaaaatattttgcaagacagttctattatatttgttattttatttgatcctcatctttaggcctatagttctctcattacacctttcaatgatttgaggctttattggaataaaactggtaactgtacaaaatatggtcccaatacattctactccggggaagctctgctacgttgcacaccctcgtgctgggtaggaagagaactaaatttgaaattggagagcctggctccatccaattctgaccctgtcacttaatagttctataactctatttatgtcattaattttctctaggactgcttactcctgtgttgagcagcaattatgctgcctgtcttacttccccatcactcttaaaaggattcaatggaataaaatatgcaagagcgtttggtagtgtggtgccacaatttcttcccagaaatgatcaatgtgcctctcagatactgaatgtctctaacccgggtagacctgctagaaaatactacaaataaatttaattatataaataatattattaagcaaattaaatgctgcatttttcttcagccaatatctgaagatttcaaaattaacaaagggacaaaggagaatgaatagaaactgctatattctatttcatatcatggcttttttaagagactgtggtctcactatgttgtgtccaggctcatatcaaactcctgggctcaagcaatacttccactttggcctcacaagtagctgggactacaggcatgtaacagcacactggtcacagcttcttgttgttcagcaatagctcaagtttaacctcagtcaccttttgccaagaaaaaacaatgcaagtaagcattttaaaactacacacttcaactgttctagcagttttctctcacaagacaccacaaagctgggatgatggagggatatctatggaccatttgctgtatttttcctctttttcaaatagccaaataatacctaaatatattttcaatctataggcataaggtttcagttacacaagatgaataggctctagagctctgctgtgcagcattttgcctatagttaacaatactgcattgcacacttaaaaatatgggtgtatatctcgttaactgttcttaacaaaaaacttaaataaattttttaaagtttcaaataattcaaaattatacagagtaaaccagaaagcctccatagccccacccatctttccttccccaaagtaacccactgtttatatcctgccagacttctttctgcagattaactgtatgtgcagtcataagtcatagattttttttttttttttgagacagggacttacttagtcgcccaggctgggcagtggcgtgatctcagctcacactgcctcctcaacctcctgtgctcaattgatcctcccacctcagcctccatagtagccgggatcacaggcacatgccgccatgcctggctaatttttgtattttttgtagagatgaggttttgccatgttgcccaggctggtcttgaactcctgggctcaagcaatccacccatctcggcctcacacagtgctgggattacaggcgtgagccaccacgcccagcccagccacaggcatctcttattttgttttgttaaataattgggatcatgctttacgaattgttctacaatttgttttttaaaattttctagatttttccatgttgtacatgcccatccacctcattctttttaataacaaggttttctgttaggtaaacacccccaattttacttatccctattgataacaatttggtggttcccaatttccacgatcacagagctttgctaaacttttaaagttaggttgctaatagactccactttattacctttctcgggattctacctgataacaacttgagcaaagttctttccagtatccccttcctgccccagttgcctaatggataaggcactggcctcttaatattcccttccccactagtgataagcatgaaaacagggcgaactcaatggagccttttaagaagaggctgaagagagggttaacaggctagactcaatgctaagtctttcaaactacacccttattcagtgttaacagcaggtgttcaatcagccctatgtttcactcacagagagaacgggcctttacctacagactttccatgttaaactaagcttcaacacttctcactcccctctctcagacagtggtaagaccaaaggaagaagacaagcatgtgaaaatcctggtgtgccataaggaatcatctacacatttaagctaggtcttgggttctataaaagaactaaatagattgatattgctagagtcttctaaaagagcaaaactattttcacttgaaatttccgaattcaaacatttgttgattatctactgtgtgctgagaggggctcaaaagtagtgtaagatccagccaggcacggtggctcacgcctgtaataccagcactgtgggaggctgagggggcagatcacttgaggccaggagtttgagaccagcctggccaacatggcaaaaccccatctctactaaaaatacaaaaattagttgggcatggtggcgggcgcctgtaatcccagctacttgggaggctgaggcaggaggattgcttgaatccaggaggcagaggttgcagtgagccgagattgttgcactgcactccagcctgggtgatagagtgagactctgtctaaaaaaaaaaaaaaaaaaagtagtgtaagatccaacctctgccttctagaaactataaaaacagctggggagatatataaataatacaatacaaatattatacaatacaaataatacaatacaaatattatatacaaagatatataaataatacaataaactaacaatgcaaagtagtccatgattaggtacaaaaatgaatggtgcagacaataagtgctctagaaggaattctcagtagcagtaaattaagggaagtaatagcaaacaagtcattgtgattagggccctcagcattgcggtgagggcttgaagtgcagaattagttgatgagtgctatttgttatatagtcataaaacagtaaattctgactttaagagacacctggacaaatgaatctaagcataactgcacacttgatgggaacaggaccagaggaaatcgtgctccaagagatgaaaaccggataaatgccacataaagattcaacaaatgcccaggatccctcaaccctactccttctgcagggcaaacaggctgcaagggacttctcttcaaagccttctcagagggatcagaatttaagttgaaagcacttctcctctcctgcagcctgactgtgtgtaagatacagtcaaaaactatcacaaagcccctactatgccctagcttctagttagaagataggtaaagaagacacgacctgccccaaaatcatccacaagtatctgaaccacccactcaaactgaggctgccactcacaggtgtcctgaaccccaattagcaaatggtagagcccggactcattttaaaaaaaggagcagcaggagaacatatgcacagtgtatttctgtaggccaataaaaaagagggtgttatgaaagatttcttgtttttaacttactgctattatgttgaagcctgctctggtctatggggcctactagttgcctactagtttcttctaattctatggctggagtgttgcctatagatgcctattatagaactagtttccattttctttctccatttaatgcaaaaatagtctcaatctaagcccaaaactactcatctctccctgcaacaaactactcaaaaaaaaaaaaaaagaataaaagaaaggaaggaaggataggagaaaaagagaaatttgacagtagctactgagaaaaagagaatccccgtgccacttcagtcctgagtttgtataatgagagcacacagtgagggagaaggtctgaaggctactgtttttagcttactcccacagaagtggcaaaggcatatctgcctccagaaatattagaggaaaaatggggagaagcaagacactgaggtttgtctctcactagaagtcaagaaaataggaggaacaaagtgttctttgatgccctggcagcggggagagatggcaatggtgtagaacggagctgatgagaggcagcatagactcgtttttagagcaaactcgactcctttaagtcctttgccgtcaactgtcgatcttgtataatagccgactgtattatttctttcccttaagaatagacctttgttctatagagtattgcacccttgaatgtttcagtactagttactataattaaaagaaaggcacaaaatactatatatgttcaaaacaaagatgaatcaattattaaatcatcttttctaagaactcacccatctataaataaaacatgtttggaaaacaaatattttcctgcctctgctgtttttactttcagtagcattaacttaaaagatactacttcagcaatacttttctcaagaaataaaactcgccaaccctcttgcttttaagctacactgctgaactccttctgtgggattggactctgctcaagggaacatgtgctcattaaaaatatttcatgccattaacattttcactagaagattcggagtgtgtgatgtctgtaatgccggctccattcacacccattgtccaccccataaacgtctaaatgacagctaatatacaacatgtaaatcactacaaaagagaatcgcgcacagaaaactggcacctaattacatgtcccagagcatcactccctaaaatacaaaaggtctgattgttttatttattttgtgatagatttggaatgaaatcagctcctctaaaataattttgtcatgaaagggaatgtttaacgccttacaaaagtgacatccttgacaagtcagcttggttatttccatgactttcctttccatgcagtgcaccagtgcaacttccggatgcccttccactcctgaaaatgctgcagcccctcccttctcagagctttggtccagacaattccctctatctagaacatcctacccaccctcacctgattaaatccaattcacctttcacatctcaattcaaaagctacttgtgcaagacagctttcctgactagccctcctaccccaagtctagatgagattcttccgttgtatgtgttctggtagcttcctgtgctcatgtcacagtttgtacagtcattatataactgtgtggtcctttcattaatatccatcttctacaccaaactgtaagctgtgtcaagacacagactatgcctgtttggctcacactggattcccagagcctaacacaatggctggcctatagtaggcactcattacatttgctgaatgaataaacaaaccatatcacatcctgacactctaccgtaaaaaaaaatggtcaggtcaaataaaggcacagtgaggaagatatttaatagaaagtctgttctgaacattgcctagtcaactggctctacatactatcagcactagtaaattgattgttctcaggtgaatctggttgtatcttgatctgtgctatgatgacaaccttgacaaaaaaatcagtctaacctaagggtagcataataccatagaaggattaggttcagcatcatgttacagaaaacccaaaataacagtggcttaatcaagaaagatatatatatatttctccctcgttgtaaacaaggtctatagaagttacccaggactggtatggtgctcgatggtgataaggacccaggttccatctatctttttttttttaatttattttttagatggagtctcactctgtcacccaggctgaagtgcagtggtacgatctcagctcactgcaacctcagcctcccaggttcaagcaattctcctgcctcagcctcccgggtagctgggattataggcatgtaccaccacgcctggcaaatttttgtattttcagtagagacggggtttcgccatgttggccaggctggtcttgaactcctgacctcaggtgatctgctcgtcctggccccccaacccgcctgccctgtacccctcggctgggagtacaggcgtgaaccaccgtggctagcccaggttccatctgtcttgctgctccattctctgtagcatctgcttctacttcatgatccacaatggctgctcaagtccagcaatctcacccaattccaggcatcaggaagaaagaatgggataaacaagggtaatgatccccattttgtgaaatttccacataaatcctcttgccagaatacagtcacaaaggcataactggccaaaaggtaagctagaaaaaattgtccttttttctctttgagacatggtctcagtcacccaggctagagagcatggctcactgaagccttggccacccgggctcaagcaatcctccaacctcagccttccaagtagctgggactacaggcatgagccaccatgcccagctagtattttattttttgtagacatggggtttcactatgttacccaggatggtctcaaactcctgggctcagccatctgcccactttggcctcccaaagtgctgggactgcaggtgtgaggcactgtgcccggccaaaaaaacagtctttaatccaggagaaacataaataacttataaagaaaggaagatgatattggggaacagtcagcagtttcttccacagattactcaatgcaagataaccaactgtcactgagttctgcaacgtgtcttggttttacttttgttttctatcttgataaatttttgcaacatttacactgtcccaaaggcagacttaacatttcacattttatagacctgccagttctattgcatacctttcttgctttagtaactagtttttgggagtttcactatctcaatggatttcatactctgaaaaacataaaaatatgaccaggtgaacacctatgtaaaaactaatgcaaccaatctgcttcttctcaaatgtcttcaacgtagattttcaatcagatgaagggccttgcatttttctgcaaatctctctaatatattcccttataatatatgcatttttggtcatataatttctacatttcctaaaataagaatagttgaattaatgtttatagaagaaaatctagatataaatatatatatattcaagaggtaaaccaggcatgatggctcacgcctgtaatcttagcattttgggagccagaggcaggtgaatcgcctgaggtcaggagttggagagcagcctagccaacacggtgaaaccctgtctctactaaaaatacgaaaatgagctgggcgtggtggtgtgtgcctgtaatcccagctactcaggaggctgaggcacgagaatcacttgagcccaggaggcagaggttgcagtgagccaagatcgcaccactgcactctagtctgggtgacagagcaaggctccagctcaaaaaaaaaaaaaaaaaagagccaagccaagaccttcttttaaaaaaaacaaaaagttgttcagacttctaccactaagctcttggcatttcaaaaattaagagaaagagctgggtaggaagcaagatggaaatccctaaaactgttctaaaaacagcaatctagtgacactagcaacagttgctagaagcttaaagaaaacctccacaaaattgctagagatgcttcctcacttgtttctagcaagtctctctctgtgggtgacaatgttggtgcccagtttagattcagtgtctctacagcagtcttgaagcaagttttttttttattagccacaacatgtaagattttactgtgaacaaaagtcatctcagaaagccagatccaaggacatggcatactagataataaccaaatctcacagttcgatagctacctccccacttccccacacccccaacaccctctcttaaaagtaattgtctgctctttgcaatcaggaagttctacaacaacccagcctatgatcaaaggcctctccatcagctttccccaaatgcataatccacagctggcaaagtctcagaagcatcttactgaacatgaataaatttgatttttggactgggggtatgcaaaatcttgtaatgcagcccacagtaatcatgcattttaagtctattcctcctttccagggcacatcttctctctttttggctctgcatcctctttctgaggcctaccaagagatcggccctgaaaaattaaaggggaatgtcctataaccagaatagactcccagaaaagctaacatcttaaaagaagaaaaggaaaatagaattaaatttgtcaaagtatgaggatgctaataaattctacacacacatacatacacagaggacttagtcgtcaaataagcttaggaaacactgattaaataatgcaaagggtttctttcttgcagaccttctcagagcctttaatactgccactatgcatcatggatctccaagaggggcacagtaaatagattttctacttgaactcttgttcaccagaacatcttatattaggcaagcactctgtagaatactcatggaaaaatgctggactggtaagaaatatatcaaaattaaatagcaactatcttgggtccagaagtttatggtaattttaattattctatttccaagttctctataatgaacttgtattgcttttgcaatctggaaaaagttatgtaaaatttaaaaaaaacatttgaatctatattaacatttttaaaaataagaagtttcagaaggtaagatttttcttttttctaagaagtagaggtacttattgttctttaagatttattatatgcctccattgtgccaggttttgatagtaacatgagaataaaaaggaagaatcatttcaatgattcactacatagtgctggtggcctgaaagaggaaaagaaactctttaaagagttcctcctctgctaataaataagccaaaaaccttcaaacataataaaaatacttgtacaatattaatcttaaaaatacatattactgtgcttttcttcccaaaccatttaaaaaaatctccctttaggtttaatgtcttgattaatcttttttaaaatagtctatatataaaaacttgctagggtgcattataagtaaaactttatcagtagatccttgttaaactttattacttattatttcatcaatttattgaatgccttttatgtgccaggaaatgcactattattgaaaaattcaatgaaaacaggtccttcctcatgactagtttattttagtagctgattatctaaataaatttaataccatttactaattgataaacagtacagaaaagttataacagatctatgtagcaaatattttataatataatggtattttataatataatggtacttcatttcagtttgataatcacagcaacttggacaatctagaaaagcaaaatcaaattttaattctggccaaaggaaaaccacgttcaatatgcttgatcctaaggctccccacatttccagttataccaggtttctcaaaagagacaggaggagccagacatcaaagtccatctccagccaacctacaaaccactttcttgctaaaacatttctatccccaattataaccacaatgactagattaaactggtatggccacctctctaggttcaccttaaaaaaagggctcatcttctaaccttaccaggctgttccccctatggaatattcttaggcaatgctggaatggtccccgtctttccagctgagacgaaagtcaagaatggttaacaggacactctagtctaggagagttgggacttgactcacctatcaagagaggcaaaggacatgcttttatttacctgggcctcaacactcaagatgagaccagaaagcctcagagtcatctctctacagcccaaaggggagaaacaggggaattaagtcaggaaaagctcaactgtcagacctgtcagtccgccaggctaaccacaaccagatgtaagggccacaaataggcacaagttcctttgcttccagacctggataaagagatcacattctgtgactagcaacttaatcgcttaggaaaattatgttgccctgcctaattacagctctgctggaactcagtttctagaaagtgttgagatttcctccaatttcactgagcaagtgctctaatgattgcagtagatacacagaataatattagaaaagctctttatttagaggagtttccatgaatcaaatcaaaacaaaacaaagtccaccattttgaagcatttactatacatatatggtgactgcatatgtaatatgtttctagttcatactgctgaatgtcttaagaagtcactattccagccaacagcaggaagaaagactttaaaaaaataaaataaataaaacccttaaagaacctaagaaacaaggaatccaatgtcacaggaatacagctttaggacaaaaaaaaaaatgtcttaaagagaaacttgggcctgaactctacattttgtatgtgttaactgaatccatgctaataaattcaagtgagttgggccttcctaaaactaacataattaaaatataactgaaaactcagaaaacctgtagaggactatcttagtccacttgagttgctataacaaaataccttagactggatataaggttaacttataaacaacagagatttattgctcacagttctggagactggcaagtccaagatcaaggtgccagcagatttgatatctggtgaaggcctgttcctcacggatggcaccttcttgctgtgccctcatgtggcagagggggcaaacaagctcccttgggcctctttcataagggcacaaatcccattcatgaggcctgagccttcatgacctaatcactcccaaaggctccacctcctaacatgatcacactggggattaagtttcaacatatgaattttggtggggacacaaacattcaaacattcaaaccatagcaaggaaggacataggacatatgtgtgggctccaatcaggggagttaagaaatcgtatagtattatgaatagacattgaactattattcttccacccaggaatgcaaacataagatgacatatggataaaagttagcgaacactcatcgctgtcatccaaaacaaaagtatcaaaaccaaatactcctcacaactgggagacccatctcaaagcacaaagaaattcaacccaacttaggtagctataactggcagaggaagcagctgctactaaagtttcaactttcttaatagctcatgtcagcagcaacacaaaaggtacagtgattttttaaatgcttggacaagactctattaagcaactacgtatagtgtaatgggaaaattgagttaaatttgtgcatcacagaatacaatggcaatagaagaaagccacttcccaccttcttattaatttagcaaagaagaatgtgtcatcagcctccagactggtcagtatataagcagcaggcagtattttttgtttaccttcctgtctttctgaatgatcacccaaacatccatttacagtgttcctaatattatttgctaatatcatgtctatttatggtcaccaaccacatgttgggatagaattggtacaaaataccatgtgtttcatgtgtcagaactcatctaccagttgaaactgttgcaggggagatagaaaaatggaagatgggaaaaatcacaacatttacaaagacagctcagcttacgattattcaccttctaccctatcaaatctaactaatgccaggctgtggtttgacaatcttttaaagagagctgactctacatctcaagcagtgatgctaattttctgtttagctatgtatctccgtgttctagcaaaatgacctatcatattccatacatagtaaaagcatgtgtataagtgggtgaccctgtgggtagccaattttgaatttacagttggccctccatatgatgggttctgcatctgccattggtttaattcaaccaaccgcaaatctaaaatatttagggaaaaaaataaaaaataataatacaataataaaggccgggtgtggtagctcatgcctgtaaatccagcactttgggaggccaaggtgggtccggattttgagaccaacctggccaacatggtaagacccatctctactaaaaatacaaaaattagccaggaatggtggtgcagtcctgtaatcccagctcctggggaggctgagagaggagaatcacttgaacccaggaggtgaacattgcagtgagccgagattgtgccactgcactccagcctgggcaacagagcaagactccatctcaataataataataatacaaataaaaagatatagtataacaacggtttacatagcatttacattgtattaggtattataagcaatctagagatgatttacagtatatgggagaaagtacataggttatgtgcaaatacgacaccattttatgtcagggacttgagcatccctggatttggatatctacaatagtcctggaaccaataccccatggataccaagggacagcagtatacatactcaacttagtttaagaaaacatatgaatattctgatttacaaagcagataaaattgagggtactcatttaccttacataataaaaaggccatttgctatagtcttttcccacctaaaggggaagggagaaacttaacagcaaagctgtttgtagggttatttttcctaacagtggtacaaactgcctgtcccacggaattaccatgaggccacattccttatctctatgtattactctattactctaaaacctctcgcatttagggaaaattagaaggccaggaaagtgaatcaagactgatcaaataaaagctcaacctaaattctttcagaaacattccaaaaactaagaaggaagagaaataaaatatattccctaatacagttctcagctatcatgtaaacccttttaccaaattgagagtagaaaacagataacaggaaaagggaggggtgaataagcagttgaactctatcccagtgcttcatccctaatgacctgctgtgtccccaaaccagaaaatgacatcagagacatgagcacaacatggccacatgagtcctgatgaagaccaggctttgaagaatgaaatgtaaggaagacatggggtgacagaggagagtcctcctataatcccatgaatgactgtgccctgcctacctaactcctagatttttatttttatttattttatttatttatttagacagtgatctcactctgtcacccaggctggagtacaatggcagcaacatagctcactgcagcctggaattcctgggctcaagtgatactcccgtctcagcctcccatgtagctaggactacaagtatgcaccactacatctggctttttttttttttttttttttttttagagatggggtatcgctgtgttgcccaggctggtcttgaactcctgacctcaagcaaatcatcctgcctcagcctcccaaagcactgggattacaggcatgagccacctcacccagccccataacccctggattcttaaatcattctgcccagccatccctacaatgggaccttgaattcccaggtccctgatgctgccaaccatctcgcttacactcaacagtcttcccaaccccctatgcaatcttttcccattgtagccaccttaccctgtgttgctgctagatttatcttcctgacacacattttctacacttaaaacacctacagtcattccccaggatcagtcactactcggagtgacgttcatgcattccctcatttcatcctcactataacactatgaggtacgtacaatattattgttctttccattttagagatgaggaaactgaggtacagcatggttggcaacttatccaagatgacacagcaaggaagcagcagagccagaattggaacccaggtgacccaacttcaagcccaatattcacactccccatgttctaatgtcaacaaaataaaatccaaacattcgagcctggcaaccaggtatctctgtatctttccagtctcgtttctctttcttcccctttgttccttccttactacctagggtgatgctgtccatgtggttaatatgggttgactgaatgaatgtccaggctaatgaacgagcagtcagtttttatttcattcaagcatggtccttatttgcaatgtcatagaaaaaaattgtttcagcttctgctcaggaagtctcatctctgaacatgacgccaggcagcaaagagatcgcacgagaacttattaggttaattattcatctgctcactgtcagtaagggcttccaagcaaggcagcgctaacagatctgcatcccagatgtgtaacaagtcacattgggtggggtagctgggcataggttgctgaaatatggcttcccagtccaggaaacagattccttacaatgtacccttttgttccctgaaagaaaatttagcaaccctgtcatagggaaatcacattgacagaagtcctgggtacttagagagcaaaaccaattcttctatataaattaggctttgtccagtggcaagaagtgggataaaatcaaaacccaaacttaatttgtatcgtgcatgagaggacacaaaccatttacacaaaacttctcacataattcccatagcaatggactgaggccatattattcccatttggctgatgaggaaactgaggtttaaagatgatgggaacacccaaaaccacacaatggaggcaagacaagaacccaaggctctctccaaatcaggcccaagggtcccagctgtgaagagtggtcactttctacagtctcttccccacacatacagactctgtcatgatagaggaaagttctgctcagttcagaccaagagtccaaactaggctggctgaggaatggaggagcccaaggtgaagcgggaaatggctggggacagggctccccgttggacttaaagacactcactccaacaagtgtgtgcagcaactaatcactagggacacggcctccctcctcatcattccccttcccacctccaccctccatcccaaaaaactacccaagcagcacagaagcagagaaaaagaaagtagcaatatccacacttgtccctcctggctgcctgcctactgctgctgcagggacagagtgcaaaacgcaattatctttaacctggttcgctttatgtgtcaaattggagaggggttctggataagattaaatttaaatgaatgaactttgggtgaaacaggttgccctttataaggtcggtgagactcatccaatcagttaaaaacctgaatagaaaaaaaaagactggccatcccaagcaagacggacttctccagcagactgccttgggagtggaacagcatcatcagctctctggggactagagcctgctggcccacactacagatttgagatttcctagcctccatgatcatgtaagccagttccttacaattaaaaaaattatatatatatattccttatagttcctccgtgatcatgtaagttgattccttataatttaaatacatacttatatatattatacatatatgtatatgtgtgtgtgtgtgtgtgtgtgtgtatatatatatataaagagagagattgagagagagaggagaaagacatagagacatagatatagctcctattggttctgtatctgtggagaactctgtctaatgcagggaccaacttgctatggaggactgctgtgggaactaatccttgctgcaaacataggaggctctctggggagacgagggggaggaagtcaaagcaggggtagcatgcggtgtccatgtggcaggagatactgaagtatgtgtagttcaggaagtggtgatggtgggggtgctggaattgagtaaaagttttgtttagggagaactaatagttttagctatgcatgaagaaagactcttgaaaattctgtaatatataagaaaagtgtggtatacagctgatcttggttatgaaaatcccactagctggccgagtgaggtggctcatacctgtaatcccacactttgaaggctgagatgggaagatggcttgaggccaggagtttgtgaccagcctgggaaacacagtgagaccccatctctacaaaaaaaatacagtaattagctgagcatggtggtgcacacctgaagacccaactacttgagaggctgaggctggaggatcgcttgagcccaggaattccaggccagagcaagctatgattgtgccactgcactccagcctgggcaacagagtgagaccttgtctcaaaaaatgtacagaaataaaaaaagaaatttttaaaagaaaatcccactagaaaacacatttgacaagtaatttttatcaagtcactaaaccttcttgaaatagggcaagatcggtattattaaagaggaagagcttcccagttttgctctacatgtgggagaatgtggtggccaccaacatacttttattcaaacagtacactgggaagcaaaaagtttttgtaacacagacaagaaaatacacaacatcttatttattttagagatgtaatttcagcaaacacactcaataaaacacataatctcctcatcagctgcactaaagtttatttttaaacagaaattcaaaatatttaagccataatcctatcacagctgcaggaggatcgtcaatgtagagttataggtttacattcactctcaccaaaatgtctttcattacagcatttattttgagaatatttatcatgttgataattaaagcaaaaaagtccatctacattttactttcattatcaaagtagttttcaaagaagcgtctaggtttaaaatacataagacagttattaagattaaaatttaaaagcatgtaatgaaaatcttaacatggaaagtgaaaggctaatagaagagtgctgacttattccagaaatcataatctactcatgaaattctttgtggtggcataattttaaaattgcattagacaatgacagtcttatcaggcagggtgttttcaactgcaaataacagaatagccaactaaaatttgcttaagcaatttggacatttgatttatctctcttaacaaaatctctagaggtaggtggtcctaggctcagtaggtcagtgaccaggtagttcagtggcttggtgatgtcatcgtaggtccaggctctgaccatcttctcgctctgccagccttggttgttggcagccatctccttgtgattgcaagatagctgcagtaacaacacatcatcacacaaggatgtccaaagcaggaaagctggggccagggagaggtaatgggtacatatctccctgcacctgtttcttataagggaggaatatctttcccagaagaccccagttgacttccatgaagtctcatagaccagaacaaaggcacacgctcacttccaaccaacttgtggcaaatgggaataggactgccactagcagagaagccttcattcattcatcccgaggctggccacaccgcagctgaatgcctgaataaaactgtggtctgttagcaaggaagaaagtgtgatgggcagttaagagtgcctcccaaatgtaggtgaggaataatagtttatattgttgagcacatctagtaccaggcaccttactatacaccttatgtgcattctctcatttaattctcactagctagaggccattattatctctatttctcagatgaggaaactgaggcacagagtagtgatacagtttctccaaggtctacacccagataagtggtagaaataggatttaaatccagacagtctgaccccagagccagctaagaatttacatgggtaactgcaaaaatgtagaagcagaaaagacaggtgacaaaggctacagaattcattttgggtggtaagttagttaaaggatggtaagttagttaaaggagaagagttgtaaagcccttcaaatttcagatgaaacacatctctcttcacccatcttcactgcattatgctaagaaagaagaaaaactcttgttaacaagctttatactttttcttttaaaatgtattttatttattaacaatatatttttaaatgttttttaaattcacatatattgctaaaaccataacaaagatgtttatttcttgataggtcttttatgtattttattataatacacgtatttacattttactatgcttttttccaaacctttttattggtttacactgtctttctgaatatgtttctgagtagcttaaaaacattccatattttgtctgttgttgtctatccaaattctttctcatttatcatcatcgaaataacagcacaataaatatctttgttcttacagcttttttttcctttagaataaattccagggagtgggttactaggtcaaagagtctggacaattgtgtgacttcttacatccactgctaatgtgttctccaaaagaactgaactaattaacattgctgccagaaatgtaagaatatactcgttttctgatatcacatcagctttgttttatttatatttatattagtttaatagccataaaatggtttctcattattttcttccttccatttctttgatttggagtggagtgtttttctataggcatgcttgcaagtatttcctcctttgaaaaatctgttcttactctttgcccattaatctttctggatcttggtgctgttgtgattcacatatttcaaaacaaagttggcttaattttatttctgcaaactgaatgcagactgaatgactggttcgtctagacttacacttgggcggacccaaattccagcttgtttcctcaacctcctaaatttcaacaactgaggcataaatgtcaatcttagctataaaaatatgaaaacgaaggtttccactacttattttttttcttcaaaagacatactaggactgctatatttgaaaattctaagagtaatattaacgtttatgcatcagtccttgttttcataagcaactacactctctaaatgaagaattattctttcagtatgggaacaatagccatgataaaatatcttttgtgtctttatcctaaaattgctaagtacaaaatcagagggggaataaagcagtatcttcagattttgttttgcttaaataggaaaaaaactccttaaaataacacatacactaaaactatttaatctttcagcaaaaaaaagaacaggcattggtatacaaacacttttggactccaccactctgcctgttatctatttctgttacctaaatattttttcccaaaccagaatccctaagagaaacttaaaatacagattcctgctccccgctacccgccccgccccgccccgccaaaggtctaacaaatcaaaatccttagggttgcatcctgaatatatatatatgtaattttttttttctttttttagacggagtcggagtctctgtcgcccaggctggagcgcagtagcgcgatctcggctcactgcaagctccgcctcccgggttcacgccactctcctgcctcagcctcccgagtagctgggactacaggcgcccgccaccacgcccggctaattttttgcgtttttagtagagacggggtttcaccgtgtataaccaggatagtcttgatctcctgacctcatgatccgcccacctcagcctgtctcacgccaggcataagccactatattttttaaatattcccccaagtgttcaaatattttagctgcaaaattctctttttaaactaaatctttataagaaccataagactaatatttatattgatttttaaatgctgctaggcaaaagacctgtatttactcttgcagtgctttgaaaagagtttctgaaagataatttacacccttaattaatcctttacctaaaaaagagtagaggccagaaacaaatatttttgactttttatagtacctgactgctttaaaagctctttgtaagctgaccgtaggcacagatcacgtggcatccactatcaatactcataagtctaatttatcctcaggatgttccctgaagtattcaggaattcttagtcctattacaaagattttgttgctgtgatagtggttttgtttgtttattcagaaaaataaaagtcaaaaaaacagctcctgtataacgatggtacaaccatgagtaattttattttttcaagcttttctttaacgtcttgaggaaatgatttttatacttcagggaaaattaaaagggggtcattaaaaaacctggtggcattcccaatttatctactgatggcttttgaattcttctcactgtcagttaggagactgacattatctcagtcattaagattattagaatcttattctaggatatcaataaacatagtggatagtttattaatgtattcaataatgtcaatgtccacattatcctactgctatatattatctacacacacacgtacatattccacatacgtcaataaaaatagtaggtggtttaataatgtcttcaataatgttgatttctgcattattctactaatatgaattatgctatatatatttattgcatatatatgtagaatatacatataaaaagaaacctgtaagaacttgagaccagaaagatattaatgtagacatctccatatgtcaattctttcctaactctccaagatattcccatgtaggtgtttaaatcacagaaaagtacttctgctggaatctcacctaggtaaagagaaagctctgcagttagttttgtcttctttctgtggcccagaaaaacaaagtcatactatgtgaagtgggctatgaggagatacagacaggcgactctatgtgggctgcaagtgaaagagttaactatttacaagcccactgatgcctccaacactggctaaatctcattattctgccttattccagaaacacactcataatccgcacagggttcttgaaagattacactaacgtttcttagcccagccacccacaatgggagtattctgtacacaattctgtaatacacaagcagtgaatcttctggcctcacgtaactaaaacaagaaaaatactcaataactcaacatggtatcatgctaaacttccaactccaagacgaggcacggtggctcacgcctataatcccagcactttgggaggccaaggcgggcagatcacctgaggtcaggagtttgagaccagcccgaccaacatggcgaaaccctatctctactaaaaatacaaaaattagccgggcgtggcggtgggtgcctgtaatcccagctgctcgggaggctgaggcaggagaacctgggaggcggaggctgcagtgagctgagaaagcgccactacactccagcctgagcaatagagcaaggctccatcttaaaaaacaacaacaacaaaaaaaacttccaactccagcctgtaattggccagaaatgtcagtactttctgaactatcctaccaaagtgtcctaacagcggaggagcatctcttaaatacaaaattaattattctcccttatggttatctttaaaattcttgcaaatgttctaccttagtgtgtgtgtatatgtgtatagacacacatacatgcatacacacacacacacacacacacacacacacacatatatatatttgctttaatattaaaatcatgtttcctctaaaagtaggggggaaattgatactgtaggagtatgttccaccttactgtgtgtgtatatgtgtgtatagacacacatacatacacacacacacacatatatatatatttgctttaacatcaaaatcatgtttcttctaaaactaaaggggaaattgatactctaggcgtatgtactagttgtactgtggcacttcatcatgtccccagaggggtgcacacctatcagattaactgccttttccaaaatgctctccttccatccgtgaaacacatctacaaatcaagttcctaagagttatttgtccaaggtgctgccctgaggcccaaggcaatagttaactgaaccagagaagtattcagctcagggcagccaaggagattccctgtccagagaatgtgagaaggagatgaagagtgagggtcagtctctctttggctgaacctgtagccatatgttccacaactatggtccaagaagttggaaaggcggtctttagaaaaggaaggaatgaagaagacactcagagagaagcagacaccagaggtaggatgggaatgctgcctgttcctcacagagccctgtctatggggttacgcttcctggggctgggctcccatcatttggaagctcagcttcctgagtagtcacctcagcatacacagaacactcatgtgagaaacacaagctaagtgacaaaaaaaggcaggcacaatagagcagcctggggccttattcaccaagagataaatcacttgctgtgggcacaccccaactctgaaagaaaaaccaaattaacaaccgtgcaagctcctatttggatataagctaggtatcccttcttttctagcaagaaggaataaacctaacatgacttgcattaaacatcatagttttggaattgagaatctgtaaattgtaagttatggccccaaaacaaaagaagaactacaggcctgcctgtgaacttccttttttctaggctgttacatgctttgctgttgccactgacagtgtggtaagaggcggccccctgggtttccccagccaggctgccccatcgaaggcagctacacagcggccaggacaagccagccagagccagtagggctggagccctgacaaaggcaacgacgctcctggagtcagataatgaaagccagagcaggaaggaccctgcgcttcatgtaagacgttcaccaaataaagaaatgtttaatcacgcatctgtgctgtacattgcaggagcctttgaaaagcgtaatgcctgggtgcagtttaaaaataaggaatcttaatctatctggtctaactttagaaaattgtttggaggggattcttaagatactctgaatttatactttcttaacaggggctgtcttttgtatatgtggtttgtgagaaaatgtgtgattgatctgtaatttgagcctcttttcaaagcttatagtatcattggattcaaaccattttcatttaatgctctagatggcagaacactaagacctaagcaattaaaaagggaaagatttcagataatgaactagtttctagtgactgtccaacagtggaccaggctcatttctaaatcactaggtgtctaaacttgacaacagttaaaactagatccctaactgtcaggagcatgagtacaaaagattcctgctgttctatgatgtgtttctgactatgtgtctttgaaaggcctttcaactttaatgctccaaaatttagatgttctccatataccaacggctttataaaaagtaaatgtaagcacacagagccaaaagacaacttgaacacaagttatctacatcaaagtaacaaaaccaaagtgcatttgtctttacaccaggaaataaatcaaattgagacagatgaacaggaaaaaaaatatgtcatgaacctgaagttaaacatctacttttcaggcttgaatttttaaaaaatacacttctaagattctttcccaagaaggcttcatgtatatacaaatacattaatcccccttagaatagatttaaaacaaaggccttggtgtttcagaaaatggcatacaaaaggggaggatgtaaggccctgtgtataaacaagtcaagaggctcgtatcctaagctaatcgctcctgtgcaatgggaggcagccacatcaccctagtccaggacttccatgtactcccagtaaattgtaaactgtcctgtaagggggcttcagccttctcatagatcacagatcaaagaccaagtctataaagagagaggaagaagaaaaaaactgtattcatgctttgggtgcctcaggaggtacagaaaagagagaagtcagttgatgtctccaaacctctacaagcagctcatcttcaaaaaaaaaatggaagaataggtgaaaacaccaatccaatccccaagaagaaagcactctccttgcacaggtttagtgtttaaaatttcaggtgcctgagcttaagcagattccaggactctcttggaggtggcagctatcactgtgtaggatttctttatagtaaaggtgattagctctctttcagatcattttgcaaaggaagtcagttggacaaatgtgagtaccatgtagacccacctgggaaagctaaatatttaccagttcagtttggtatgacagtagtttttaagaggtattctttaaaaaacaaattaaaagcacacagaaacacagaagttttttttttttttacttgattaaaagaatcaacaggcagtaacagtcagctttttagtgattattataaaacttcggggaaaaaaacaatcatgactttcttcagttcctttttcttttatttagtatcttaaaacaattcaatatttttggacaaattttttattgtgtaaagtatacataaaatttaccattttataactaaaagagtataattggattatttgtaacacaaaggataaatgcttgaggggatggatgccccattctccatgatgtacttatttcacattgcatgcatgtatcaaaacatttcatgtaccccacaaatatatacacctactatgtacccacaaaaagtaaaaattttttaatttaccattttaaccatctttaagtgtacagttcactgggattaagtacattcacattattatacaaccattaccatcattcatctccagaaatttttccctagcccatactgaaactccgtgccaattaaacaataacttcccattgcctcccccctttatccctggtaaccactattctacttcctgtctctctgaatttgactactctaggtaccttatataaatgaaaatcatacaatagttgttcttgcatctggcttatttcacttagcataatatcttcaagttcagctatgttgcagcatgtgtcagaattcccttcctttttattttttctttttatttatttatttattcatttatttatttttgagatggagtcttgctctgtcacccaggctggagtacagtggtgtgatcttggcttcctgcaaccactgccccaggttcaagcagttctcttgcctcagcctcccaagtagctgtgattacaggcatgtgccgccacacttggctaatcctttttttttttttttttttttttttgtatttttagtagagacaggtttcaccatgctggccaggctggtctcgaactcctgacctcaagtgatccacccaccttggcctcctgaagtgctgggattactttgggaattctttactaggccagaatttccttcctttttaaggctgaataatattcacatatatcacattttgtttatcaattcatacgtcattggacgtttgagttgtttccatcttttggttattgtggataatgctgctatgaacatgaatgtactaatatctgttcacctctctgctttcaattcttttggatatatacccagacgtaggattgctagatcaaatggtatttctatatataactttttgagaaaccaccacacggtttttcatggcagctgcaccattttacattcccaacagcaaagcacaaggtcttcaatttccccacatcctcaccaagatttgctatttctggttttcagatagtcacactgatgagtatgaagtggtatctcatttgtggttttgactggcatttccctaatgatcagtgattgctccattttcttctaaatggtgttgcaaaatgtgtcttcttgttttgtttcagtatctctttctgtaggatagaaatgtaatgcttgctctgagtagatattcatgaagtgctctgggagttctgaagaacttccaacacactaaaactaagaagccagggattccgttattcaggtctcaaccacctaccaaatcttgcagcctagacagaaagacattgccaagtttccttctaggctcttaaagactaggtaaagcagccttaagcacagtcctcctacaaaggcaataatgtaagtttttattgtctaggaagattaatgaactgggtgagtaaacatgaaaagcaggatggtcccaggactctagacccagggatgcaaatttgggccattgagtccagcattgcagctcctaccagaggcctcccctgagtagctcctgcttacttatatacatctgtgtccccctcccagagctaaacactaagaacacaacatagcaacagactcaaccttaagaataactttgtaaacctaagaaacaaaaacaaagttacttggaagatatgggagttaaaaatccagttttgagacaggtccttgttaaattcccccgatctaggttcctcttgtctagcccaccatgatttcccagacttctgcagataatctctttcccttctgcatctaagctgatccaacactccttaggctgcctgagaaaacttcactttcaaatcttttctcctttttgttaaactgtcgtcctccaactcatagtcattaattcaacagccaacaagcatatgccgcagactccaacgtgccaggtgctgagcttggcactagagacaccatgatgaataagaccaggccccagcaggaaggacttgctgtagagggagcctgccttctctaggttcttactttatctaaaatgctaatgtatctcctggggcatataaccaccttttggtcatctatagagtcacttgctataactcattgaaaagaatatggttgaggagtttcacatttgtgtgggattcccatgagtgtgactgttaatttgaggggggaaaaaaaaagaaagaaagaaaagaatgtggtccaataaagaacacaggctatactatcttatatgaccttgagcaaaatcactcatcagtggccttgcctgaaaaacggtaagactacttttcctagaaacagagacctaaaccaaacaatatttttaaaattttattattattatactttaagttttagggtacatgtgcacaacgtgcaggtttgttacatatgtatacgtgtgccatgttggtgtgctgcacccattaactcgtcatttagcattaggtatatctcctaatgctatcctccccactccccccactccacaacagtccccggtgtgtgatgttccccttcctgtgtccatgtgttctcattgttcaattcccacctatgagtgagaacatgtggtgtttggttttttgtccttgtgatattttgctgagaaggatggtttccagtttcatccatgtccctacaaaggacatgaatcatcattttttatggctgcatagtattccatggtgtatatgtgccacattttctgaatccagtctatcgttgttggacatttaggttggttccaagtctttgctattgtgaatagtgccgctataaacatacgtgtgcatgtgtctttatagcagcatgatttataatcctttgggtatatgcccagtaatgggatggctgggtgaaatggtatttctagttctagatccctgaggaatctccacactgacttccacaacggttgaactagtttacagtcccaccaacaatgtaaaagtgttcctatttctccacatcctctccagcacctactgtttcctgactttttaatgatcgccattttaactggtgtgagatggtatctcattgtggttttgatttgcatttctctgatggccagtgatgatgagcattttttcatgtgttttttggctgcataaatgtctgagaagtgtctgttcatgtcctttgcccactttttgatggggttgtttgtttttttcttgtaaatttgtttgagttcattgtagattctggatattagccctttgtcagatcagtaggttgcaaaaattttctcccattctgtaggttgcctgttcactctgatggtagtttcttttgctgtgcagaagctctttagtttaattagattccatttgtcaactttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaacagggaatcctttccccattgcttgtttttgtcaggtttgtcaaagaccagatagttgtagatatgtggaattatttctgagggctctgttctgttccattggtctatatatctgttttggtaccagtaccatgctgtaaccaaacaatttttaaagggaagttcatcaaatgcttttttgccaaccaaaaaaaaaaaaagaagtaaaaaagatagacaatcttttcttaaaaaaaaaaaatgtttcttttctaattgttttcttttctaaaaacataagtctatatgccaaagataaagctttgatgactgtacacaccctgtcttcttccatagtagctgttattactgctgagccttctgaaaagtgtttaaggagtgataacaagggaccctagagaatctgagacttttcgttgctaaacaaaaaatcagaaccacgcttgagatgttatactactaagacaacaggaacatttgtcacatatcaaacaagagacagggtctgctaactgcagcgatggccagaagagacagcctgcaagtctagttcatccttatgaagaaaacaggatctgaaaaaaactcacacctcgaaatcatctcttctgtgtgacgggacaagagaaaaaccgagggcaaaatgcaaattcacatgcaactagaaatcacaactaaaaatctgtaatgtatgatatgtgctaggctttacaataagagtctatgagaaacagcttacttcctaccagccaggacaaaatattcgcacactgttatacaaacaaatcttcctagccatacggtagttccctctgatacagcactctgggcagagagcaataaacaaaatccagacaggaagtagccagaaagaataaatggcagagctttctggcagtatcttcctgtagagaaacaagagacagctttttattttaataaaattatcttagaacccaggccctaaaattacttattaatatgattccccacagaggtggggaagttataaatgaggttgtagtgttttggctccactcctagagtcaacatcatgaagtgaactctatttactggccactgacaactccagaatcaaattcccatccagaatgaacaattttgacctaccccctagtgggtgccctttctgaagccttttctcattttaaggcatatggatttgtgctaacggaaattccacgtaaaaatttcaacctaccaaaatgagtgcattctttccacagaagaatgtttgaagaaactacagttgcttttaagttaagattgacaggtcaggcatggtggctcatgcctgtaatcccagcactttggaagaccgaggcgggtggatcacttgaggccaggagttcaagactaatctgcccaatatggtgaaaccctgtctctaataaaaatattaaaaattagccaggcatggtggagcacacctgtaattccagttacttgggaggctgagacaggagaatcgctttaacccaggaggcagaggttgcagtaagccgagatcacgccactgcactccagcctgggaaacacagtgagattcttttaaaaaaacaaaaacaaaaacaaaaaacgttagcaatacattcaaaatttactttcctaacatggatatctaaacaatacattaagcaagatatcatattgcatgatatgctctggtgctgtctgtgaataataatgcctctttaaaaggtgttgtgtcttccctgcactgggcccagctctcctgccacagcccctcaccccctgaaaatgtacacctgctccaagttcgtctccactccctccttggtcaagagcgcctcacagctgctaagccatctgctacctgcagtggtgctgaaatgaccagagacactgacaggtgagaacctcagcagcttggtagtctcacgtccccttacctcacttgtccctggccgcagcttggaaagcagcgccatttcaagggacatcgacacaacagccaagttcattggggctggggcgccacagttggggtggcgggctctggggctgggattgcgactgtgtttgggagcctcatcattgattatgccaggaacccttctctgaaacaacagctcttctcctacaccattctaggctttaccctctaggaaaccatggggctcttttgcctgatggtggcctttctcatcctcttccccatgtgaagcagctgtctccacctcccatatttctttctcccatgtcttgtcagccctgtatgtttcttttcctgcacctccccagatggcctggggaacatggttggctcagggtttgatagaggaaagacaaatactgtattaataagaaaaagaaaaaaaaaggtgtcaagtttgaatttgcctgaaagccacagcagtacaggaacactgaagggcaaatgtcactattccggtgtagcagaggctcctagctgtctccccaggatccatcttctctctcctctatagtaacagaagccttagctaggcacatggctgcctccctaaagattacatttcccagcctgccttgtagaaaattaattatgtgattgattctggctaacggaataagatgttttcaacttccaggtcatgttcttaaaagaaaggaggccagaagcccggtacagtggtatgcatctgtagtcccagctacacctgaggctgaggcaggaggatcactcgagcctaggagcttgagaccagcctgggcaacatagtgagatcatgtttcttattttaaaaagaaaagaaaaaggaaaaggaaaagaaaggagcctgccctcctctttcctacttccttttcccatagtgatagaagatggagcaactatcttagctgaaagatagaagctatgtggtagagatggcatagtaataaaagaaaactttatccccaacatcatggagtcatcttctcagtcttggtttgtttatgctcagaccattatagatgagagtaaaataaacttctgtgttctaattttgaccaaataagtatcccgactaatacctctcttgaagcactttgaattcaaccgctatcttttgttttgatagccattccttacgcagaaagcatcctggatttcttgaaaggaatttcccagcatgttttcagcaggcactgtcagagtttgatgatagcatcaacgtttttgagtttttagtatcatttttcacaatccttgaagtcagagctgcaacaaatagttcataacatggggtggatttcctccctttccctcagggcatcctcacagaaggagaaagtcttcggctctagcacccatccagtaaagggctagtcttgtcttccccatctctgtctctagccagagatggcaggatgctcctgggcactagaatccttcacatcatttataatatgggaacctttctttaaccttttccagactcctgagggtgattagaaaataacatttcccaagttcaagaaatcaaaacccatgactctatatccctgacaaaatggacaaaatacttaggtcaaagttaccaggtcagcttttataggctccttaaaaattatatggttttcttttaaaagacactaaaagttctcaattttttaatggtcattgccatttacaaaataaaaacgatagttggctcaatgacaaggacagtaaaagagtcagcagcatcttgggcacactgagaaaacccagtaaacctcccacagaattccgtcctcatagaaatattctgtccaacatcaaccctgaatcccactctagccaaaaattcaaataagtgcaaagacatcatgagcccattccacatgccaggtagctttttcttattttagacagagaaatgctaacgtacttccttaagtaacagcactttttttctttttttttttttttggtggggagggggtggggagacagagtcttcctctgtcagccaggctgaagtgcagtggcatgatctcagctcactgcaacctctgcctcctgggttcaagtgattctcctgcctcagcctcccgaatagctgggactataggggtgcgtcacagcaccagctaattttttgaatttttagtagagacagggtttcaccatgttggccaggctggtctcgaactcttgacctcaagtgatctgcctgtctcagcctcccaaagtgctgggattacaggtgtgagccaccatgcccggccagtaacagctttttaaaaatgaagttgtgggctacctcttttttttctttactgtctctgccttgtctaataaaaatgacagaacattttgtttcatgattctctatctcctaagtgtagagtttctcatatgcagagatcattataattgagaccatttatgaacaaagcatattaaatgttaccatgaaaatactgcaaaccaatgggtatcactttcctttaacacttgaaaaagcacataattccatgatgttaaaaagagagacaaaaaggaacgtttttaataatatttcaaccctttggctttattagcagtatgacataagagttctaatccgaaaaacctatgttttcacaaattgaaatcgagtagtaaaagccttttgtcacatcctccaagggctaaaatgtaaagcatatgacatagccctatataaaaatgaccttcagtaaaaataataaatcaaatgctcactctccaagcagaacgtcacaaactgaataccaggtaaaaggaaagctgtacatgaaggcgttgtgctttcgtgggaaaatgattgctcatgcaagcagaacctattggaggagaggtagccgcctggccaggctggaactcatagtctttcaggggttcagctggaggtgaagactatctaaagaattcgccaccaagaaccatcattttcagtcctttctgattaaggaccaaaataaaagctcagtagctacttcattttgataatttttagaaagcctcaaataacagctaagaactttctataaggatgccagaggaaagggggaaaaatggaaaattacagttgaaattacatccttaagagagccagttaagccactaatatacaaacagatctcaagtctgctgtctgacccagaaaaccacagatgaggaattcattttaggactaattacacaaacattaaatcactcaatttttcaccctttatatttaaaattttggcattttcctccctttttctttacacgaactgaatgacagtccctaaccaaaagacttgaccttggaaatgagaaatcatctagtatgggcatgcaagagtgtcactaaactctgtataacctcaggcaagtcattgcacctttctattctgccatttccccaccagcaaaaaacaaaccgcacttcctactacctgttgcgatgaaaaatgaaatactctaagtaagtcaagcacctcagaggctttcaatgtgttttatgacattcatagagtcagttttgagcatctgagaaataatctcttccatttaatcttctattcacaatatagaaaaatgtcctatacggtctgttaaaaataataaaggcaaaaagcttgaccgtctcaggtcatggagaattactttctctgaaaagcccagtcttctagattaatatccaaaaggacagggattttgtctgttttgctctgtaacatattctcagcacctagaacaatgccacatcaaggcattcattaaatattagatgaatgaatgaataaagggaataaaggtttagcctgaataaacatggaaatctttttattctagctattttaggtagacatcttaaaatgtatagtagcattcttccttaccatcttgagaaaattataaggacattttgcagatgactaagggtcgccatcatgcacattctgtatttcaaggatgctctcagtgtcttttaaaatgctaaaatcactccagaatctttaatgtaatttttcagctcctttatgcatttatcatttttcccatcctcctccacctttctaataggttgtcatttctccctattgtgaacaattggctgttgctaatttattgtgcacgtaaaagccaattagccatgtgtctaaagtaagagtacctgcctctgagggcctaaggccttctcctaagaggaaaaaatatgatccttagactttgccacatctatgtttggctccattttttaatgtttcttgattctccaccacgttctagataggtaaaaggccagatagccaagttccaaataagtgtacccaatcaattcatgctgaaatgacatgctgtggtactaagaggcacttgctccatgagacagggtatctgaaaacaatggctccagataatgctggttatctaagtaagcagctgtttcaatgctagagtagggttgtccaagacaaagcaccaggagtggagggaagactgtctctccgtgctgactgtccaagggaagaagccattccagaggagctggggtcggggtaagacaccaaggcaggaactgagaaagtcaccagaatcagggtcaaggtagaaatcacaacttgggaacaaagccaaagcccagtctcccaacaagggacacaaaggcaaggccagacctgacttgacacagagtttcagggtcaggctggagctccttaaatccttggatccagaatgggatctccaggaaggagccaaatgtcttagattgtggcaaggctgaggaactcagcacaggttttacaatagaaaaagaagggcacagcatggccaactacctccttcaccatggcccaagggcatcacaatgggaaggataaggtgagggataccccagaagctgtggagctgatctatgaagcccttctatgcccagcttcagcacatgtgccatgaaaatctatcagtcttgttaatagcaaaggtagaaagagtggttcaggaagataaatctggagaaagaagcatctgagatgcactggggcacgggaaataggaggcaaagagatgacaagttatccaagaacaatgtgatgaaggctctgacaatttccaactttgggtaagaaaagagagaaactatcattttttgtgactttctgtgaaccaagcacaatgctggcattcttcacattcgttatctcatttattcctcactttaagtctgcaagagaagtatactgttcccattttataggtgaggaaattaaaatccagagaggaaaggaattgtagtcacatggcgtggatgacagagatgcgattcactctggaatgatctgattccaaaagctgattccacttgcaccagccgatacccaggtgacttttttaaaatggaagaatgcggtgaatgggataaggagggggtctgtatgtctgcatgcatctgcttttcatgggcttaaggaatcagcctggactgagaccttcctcatatgccctgccttcactccgcagaactgggaatccatcagactggaggctttcatccctaagatgcctccctaacactggggaaatcatgttttaaaatgtttttttaaattgtaatgatctaaagctacctatctaatctgtgtgttgattgctcagcgttcttaaatcaggatgtatctcgtggaaccttagattacagctggtttggggaaaaatatgactcagataaaataagaaatgcatactcaaaaaaagtccaacatttccatgaaaagccattaagctttggggtgctggtaatgtgtttttgtttttgtttttgatctggttgctactcatagagtgtattcatgaagatatatacttattaaatgtgctctcttccacatgtatagtatgcttcaaaaaagttttttaactgccagagcagagtaacattttatccctgccctgttccagtgtaaactggccttttataaataagcaataaagcagggaaagtttgaatatggagataggagcagtaaggctcctctctcctaatggagatccactaagagaagcactctactcataaccagaaggctgttgccttggaaacgggagctgtaactactgcaatcacacctcaggagcaaagatggccaagatctatttcaattcttagatatctcgaggaaccgcagatgactgtaactatggaagatagccaatctgtagtaatgaagaagcgcatgctggagttagaaaggctgcaattgagaaaggaaaagagggggcaggggaagaaggagaagatagaattgaagtataacaaggaaagcctaatccaagaactgcagagctgaggggctcttggtggcatttctttaagccatgccaccctctagtttattgcccacctactacctgccaaaccatgctaggtactgggaggacaaagccaggaaaatacacactcaaagtggcccatgggaggtataagtaccctgggaccaattaacctcagtgtgcaaaatgggtacaggaggcttcggagagacagtggcatttttaagctggaactcaaagaacatgtaggaatttcccaggcagagaagactgaggagagacatctcagacaaagggaggtgcaaagggcagaggcatgaaacagcatgttctgtttttcagcagggtggctacctgcaattctggataggacacttccatgtctggtagattgtcccacacactgcaggacatttgctgtctcagaccccacccactcattgctggcagcaactcccagtcatgacaacagctaaagtaatgcccctcccacatttccaaatgtcctcaaggatggggggatgctattgttcccagttaagaagcctgagaacctaggggaacagatgtgtggctggagcagggattgggggacaggggtgggaggtgaggatgagagtgcaggtaaagatcagagttaaggccttgcacatgccactcgggagtcagactctgtgccagatgtggaggagagagaacagactctaaagcaattatggaggaggtcaaacttataagacttggcaactcatgagatctgaggaggtggggaagaagaaagaatgaaagaataaagaataatccccacagtttccagcttgaacaactgagtaaacattcatggcaccaagcaaagtgacaaatataggagtaagagcagctttggacggggatggaaaggtaaggtggaaaatgagtctgaagcccttcagggacatccaggtggaatttctaagaagtaataaacagcagactaaacgcagaggagagacatctgggtcaaaggtaaaagaaaccttagcatttaattgtaggcagtgtctgagccatttcccaagggcctccagtctcactaggaaagtcagggaaagggagagctggagacgaggaagctgtagcactggagctgggcataacaaacaggagccaatatggcagaaagtgggtaccggcaggcaggaatggagggagcggagccagctggcaaggtgcagatgagcagaccaaggaagagtggctgaaagctcatggtaccccacactggtgtccacaaccagcctttctgtggatcttggcacacatcactacagtggctttagaaaataatcttccatctcaacccaggtcatacacatatatacacacaccagggctggctccatgagcaagcagaccgtgcagctgcccagggacctgtgctgggaagagccgcattcttggttaaatgctctgctactgccatcttgaaattcttaaagattttttaacaaggagtcttgcattttcatgttgcactagatcccacaaattgaggctggtctggacacacaaaaacatagccttaacaaaagtttcatgaaaccatatctatctgctatggtctgaatgtttgtgtgcaccctcaaaatccatatgttaaaaccgaattcccaataatattaagaggtgaggcctttaggatgggattagtgcccttataaaacaggcctgagggagcttgttccttctaccatgtgaggactgtgcaagaaggcaccatctacaatgcagagagtgggccctcagcagacactgaatctgctggtgccatgatcttgaactttccaacttacagaactgtgagcaataaatttctgttgtttataaattacccagtctaagctattgtgctatagaatccttaacagactgacattatcttactaaatgtgatataaaattatattctctgttctattttttaatgtagccatagcccattaaattcacaatccactaatgcattgcaaatcaggtttttttgttgtttgttggttgctttgtttttgagacagggtctcgctctgttgcccaggctggagtgcagcctcaacctcctgggctcaagtgatccttctacctcaacctccctagtagctgagactacaggtgcataccaccattttttaaattttttgtagagatggagtttcaccatgttgcccaggctggtcatgaactcctgggctcaagcgatctgcctgccttggcctcccaaagtgctgggattacaggcatgagccagcacgcccagcccaaggttttaaaactgtcttagagggctgctattgcctgaatgtttgtccccaacaaaattcatatgttgaaattatatcgccaaagtgatagtattagaagttggagcctttgggagggaattagagattacgacccttataaaagaaactgcagagagctggctagctccttccatcatgtgagatcgagatcacaacaagaagtctgcagcctgcaactagaagagcacccttatcagaaccttactaggctggcaccccgatctgggaattcctagcctcctgaactgggagaaataaatttctattgttttatttgtttgtttggtattttgtttttgtttttgttttttgagatggagtctcactctgtcacccaggctggagtgcagtgacacgatctcagctcactgcaacctccgcctcccgggttcaagcaatttcctgcctcagcctcctaagtagctgggactacaggcacgtgccaccacgcccagctaatttttgtacttttagtagagatagggtttcaccatgttggtcaggctggtcttgaactcctgaccttgtgatccgcccgccttggcctcccaaagtgctgggattacaggcgtgagccaatgcgcctggccaatttctatcgtttataagccacccagttgatattttgttttagcagcccaaatggactaatacaatggggtaagccaagactaaaaagtttgttttgttttgtttggagagtggagcccttaaagtggaattgctgccattatgaaatagacccagagagctccctcaccccttccatcatgtgaggacgcagcaggaagacagacatctatgaaccaggaattggaccctcaccagacaccaaatctggtcagcgccttgacagcagcctccagaactgtgagaaataaattcctgttgtttatgggccacccagtccacggtattctgttggaagcaccaaagcagactaagacaccctcctcccacacaaaaaataaactaactttaatttgggttataaataactatatattaagttgacttataaatgattagttgacatcaagttaggtcttataggtatttgattgattaaatacacattaacttagattttgctattttctttcagtattcaaagaagccaatacaaacttttttttctaatttcagacatattttggggccattgaaaagctcaaaggcccgaggcccaaggttcctaattcctcagtattcaccaggcctgcatcctctgggactgaaggaaagaagtcgcagagtgaaagagactgaagaaagatgaggagaaatttgtcaggacatttaagaagccatggattctgatagacaacaagctcctacaaactggtcagaagaggatagttaacccgatttttttaacatcaaattaaatgaataagcaattcaaagaaaagaaagatgcaaaaggtcaatgagcatattaaaaaggtgtctgggaaatatccattttcacatagcagattggcaaaaacagtcattcccatttgatgtgctaaaaagccaaaattattctaacacacagtcgccaaaatgctttgcctttgattaaagatagcacttcccagtgggggatctagaaatggtttgaaccctttttcaataggccactgagagcctaagctgaagctgcccaggaaaaagagaggaagagggcgcagggcctaggagccaggccagcacctgcggcctgggcttcctggagtacatatcagattcccgaggcagctgccagctggctggttcacccacaaacaccagttggctggagcctgggaagtgataccttgaaggcctaaggccctaaatcaaatgtccttgtctatgctaggaacaacctataaggaaaatcttatcacaaaacaagcagctctcaggcatgtcaaggattttaaaaattaattccttaagctgatccagtgataaaagctgtgaataaaaggattcagatgtttccacctcatcatgctaatctacctgtaagctagtcaaccaaccacaaaaaaaaaaaaaaaaaaaaatatatatatatatatatatatatatatatatatatatatatatatatgaatcagacaggcttttgagcagctcagttgccccactgcagcatggagtatgtcacttcacaccaaccaaccaaatgactgaatgaatgaatgagaactgtcaagtccatgtggacatcactaaggggacctggcacttagaagtcatgttcctgttctcactgagacactaactagttaggtaattaaatcagggaagttagtgaaaattctctcagcctcagtttcctcatctataaaatgggaatgataactatacccacctcttagggttgctctgaggcacagtgagggtctctatgaaagcctatggcagactgaaatgacctctcttcagataaaggcttgccgcccagctgtgcagagtgtggtcagcacatggcctccagctgccagctccttcagggtctgcccctgctgcagagagccacctcacctgagatcacaccattcctgtgacaacctgcctgtaactgagaggtaaggatataaaggcccacgatggcccaaagcaggacacggtgactgcactcactcactccagggcttcctgccaggtgtgctgaggccttttcaacttttccctcggcccagtcctgcgtccttcccttcctacatgttggtccctaacgagcatctcacaccccagattccatcttagcatcttcttctagagaacccaacctgcaccaaagccctttttcagttttaagtactttagggtttctttaatgggacaaagaacagaggccaattctggtttagaaaaaaaatcacactcagtctggcatggtggcttacaccttgtaatcctagcactttgggaggccaaggtgtgaggattgcttaaggccaggagttcaggatcagcctgggcaatatagagaaaccccatctctatgaaaaaaaaacaaaaacaaaaattagccaggtgtggtggcatgcacctgtagtcccagctacttgggaggctgtggtaggaggactgcttgaatctgacattttgaattttgaggctacagtgagctgtgattgtaccatgacactccagcctgggtgacagactgggactttgtctcttttctcttttttttttggagacagactctcgctctgtcacccaggctggagtgcagtggtagtggtgtaatcacagctcattgcagcctcaacctcgcgggctcaagcagtcctcccacctcagcctcctaagtatctgagactacaggcacatgccactacacccaactaatatgtggattttttgttgagacaaggtctcactatgttgcccaggctggtcttgaactcctgggctcaagagatcctcccacttcagcctcccaaagtgctgcgattacaggcataagccactgtgcccaggtgacccagtctcttcaaaaaaaaaaaaaaaaaaaaaatacaacacgcactcataaaattttagaaggggggatccatgccatttacttcaagtattcaaagactggtagttcattcatttacttatttaacaaatatgtacagagcaccatgttgggggggtgggcaacctgctgggaccacaagggctctgtactgatgatcatttagggctattgcactttctatgtccacagcagtggttctcagcggggtagcactgcccctacaggctttggaaccgggttgggggcttttggtcgttacaatgattacagggctctgctggcatatggggggtgggagcaggaacgctacagtcctacagtgctctagaaaatttcttttcatggtggattggcccacatcccacatgattttcataaaagagggggaaagagtttatataattatctaagtctagatcttaactatgcatttcataaaatattgtttagttttaaatacactaaattctctaggaatttgattaccctataaattgagggaaggatgtaatgtattttgttcagaactttactagccgggcgcagtggctcacgcctgtaatcccagcactttgggaggccaaggtgggcaaatcacctgaggtcaggagttcgagaccagcctggccaacatggtgaaaccctgtctctagtaaaaataaaaaattagccaggcatggtggcacgcacctgtaatcccagctacttgggaggctgaagcaggagaatcacttgaacctgggaggtagaagttgcagggggctgaaatcatgccaccgcactccagcatgagcaaaaagagcgaaacttggtctcaaaaaaaaaaaaaaaaaaaggaaaattaaaaaaagaactttgctaagagttttttacaccatctctaaaaatgatgactcttacagaaatgacattcatgattaatgagacatctctataacacacctgtattgctctatatttatagttgtcatattcttagtgataaacaagaaaagacttttttgcccttatttctagggttatatataagagtactaatatataactaaaactattcagctgaatatttcttaaatacaaactgatttatgagcaaaaatgtaactatttcattaggtcttcaatatagctgtccccatattgaaatacatgctactttattataaattattttcatgttgtttctcctttatattataattagagtattacattgatttatttttaaatattgtgtgtgagttctattatctgtgagtttccatttcaggaagaggatgttacaaaatatataaaagaggatgctgggtttgataaggttggaaaccactgccttatagaactgattctaaaactggggtctgaggcccacccacagcacaaatacctgtggcattcataaaaaatccaggtgcctaggctccagcctgtctcataaggatgctctctggggctagaacccaggaatttttttttttttttttttgagatggagtctcgctctgttgcccaggctggagtacagcggcgcaatctcggctcactgcaagctctgcctcccacgttcacgccattctcctgcctcagcctcccaagtagctgggactacaggtgcctgccaccaaggccagctaattttttgtatttttagtagagacggggttttactgcattagccaggatggtctcaatctcctgaccttgtgattggcccacctcggcctcccaaaggaatctatttttcaaagctcctcaagtgatattgatcctcttctcggtttggtacccacaagtatagaggacacggagtgcaccaagcccttccctagcctagaggtgctcagagtctcaaagggaaggtaaaattttaaccatcatgtcaggcacataactgttaagtgctagaaagaaataccagtgaagtgctatgggaattcaagaaaggaacagctgggctggaggaggtgtcttgcaaagggtgcattccagtgaggatctggaagacagggagtaagagcctcatctctggagaccgtgactgcagaggcctttacatacattatctccatccaaattcaaagctactgtctgggataaataccactcctatccagtctttcagaataatgaggcctaaagaagcagaataatttcactcaaggttttaaacttaggccctgcagtcccagatgatagagcttaaccacgcagctaatactcaagccttgaccagagggaaacaggtaggggtggtatggaagaggtcccaaggagtttcaagacatagaatttctatccaaagcttcacttccatcttgctattagcgctgtcaccagcattcaggaggacaagaggaaattatcataattagaagggactctgagcatgtatcattcacatatggctggaaagactcaaggatgagaataggcagttaggagtcactgacgctaatgagccacaaatcatagaaaagtaacttaattgagacaacagcaaaatgagaggaggctcagaattaggagctctcacactgcttcgacagttctagtaacagcgtaaagcagtttctgcttaatcaattcccacctaatcagagagccatcttaacgcagcatctcccaaggcagcaaattagctaatagtgagtgactgcagcaatcaggacagtatcagtggggacgggagggatggaaatatgctaggaagaaaggcaattggctggtgctaaggggttaaggggtgtttaactggctgttaaattgcaaagtgctaagcttctgtgttctaatgcagaaagagttaacaatgaatagaaataaagatgaaatccatctttttttctgttttttttattctgcatcctaaatgtgcatccaggtagttacaaaacttactttttgtttgttttgttttgacagagtcttgctctgtcgcccaggctggagtgcagtggtgtgatctcggctcactgcaacctccacctcccgggttcaagcaattctcctgcctcagcctcccgagtagctgggactacaggcacgcaccaccacgcccggttaatttttgtatttttagtagagacggggtttcaccatgctggtctcaaactgctggcctcaacctcagcctcccaaagttctgggatttcaggcatgggccactgcgcccatccacaaaactcacttttatccctacaaaggtaaagatggaggctctttacacccatgttacaggccacaaggtcttattggacagtaagaccaaaagacctccctacccactttctcttccccaccacccctttcctttctctcattgcgacacgtaggtcgccagcaagcaagtgcctcaaatctctgaggcagagacttttcgctttggaaacatttggagcagaaacaggcggtgtggtctggagcaaacatgcaagagaagaaaataccaagaagtcagagaagaatccctccacgtggaattctcatttgcattttgtgcagtcagcagttctccagtttttccacatcctttcaaaggttgggctctcatgtgttgtgagaaggtcagactaagcgggtttttcttatggtttcaggctggataatatttcataaccacatgattgcagggctaagcttagcagtgctgtatttaagagtggatcgcatatccatcattcagtccacatttcaaagactgataaaatattgcccctgaagatttaagagatgctggtgatagaacatttccctctcctaactaataaaactgtgagggtcagttcctaatacaataccagggagcctacctgtatacaataaaacgtcatttgtccttggaagatggcctgagaaacagcatcacgcagtccaggcagtaaacaagccattgagtctctatatacatcatggttagattattcatcctaaaacaccacttggcacacatcacaacctctgatcaaaagtcgtcatggctccccacggtcacaagataaaccccaaactccttagcgggttttcacaaactggaactccacaaactggcactgtccattctctcccatccaatctcccactgttgcccatacacaccctctgctccagccaagctgctcgcttcactgttcctggaagccctttgcaaggcttcctttttctctcttcccttgctgacctctgctcccaaatgcacccttcctccttcttcctagtttgtcctactacgagacatttaaaaaccaactcaaatcccatgtcctccataaagccacctttcagaaagcttcctgcctggatgtgctcactctcctgcactccaatgagagccatcagctggcaccctaaacacagaccgccctgcattgggattgatttatttccatgcttcccaccccacccagttggaccataaagttcctgggtacagtgtcttgtcctggcttcccagaatctcacctcttcgcctcacagcagatgctctgcaaagctttgttgtcatcatttttgagccaccactactataagaatttcgtcctccctagtattaatggtttatgagacacttctgcctttaaaccaccttatctctctctttctgtccaatctctctttgagctcggcgtgtgacaggactgccagttcattctgtccctactgctgtcacatacacctaagagtgtttaacagaaaaatcctaagaggtgattgcaaggtcggaaaatcaccttaagccccccggggccatgtgcagtctacagacaggaaataggcaacaggagaatgaaattagcataaagaaaaaaggggctatggctcctctccacccaagtcagcaacacctaccagaaacaacaaagaaagcatctggataaagcattggcaagcattgctgaggtcgggaaactgctcgtaacaaaagcacaaagggtttgcaaaaggcagctccccttcccttcccaaattaccaaaagctcaacaagaaaacgagcagagtttttgctctaaaaacatctgttttcagttacctgtgcctgaaccacaaacttaacagagaaacacagagatcccaagctgactccgtggtctaagatctgtcaggacaaattatgtggagatggaggagccaagtgtgggatgcttgagcaaccgctgtacaatagccacggtcttgataagcctcgcggatgagattttggcggactagggattgtactactgaacttgattgctgaaaatgtaaaagcccatcaaagagtattattaccccttgataaaccagctacccacagtggtcaattactaatgaacagacctctttcaccaattaaagtcacatgttaccactcaattcccaacatatttagtctttttctcccagtagtccatctcactactgtctagctaaacctctccaactaagatgttgtttgtctttacttaaaaaacagtctttctggagtctggtcagtggggcccaaaaaagaaaataaaataaaaataatttttaaaataaacagtctttcactagaatgttctttatattaaaatcttaagctctgctttttttttttgagatatgtcttgctctgttaacctgccagagtcctgactgaccttcatttgttcattctccttgtgcagttcttcaatgttctttgcaaatggatttcactaaagtgagttctgtctattaatgtcagtaggtataaatgcctgtccatctttggagggactttgggagatgatcttataccaaatgaacatgttacatgcctgttgataggaggcctgatgctttattttctctagaaaaaatagatatttcaatattgtaaattccattaaggcatcctgctccccacctcctgatcctccatcccccaccccccatcaccaacaagctttagtttccctaacctctcaatctggcaaagaaacaacatcccagacctttttggtaggtagttgtccaactctctgtccattttcttcttggcaaaatgggagtaacttagcttaaactgaaaaaacatcgtcagtccttgtataaggcataagtccctgagtaatttacatcatatctcctttttgggcctggtaatttacaaaatcagcaacagggagtaaagtacctcttttgatgaatctatcagcagatgtgtttggaaaatgaggaaatgatgttgctaacttgccaactgtattttggcagataatgtaataaggtgacgtttactgcatttcctctattaaaggaatacaggcaaattttttccttggaattaaaaatctatatattaccctaaaatcctcccagaaatttaaaactgctcctttcttgcttataactttccctcattttcttcccagcagtggaagagaagtttaaatcttgtttaaatccacagtgaactttttatattgtgaggctggttggtaggtgttaatgtaaaattagtgttctgtctgaagccacgtaagatgattctggtataaatatggtaactgcaggacagccgtggtggctcacacctgtaatcccagcactttgggaggccgaggcgggcagatcacgaggtcaggagatagagaccatcctggctaacaaggtgaaaccccgtctctactaaaaatacagaaaattaaccaggcatggtggtgggcacctgtagtcccagctactcgggaggctgaggcaagagaatggcgtgaacctgggaggcagagcctgcagtgagcggagatcatgccactacactccagcctgggtgacacagcaagactctgtctcaaaaaaatatatatatatagtaactacagtgtctactgtgttttgccattatgttttctttttttttttcttggagtctttggagaaagattaaaaggcttggtggcgtatgtatgtcttgaatgccagactgagaagtttatagtaacaggctggtctgagaggcggtgtgtgtttaagtgtttgaagatgagcctggcatttggatataaggtactttagagagctccagttggggctgttggaatggttttgatgtggtgtgatgaggacttaggagtctatggcagatctgagggccaccctgggatgttgagaggtgaaacagagaagatgcttgaagttggggattttattttatttttttgagacagggtctttccatactacagtgttctttatactaaaaactttaatccctccaggccgggtgtggtggctcacacttgtaatcccagaactttgggaggccaagacgagcagatcacctgaggccaggagttcgggaccagcctggccaacatggcgaaaccccatctctactaaaaatacaaaaattggccagcataatgacatgtgcctgtaatcccgggtactcaggaggctgaggcaggaggatcatttgaatccgggaggtgtcctctctaccttagtaggcacagagtacactgttatgaatttaaaatataccagcctgtggattattacttggccagtgaactaatggtattctatatctgttcagaaacttgtattttaaattcctttagaagagtctctggaagagtttttaagagaagagaacatcataggaatgcttttatagatatgtatgtttgtataagcttctaagcctcacttagattctcactgacccacaggataggttagtttctctcaccaggatgtggaggctggagagagaagttgatgtctctgagtttggttacccttgtccagcacaagacaagtgacaccatactgtactggttatattttattatagcaaaacctattaaattttttaaagcccattatgataaaatcccctagggacaaacaaaatggaatgtaattcatttttcaaccaataaatatttattgagttctattaaccttcatgccagtctctcggcagagcccctggatacatcttttaatacctgctctactgaaatctcagtatgaatctccatataaagcaatttccatataaagcaattccataagtttctatataaagcaattcaagtaaaaaatagtgaaacaaatgccagcatgtctctttaattatggtaaatatttaatgtttccttataaaataattacagccttaatagaaacaaaactgttgaaagtgtacctggatgacaataatggttaaatatacacttcaataatttaaagtgatgagttgtttttttttcacaaaagtttaaggtggtaatgaaatcattggaatcccttttaccaaagtgaattttaaaaattacattttccctcttgcaatcatgtttgtagcataaagaagcaataaatgggggcagggagtaaagcttgggaactattctatgttaggcttgagtagtctagcgcaatgtctgataaaggaggggtttgaattttggtatggaaggctttctaacactgcattattttaaagaatagctcagtgatatcagtattcagttacttaactaggcacgaggtaccagatacagagagattgtgtagaagaatgaacactgttaactactgtctcctctccccgtttgctggatctatctatgaatagggtgctgacctctaatttactgaaataaaaggaacattgttcctggaaatatttatgaggcatattgcatcttctccacgttatggataagatggaaagacatctatacctattgacattaatagacagaactcactttagtgaaatccacttgcaaagaacattgaagaactgcacaaggagatgaagaaatgagggtcactcccgcctctggcaggctaacaggatttctctgggtattcgctgcattccctatcatccctcaggacattcatgttctatgaccaggtccaagttgcctcaccatgaaaatcaaacaatggaggccttttcccaattcttagaaggaaaaaaactacttaaatgtgacatatactctttttcccattaatttctccaaaccctagcacataccaccacatggtcaaacaagaactcacggcaacagagagtcaaacacacacacacacacacacacacacacacacacacacataatttgtgtgtttaaacaaaattctagaaatatgactcattaaaatttttacattattagagccaggcgtggtggctcatgcctataatcccaaaactctggaaggcctaggtgggtggatcacttgaggccaggagttcgagaccagcctggccaacatggtgaaaccccgtctctactaaaaatacaaaaattagccaggtgtggtggtgtgcacctgtaatcctagctactggggaggctgaggcacaagaattgccttaacccgggaggcagaggttacagtgggccgagattacaccactgtaccccagcctgggcaacagagcaagactccatctcaaaaaaaaaaaaattaaatttttttttacattattcaatgttaagatacgaagagcttcactacttacaatagaaatatatcttctgcttgttaagataatagaaagagtgatagccctctctcagatggcagaaacagtcatagcccaattttgtggcactctagaaggctccctaaaagatgttccctttgagcaagtttaagtatcacccactagtctctacttgaatccctcagcccacccacatcacattctgcaggaagtgatgaaaagtcagggagtttaggttatgtaaggcctgtggacccattgagccaaactgcaaaatgtgcatcagtgagctccacaacctccccagccccaacccactgcaggaaagtgtctggggatggggcagccaagagttagtcactggaacatgtctgatgctataaaatgctacctgtgatacccagatcccaggttcttttcttctgggttctgatcaaaacacagtagcctgcctgcgatggagcaactagaggaaacaggttccaggtgtgggaagccatgggttaaaaggcaacttgccaaactatgggaaatattctagttgacgctgaagccttaatgcttgactctaatggaggagtcactccattttctcataaaaatgctaagtagatttctgctttctcaagaagctaaatccttttgtggctttatgacttactcctacaaccaagagcttcttaagctattaacagccaagtgtcacagccttaaagatttgcaccgtttgctcatctcaggcatgcccccagtcacaaattcctgcaaaataaaccttggttggacagattgcagaaaaacaaaaaggaaagaaaacataaaacctcattatggttgacaaagaacctgtacaaagcttaaagagatcaataaaatgatatagggtcagattctgaaaaaaaagaacagatttcactatatggtcacctctgggaaccctctgacaaaatcagaatcaggccttccagtttgattgctaagtgcccagtggcagtaattcaaccattccatctctcacacaaaatgcctgagccccagagctaactctgggtgagtctgacaatggtaccacccaatttataaagtaaagagacaagctggccaatttggcacaaggaagaaagcctttccatttgaccattgcagctggtgggccagtgtagtcatttgctgctctataagggtcccccatgacactattaaggcatattaccctttccaaacatcttttgcttcaaaagattccagtcccactctgcaataaaactgagcatatttctatttaaattaactgtctcaatttgaaagcaatttggttttatttaattcaaagatttccctaaatgctatcaaaatagcaaccaaaattggctttcaaattctttaaagagtatctaaggacagaaagaattttttacctacttcttctacttttttttttcttttttttttaagagacagggctttgccctgtcacccaggctgaagtgcagtagcaagatcatatctcactgcagcctcaatctcctgggcccaattgatcctcctgtctcagcctccccagtagctaggactacaaggacgccacaatgtctggctaattttttttttaattttttgtagagatgggggtctcgctatgttgtccaggctggtcctgaactcatgacctcaagtgatcctctcacctgggcctcccaaatacctttttaaatgcttctctttacttctcccaggaatattaacttaatttttaatgtaatttttttttgcttatgaaactgtacgaattggtttctattcaaactgtcgaaaaatatgtacctttggtaagcatgaaaaaaggccacagaatgaaaaatctctaagatcccttacagtttcaaaattcctttatcctgctagatccctttttaaaagaatttatccaacggtataacattctggaaaagataaaactacggagatagaaaaaggatcagtggttgccaggggttagggggtaagcaggcatgagcaggcagagcatgcaggattttcagggcagtgaaactactccgtatggccctataatggtggatacatgtcattatacatttgtcaaaacccacagaacgtacaacaccaagagtgaaccctgtcaactatggactttgggtgatgatgtgtcaatgcaggttcatcgatggtaacaaatgtaccactctagtggggatggtgacagtgggagaggctggttgtggggacaggggtatatggaactctctgtactttctgctcaattttgctgtgaacataaaattgccctaaaaattaaagtctattttttaaaaaagtataccttctagatgttctaaataatatcatgtatcctccaactgattaaaaaaaatgggtaaaagtatgaaggaagagattaattctcctgcagccagaaaagaaaagtgtaagaaaaagctgctgcactgtaggagctgccttgtgacgtcacagaatacttggcagagaggacgtgtgtttctgtttgttctagagatgagcaagagaggaacaagcaacactagtcatcagactagtattctctccaaagaaccgtttttaatgctgttgaacactacacagaaaagccaaacaaatccattcaacacacagacaaccacacatcattgtgaagtttatatctagatcttttaccctgttttttgtaaagtaactgctgagatataatacctattttctatttaggagatctggggacttcttagctaattcaggaattagcaaaccaaagtagacacgcgctgggtacggtagctcacgcctgtaatcctagcactttgggaggccgaggcgggcatatcacttgaggtcaggagttcaagaccagcctggccaacatggtgaaaccctgtccctcctaaaaatacaaaaattagcccggtgtggtggcacacacctgtagtcccagccacttgggaggctgaggccagagaaccacttgaacccgggaggcagaggttgcagtgggccgagatcacatcattgcactccagcctgggtgacagagtgagactcagtctcaaaaaaaaaaaaaaaaagaaaaagaaagaaaagaaaaaaagatatctgatgtactccctcaagaccaaaaatttagggtttgcccaaaaatcagttataaaaggaggatctgggtctttagatatgagaaattagctttcaaataccatgatattctaagcaaatgttcaaatccaatgagaaacactgttacttacatccagctattcaaccagttgcacagagtggaatataaggaaaagcacatagaaacttcattcactacatctgagaggaaacttcatgggcggtatataaagtttcacagatgctggtgaggatgcagagaaaaggaaactcttatatgctgttgttgggaatgtatacaacctccatacaaccactatggagaacagcatggcaatctctcaaagaaaaaaacacatataaataacttctatatgacctagcaatcccactgttgggcatcagtccaaaggaaaagaaaccactatgtaaaagggatagctgcacatgcaagtttatcacagcactattcacaagagcaaagttatggaatctaagtgtccatcaacagatgaatggataaagaaaatgtgatatatatatatacacatacacacgtgatatatatatatacacatatacacacacatatacacatacacacacacacaccatggaatactattcagccgtaaaaaacaatgaaatcatgtcacttgcagcaacatggataaaactggaggtcataatgttaagtaaaataagccaggcacagaaagacaaataccatatgttctcattcacatatgggagctaaaaaacttgaaatcatggacccagaggatagaataacagataccagaggctgagaaggataagtgggtgggaggaggatatgaagagaggttggttaatgggtactaacatacagtttaggtagaagaaataaattgtaagtctggtagcagactagggtaattatacctagcaacaatattttgtatatttcaaagtaactagaagagaggctctaagtgataccaacgtatagaaatgataaatactcaaagtgatgaatacccccaaatacactggtttggtcattacacatcctatgtatgtctcactcatatagactccataaatatgtaaaatattatgtatcagtaaagaaaaaataccaaaaaactcacaaacattactacataaatattagtatagctaaaatttaaaagactgctaattccaagtgttgacaaggatgtggagaaactaacccatatgtattgttgggggagtgtgaaatggtacgaccactttgaaaaacagtttgtcagtttcttataaacatgcacttatcaggtattatacaagagaaatttctttatgtttaaagaaaagacttgcacataattattcataatagataaatgtgggtacaacccaaatttccatcaacagatgaatggatgaaaaattatggtatagccagacattggaacactatttagcaataagaaagattttatctccttatacacaaaacatgaacgaatctcaaaatccttatgctgagcaaaagaagccagaaactaaagaggacaaactgtatgattccatttgtgtgaaattcatctgtagtaacagacagcagatcagtatttgcctaggatgtaaagtagggaagacaaagaagcagaatagaactctttgggggtgatagaatcattccatatcttgattatgggggtgattacacaggtaacttttgtcaaaacacatctacatgtcattaaagtggatgcatgccatttcatgtaaactatccacaatatggtcaatttttctcttttttttttttttgagacggagtctctatcacccaggctgagtgcagtggcgtgatctcggctcactgcaacctcctgggttcaagcaattctcctaacctcagcctcccaagtagctgagattacaggtgcccgccaccacgcctggctaatatttgtattttaggagagacggggtttcactatgttggccaggctggtctcgaactcctgacttcaagtgatctgcccgcctcagcctcccaatagtctatttttcaaaaagaaaaaataaaatgaataggtggggcactgtggctcatgcctataatcccaggttgtactaatttacattcccaccaacagtgtaaaagtgtttccttttcaccacatccacaccaacatctattgtgttgcaactttttaattacggctattcttgcaggagtaaggtggtatctcattgtggttttaatttgcatttccctgatggttagtgatgttgagcattttttcatatgtttgtgggctgtttgtatatcttcttttgagaaatgtctattcacttcttgatgggattatttttttttattgctgattcacttgagtttcctggtgtcaaagaaaagaccagttgaaaaccaggagattcgaagtcagaacttttaactccctctgtatcatcccagcaataagccatgttcttcacaaatacacaaactcattttaaaaagaaagagcctcatcaacagatcaagaaattcattccaaataagcatgctttactttgcatgtattattactaatttatcaaattttatatttgttttgatacattgttaataatcattggaaactcaatccagaaatttatttaactcttagcatctcaggatcacatttctattacaaagcattgtaagataatcagtttttttgtttgtttgttttttgttttttgtttttgtttttgtttttgagatggagtctcagtccagcccaggctggagtgcagtggtgagatctcagctcactgcaacctctgcagtttttttttaatgtagtacatttgtgccaggcacagcagctcgcacctgtaatcccaacactttgggaggccaaggagggaggatcccttgaggccaggagtttcagactagcgtgggcaacatagggagaccctgtctgtacaaaaaaaacaaagatttgccaggcatgctggtgtgtacctgtaaccctagctacttaggaggctgatgtgacaggatcacttgagcccaggagttccaggctgctgtaagctataatcacaccactgcactctaggctgggtaacagagtgagaccctgtccctaaaaaataaataagatgtggccaggcgcggtggctcatgcctgtaatccgagcactttgggaggccaaggcaggtggatcacctgaggtcagcagttcaagaccagcctggccaacatggtgaaatcccgtctctgttaaaaacacaaaaattagctgggcatggtggtgggcccctgtaattccagctacttgggaggctgaggcaggaggatcacttgaacccaggaggcggaggctgcagtgagctgggatcatgccattgcactccagcctgggcaacagagcaagactccatctcaaaaaaataaataatgtataatatttggataaaagtgcggtaatttacaggcatgagccaccacacccagccaaattctgcatgagaaagtggaatagaagtataagctcaaggagaaaaaggaacaatgtaaaatttccaactatcgaataatgcttgctcatgtattttttttaaattatactttaagttctagggtacatgtgcacaatgtgcaggtttgatacatatgtatacatgtgccatgttggcttgctgcacccattaactcgtcatttacattaggtatttctccaaatgctatccctcccccatcccaccaccccacgacaggccccagtgtgtgatgttccctgctctgtgtccaagtgatctcattgttcaattcccacctatgagtgagaacatgcagtgtttgctcttctgtccctgtgatagtttgctgaggatgatggtttccacctccatccatgtccctgcaaaggacatgaactcatcccttttttatggctgcatagtattctactgtgtatatgtgccacattttcttaatccagtctatcagtgatggacatttgaattggttccaagtctttgctattgtgaatagtgccacaataaacatatgtgtgcatgtgtctttatagtagaatgattcataatcctttggatatatacccagtaatgggattgctgggtcaaatagtatttctagttctagattcttgagagatcgccacactgtcttccacaatggttgaactaacttacactcccaccaacagtgtaaaagcattcctatttatccacatcctctccagcacctgcggtttcctgactttttaatgatcgccattctaactggcatgagatggtgtctcattgtggttttgatttgcatttatctgatgaccagtgatgatgttgctcatgtattttttaagtgaaggtgggacactcaaatcacaatagtgtttaaattccattcaacacattttaaacagtgatataatgtttccattttaaaagtcaacatttgtattatgccaggaattacatcctttgtatctttccaactttgtgatgaaaaactttagatgtcaaccccccaaaaaatgtgcaagggaatacatagcgtataaaaatcttttggtggtaggggttggggataaaaaatgttgccatgagctacttgtaagcatcagtagatggcccagcatggccatcctctcagtccacccaggatcggtgatggaaatcacactctgcctcctttgggccctacttagcaagatgctttaaaccaagagtgcacattaacagtgacttcctgtgcaagtctttaaagagctgtcccagttaaagcctgtccaaaatctccacagtacaaaaaaatggtgagtaaaacatttcttcccatactgtttccttgactggagaagttgtcccagatctgttcatgtcatgacacactaagccatcagccacacattcttgactatacatatttatcaagacaccaagaagaaaaaatccaccaaacaaatattagcaatattttatatcaccaatctttttactagggttatttacataaccaaaaattaatcacttcctgtccttcctctgttcatggtaaagatcccaagaggagaaaaagaaggtagataaagtagataaaagaagggaaggatggtgaaggaaaaaacacagcagcagagactggcactacatcattcacttattcaatagtcactgctaatctactactactgagttaaccagagtcttagatactaaaaagttggggtacaaacattttcccccagaagtgaagagaaattcagtggcttagctccaaccttcccaagacacacactaatcaaggggctaaaaatggactgaaaccagaagtgagagcctcaatgaagaaactttccccactccatgtaagcaggaaaatgaaagagttcattaaacatatctgcatttacacacatctaaagattaggcagtgctgtgacaaatgttcccttcagatggccaatcttaaatacatctcacaaaattctaaaaaaagaaaacaaagcatattagagaggaattttggggatgagggcatgggaaagccttagtatttcaggattattaccagtcacaagtgttttcaaataagaatgaagttccacggtcttctgtgtatcacaaagatctttacccacaggggaacgatgaggcaatatccttatggccttgcacacaatgggctccttcttctagaccagcttagaagtgggtgatacattctaatctggataatgcagatgatacgatactagaaccacatgataattacccaggcggcagccttcagcattctatcacagggtgtttatacagcattttaggctgtatcctaaatataactgcagaaatgacacgtgattttataagtgctgtttaagaacaggataggcaaatgaaatgcacctcagactgagccagaaaaaataagagctctacctccactaacaatcaacaagcaaagtaacagccactggcctcggtttctccctatgaaaaatggggattctaatgctcatctcctgtcttcaccagacaatttataatattgttcagaaaatgctggaggtcccagacagcttaggtactcggtcactgtccatgttttctaaagttgtacactacattaatttctttacaaatcttttaaacaagtttctttagtcttaattctctctgaaggatagagaaaaggaggtcagtcaacacgtgtcatctttcatatagaagttagtttcacttctgagaaaagtgaacctttatatgaaagatgacatgttgactgacctcctttctggcctcgctaaccagttcaaggtgcccatcttcatccaagatcaaacagaactccaggcctaggaggagtttcataataactcaaatgactctggaagtacaagagcaagagtcagatgctctttataattctaatgaaatgaacactggaaaccacacacacacatattttcattctctctctgtctctctgcaccacccctccgccccaacacacacacaaacttataacccacacagaaattaccagacttagcttcagagagaaccttctagaataatgagcaacattagattagtagacagctttaagatttatttttaattgtataatttccatttgtaatacttgacctttaaactgtgtttgcttaaaattagcctcctacaaaattaaggctatttccatccccatattaatctagagtctctacttggggaatagaaaatattaagatttctgttttgctctcatatataagaagtaaagatctctcttcccccatcttggctctttgagtgcatcaaaagtacatattaactgtttctgagtccacatctggagtttaaaaatcctatagaaaaggcaagtgatttaaaatataaacatatggcttccttctctacagtgattcctaggcagagggaaaaaaaagttgagtacaaacaaaactattgttttaaggaggattgtttctaattgaaagcataccaaaaaagctaactaagcttctactttctcctggagaaaataataaaagcaagaattcccacctcaatctaattaaatctagatcaaagtgcaacttaggtaacactaggactgtaagagtgtagcactcgatttctgaagaggatggccccaagtctgcccttgagttagagcaagaggttggcaaattttttcctgtaaaaggccagataataaatattttcagctttgctgaccctatagtctttgccacaactactcaactctgctgttgtagcgcccatagacaagacgtaaacaaataatacaactttatttatggacaaagaaattagaattttgtttaatttttatgtgttgcaaagtattatccttttgatccttttcaatcacttaatataaaaactatccttggctcacgggccatttaaagcaggcagcaggccatatgtgtcctgtggatagtagtctgcaacccctgggttaaaactatagaagactggagcagctgcaagaataaactctaaaacaatgtcctcatttcttaaagaaaactgaggcccaaggaggtataatgactggccaggatctcacagccaattcatggcaggaatggagttaagaaaaatactattcagcctctggaagagctggttgaaaaggtaaaagcaaggctgggcacggtggtttgctctttcctataatcccagcactttgggaggctgaggtgggcagatcccttgagttcaggagttcaagaccagactgggcaacatggtgaaaccctgtccctacaaaaagtgagccaggtggcatggaggtacatgcctgtagtcccagctactcaggaggctgaagcgggaggatcacctgagcccaggaggtcgagctatgatggcaccactgcactccagcctaggtggcagattgagaccctgtctcaaaaaaataaaaaagaaaagaagaagaaataaaaagaaaaggtaaagcagtaatgaagaaatgtcctgcttgagttcaactcaccaggacaggcagtggggtgcttaaaaccagagttgttgcaggaacctagtcactagtcatagaagctcctaatacctgacttcccactgtgtaaaataatttgttacctgcctgtcacctacactcattctgaaggtcctatatcagccactaggaccttttgaggggccaaattacctgtcagcctgattcttttcagccttctgagtgacacagctctggttgtttcttttgcagtgtaagtaacaacctccacttttgttagtccaatcctagaactcccaagatataagtgtcaatgtggctgaacagcaaggatcaatgtcaattatttcaaagaacaaaggacagcaggtgaccaattaagcttaaagttcaacagcatctccaacactcacctaagaaactaacagtcaatctccttcccgctcctaattccttccctctaaaagaataaataaataagtttcttaatggttttctcttatttttccttattccaccttttcttataccaattctcattttcatttcctgtgaccctttttactttgccctacatctcaaccaagaatcacctcaaattgaaatgctttgttagaattaagatacatacacatatccaatgatgtttaaattatctgctctttaagtagcattctatagttttaaaagggaaaaaaccccaaattaaagtaactttttacaatgtatctttcatctaactttttaagtcacattttatcagagaagtttgttttctaccgttataaattaattcgagacttgaaattttacaccaatgttttttagacattctgctgtgatgattttttatgaagattactctatcaacttttgtttttacacacttcctcaaaaagacacagttttatatttctgtgaagaggaagtggcattcttataagtaattttcaaagttctttttgacaacttaaataaaaaatgactgcaaactcctgagaatcttttcaacacaaattgatcctcctagatctatctaaacataagattctttggtcaaataaactaagtcaattgatttgataaaaccaaaatgaaagaaaaatgtaattcctaaagctgtaggaaccaaacactacaattcataccgaagtatggaaattccatacaaaaataaaacaaacaaactctttctaccaatgttgtttaagtgagagagagaaagaagactagttaaaaggtcataaatataaaacaaaaacaaactcaaatcatattttcatagagctgaaattgacctgagaaaactggtctctttaatgtgacaaatgaggaaccagcccaagattcagagactatttattatagagtgccaaccaaggaccacctgctatacaaagacttttcccacttgattatcacaacttccccgtaaagcaagtattattttacccatcttacagtcaaggaaagttgtgtcacaggaagatggacacagcttgttaggagtagcgctgtgcacatagcccaggtctccagacatcaactttagtattctaaatatacaactcacacggagcatttttggaaattgttcggttagatgccacaatattttaaaatattatacataaaatacagtaccctgaaaccttgatagaagactccttgctacaaagcagagctacttaaaaagattgtttcttcttggctgctacgaaaaggagcattagcaactaaacattgcactcatctcatgagccccaagacctaattatactaaggctccaaagtacaaaacccttagtcacatggcttctaaattactcatgacagtatcatttactcaagtcacagctggccacttcttatgcttatggtctattcttaaatctggactccgttaagaaggatatagaaagatttttacacttgtagaaataaaggaagatatttcagcatgtctgaagcaatggtgaaaccactcaaggcaacaacaaacacctacttcctgttcaggtaagaagagaggcatggcagccaggcccattagaattgagaccttgtaactgtttgctgcctttaagaactacacggtataattaaaagcatagtttaaaagtcaatgtaagaaagcgatttttggcaactctagtatctaaattcccttccaaatatcttacactggacaagccaaatccaggtcttcctaaaagcacacaagatgggattctaagaccaatgctcaagtatttgactcaagttatggagccacttaaactaagtcaatagatgtgtggaccacacaactagctcagaagcatatttccttgggcagcaaaaccagaaaaatcatgtgcttttatggacaaacagaaaggattctaacaactttactgaaggcattctatcaagcgagagtggaggccttaagaggggcacaaaggtggcaggaagaagtaaaaagaaaaatagtttccaaaaagaatgtatcacttaaataggtgccctgagaaaatgctaaagtaggccaagcatggtggctcatgcctgtaatctcagcactttggaaagccaagcagatcacttgattccaggagttcgagaccagcctgggcaacatggtgaaactcatctctactaaaaatacaaaaactagccaggtgtagtggcacgcacctgtagtcccaggtactcaggaggctgaggtgggagactcaactgagccccggaagtcaaggctgcagtgagctgtgatcgcaccattacactctagcatgggtgacagagtgagatcctgtttcaaaaaaaaaaaagaaagagagagaaaatgctagagttttatagtttctagttttgtaaaaggactctctttttaaacataaccacaatatcctattcacactttaaatcatcaaatatccagtcagtattcaaatttccccaattatctcaaagaagtgtgcttttttaagtttgtttaaatcagaatccaaatctattcactgcaactagtctgaatgtatcttaattctcttttaatttatggatttatatttcctctccatcttttttttttcctcttacaattgattttttaaataaatgaggtctgttttttctgtaggcatcccatagtctggattttgtaatttcttatttaacaaatatgtataagattaaaaacaagtcatctctagatccggcaatcccactcctgggtatctacccagaggaaaagaagtcataagaaaaaggtacttgcacatgcatgtttacagcagcacaattcacaattgcaaaaatatggaaccagctcaaatgcccatcaatcaatgagtggataaagaaagtgtggtagatacataccatggaatactactcagccataaaaaggaatgaaataatggcatttgcagcaacctggatggaattggagacgattattctaactgaaataactcagaaatggaaaaacaaacatcatatgttctcactcattagtaggagctaagctatgaagacacgaaggcataagaatgatataatgagctttggggaatcagggaaatggtgagaaaggagtgagggataaaagactacacattgggtacagttctttagtggtgacaggtgcaccaaaatctcagaaatcaccactaaagaacttattcatgtaatcaaacaccacccattccccaaaaacctatggaaataattttttaagaaggaaaaaaaagtcatctttaaacatactacattattccatcaatggcctacatcaccaaaccatctagatcctttcaatgaagtccttgctactccaaaatacatgtttgttcacaaaatgttgccatggtacctcatgcaacattctatccaagccaggggtatcatggacacagaagggcccataaggcaacaccttactttaatgcttcaatactttttggaacaaagtaaatacaaattaatttgtaaaaagtcatgtgcaacaaatggaaacaatgagttttgcttaggcacaaattcatcaattcaagttttcaggcagagggcatgtagtacctatcaaagaactcaactgagaaaaatgtgttaatatgcaaacacctctcctatccagtttgcaaattggatatttccttacctcttcttcctacctaacatgaaccctatgactcagtaaatttagtcaccaggttacctgaaagggacacaacacgtcactcacctgggttctacccacatctgctgcctgaatcattcccttcctcaagtaccgcttagactccctccagctcccttcttaatgactttgcccatctctggactcctgaagtccctaatcaatacccctaagcatagtctaaacctgcactatatgtggattgataactgtttcatatgccacatgaactcaataaactttaaagagggcctttcatgtgcaaggcattcagtatcatctaactagactgtgagctccatggggaaaaaggcctcttgtgatactgcacctatttcaagaatcctaatgtgtgatggctaagaatgtgcaccttggagttgagcttgcccagatgtgactcccagagtcatgcgaccctgaaaaaaattactcgacctctcagttttcattttccttttttttttttttttttttttgagacagagtttcactcttgtcgcccaggctggagtgcaatggcacaatctcggctcactgcaacctcgtcctcccaggttcaagcaattctcctgcctcagcctcccaagtagctgggattacaagtgcttgccaccacacctgactaatttttgtatttttagtagaaatggggtttcaccatctctagccatctctggccatctctctggccaggctggtctcgaactcctgacctcaggtgagccatcttcctcggccttccaaagtgctgggattacaggcatgagccaccgcacccggcttcattttcctcatctttaaaatgaaatgatgatagccatcctctcataaaaatattaggattaaatcacgtaaagcatgattcttgtcttgtctccttgttcccaattctttctgtctggtttctattttattgtgcctgttcttacctgtccttcccttttgtggagaaggggagagcagagagccccagcagagctatgctgtatcattgctatgtagatggagctcattaaacacccctcgattgcttgaatacatgggagatccactcttagaacatttagggacaatatttcctgtcccctcatgtcaccttgatacttcccctgaaaagaaatggaactgagaattacctacgactgagaattacctacagtgctaaccatcctcacaaccaaaagcacagtttaaaaagagggaaaatataaccagaaaataggacaatatgtgatcttttatcttttcatagggcagaaaactttctcttaattttgtttgaatggaaatttgacatcccagtgtaaaatgaaagctgtttatagaagtgtttctcttttctttgtttgagtacttcatgagtaaaaaacatttgaacatgtacatatacagatacatatacatatttatattcaatcacttaacaaatatttattgagcatttactatgcaccttaccctgttttaagtgctaaagacacagcagtgaatgaaccaaactaacaaaataatctttgtcctgttatctatatcttagccacatgtaagttttggtttttaaaatggggggagtcaaatatatggtatgagggatttacactgtggaggaaaataaagaaaggcagacaggaaatgtggagtgggcattttaaatagtgtggtcagaaagggactcactgagaaggtaacatctgaggaaagacccgaaagaggtaaaggtgagccatgcagatatctagggaggagctgcacagggagcaggaacagcaagggtcccgaggcaggagcgcagctggtgtgttcactaaataggaggaggccagtggggctggagccaaggagccaggaagaggtggacagcagacaaggctggacagttgagtggatgagctgagtgcagaggtcactctaatgaccttagctttcacctgggtgaaactggaagtttttgagcaggagtgacaagttctgagttccatcactctgagagctacgttgagagtagagtgcaggggccaaggtcagacggaaggagaccagtcagaggctgctgttataacccaagtggtgatttggccaggtggcagccagtgaaaaatacagccaaaaagatgacacagtactagcaaataagatgtactaaaactacataaaaattaaaagtttaaaagaatgatttaaagaaatatgaattccaatattctctttcccaaactccaactcaataaagtattgtgttcatccttggggtgtaggccacacctacttttggaggccattgtttcacaataattggttggttgatttgtcccggctgacctgaatgtctgcctggctttctgtctttagacttctcttatgctcactttcctttttcctgatcttgccagtcttagacaccaaaacaagtctcctccacagagactaaccatacagaggctggtgattacatgtaggaattttcttcctttcttgagaaagtctgtggtcaccatgtcaactgcacccaactctgggccaacccttcagaaataaacttgttagatgcacatgttatttgggttcaataaaataggattttgcctgggaggacccaaggtatttgctaaagcaacacctctgaagaaggctaaggtgggccccagctcacaagagacaagcatggcctttgtaaggattgctccctttatcctgtaagaagttcaagaggattctcaaagaaccacactgagaacagccccaggggttctgtgtccccacagccaggctcctggagatgccagaagacaaacttcttggagaaaggactcctcacccttagacaaaactcaggatgtgtttaccaaacctgggaaactttaaagctgccacaaacacacttgggagaaaatcagaagttcataaaaggcagatactttttgaactgagattccacaagatgagaaaagactgacattgaaatatgtgaggagctatcttagaatgttagagcttggaagaatttagagaattttctacctgttcccattttgacagacaaagaaacgaaggccaggacttaccccaaaccatacaacagttagaagaaccatgagtagaatccacgtcttctgattcccaatctagtgttatttttaaaacaaactaaagcaaaacaaaattttttaaataaaaaaagcaaaacttttagagacaggttagaattgtaattaatttccatgtctaggctcaaacagatgtttccacaagtctccctaattttactaaaagctctgaaagctttcttaggggaaaatggtcttctggtataaaagatatcctagaaagctatgcttggatgcttaagactccccaggatgggagcaaggggactctaagcaaacaaaaaccaagaaatgcaaacaattatcgacttagtaatccctgaaacagcccaaagtggactatatatttatttgcttagctcactttatagaatataaattttaagttttcaaaagaggaggcaagtgaaaagatccttaaaaattatgaatatcataattacaagctggattcatgaatcattaatttcaacctcttaggctaccaacatatttacaaacataaacactgataagggcaaatacctgcattcccgacctctgaaagcagccaaagccaaataatatattggttaaaaggttaaaaaggagtaatctataaagagggcaatcttaggccaggtgtggtggcttacccctgtaatcccagcactttgggaggctgaggcaggcagatcacatgaggccaggagtttgagaccagcctggccgacatggtgaaacctcatctctactaaaaatacaaaaattagctgggcgtagtggtgcaagcctgtaatcccagctacccgggagtctgaggctcaagaatcacttgaaccccaggagggggtcggcgggggttgcaatgagccaagattgcaccactatactccagcctgggaaacagagcgagactctgtcccaaaaaaataaaaatacagaataaataaaatgggtaatcttagattatctatgaattgaagtagggtggagaataggaattagtcctaagtcattgacatgggttaaaatccttctctggaacttgaagctgtttgactttgttacctggaaagccttattagagctcatctgcaaatacacccttcataggcacatttgtaagaaatgctataacacaaaccatgtgaagagcatcggtctccattacaggcaccaagtcacagaagggagagggcagagctgaggcaccataaaggcatccagtccaacctcttcattttacaaagagaaacctgaagcctacagaggttaacatgtcttgccaagggttggctaatgtacaacatatgtcacttctcccttcccgtgtacccatagcaaacactggtaatcaatcacactttctcggatccttgactgcaagagtcagaatgtttctatcacattacacctgcaagtcctggaccgatcagaactcatgtgtgacatggaagctgtttcccaactctgcacaaggtcataaaacaatctttgtaatacctgcaccactgtagacctgactcaaaagagacagagtagtctgctagtcaaactagtttactgtcactgtcaagcctgtggtgagcaaacatggagtctatgtgaatatatgatgaccacatatccaggtttacccaggacagtcctggctcacgtctatttgtggcttcatattgagtagtatcacctatgattctcaaacggataaaaatgatatagtcatcctagttctgtgtagttcctaatcattcacaaacatttataaatgttgtttcatacatgatgtgtcaggaaaaaaaacaaaaacaacaacaaaaaacacttaaccaatcaccaggagttttctcatacaaaggggctttcaaataatactaaacccaaccagttttcaagagggactcagggaccactgtccaagccaatcttttttatatattgagcttcaatatgaaatttcttcgggggaaaaaaggagtgtcatagcttaaacaaatttggaaatcacaaaattatcagatctctgtagctctgcctgtttttaaattatttcgtgctatactttagcctataaaaattcacattatcttgtagaaatacaaatctttttaaagaatctttcatttctgtttctggtacaaacaatttgtgcctttttgagttcgtatttgctctctgtttacagcaaaagaggaagtaaaaagttgaaatcttaaaaaagaaagaaagaaagaaaagaaaaagaaaaaagttagttccattaatccagagctagagcttatgtgctggcgttggctaaagagccaatcatatatgtaagagaagaataagtttatttggaaaagtcattggtgtagagaacacagatatcagctatgtgcacaagtgaaaggtaatgatattatcacacgaaaagtttaaaaattttaactggctacccagacagaagactagaaggaaacatatcaaaatgtcaagaatagttatctcttgagtatacaggcttcagatggttttaaaattttttggtttgctcatctagctttctgcttttcctataatgaccgcagttcgttttatatatatatatatatatatatatgaaaaaaatcactgaactaccaacacatcattcaccggggtgaggaaatggagaggctaatgggaaaagccaggtataagccaggcaggggcagaggcctcagagcagctccttactatgtacagaaatgggtctggcccaagaggcagaaggagttcagggaacgctgttcatccaatggcttctctgtaaacaagatcagacacccattaatcccatggctgcactgccctttcaactatgaaaagtatagccttgtggtcagagccccacctgtgcaatcagactgccagggtaggacagtgtgctagatcacttactgggcgtatgaccctaaaccggtcaattagcctctctattcctgttttctcatccataaaatagaaatcacaccaccacctacctcctagtgtggctatgaggattaagacatgattcactgcaaaggcccagtatacaataagagcacaataaatgtgtgacattattaggtctctgccatgaaacaccagcctcaagtgcactctcaaaaccatgtgattgggtcctgaaacaaccagaaaaggttctaaataaagcctttcttttcccttcttctatgctgaagacaggactacagcatactgtttgctttaacaccagtgctctagggagccatggaagaacaagggcagcccagtaaaatatgtaacacgtcccaaggccccacactatgggctagaaatcctgctcccaaagttacacaggatttctagtctcttgccactgccaccgctgccagccactgcctttggcaagaaggtaggtgactcaagtgtgaactaggacttggcaagggaacaccaaaccagaaggcctccaggcaggaagctccaaaaaggccacctgctgaaacagtttgtctgcaggcagcctccgagatgaaagtagtgttctgccatcattaacaaatgcaggtaagaatagtggacactttaaacatgcaacagaacttaccatcctagcttcataactctgaaaataaatttcgggtagagatccaggctgaagatacgaccacacacttaaaatgactacagtgcctttaactatatgacataaagaacaccctaaaacagtcaatatcaaatcaattttcaaaaaggtttcatggctatctttgagtcaaatgccttagatctgtatttaacaaaattttctttcccaaacttaaaattatctcactttaccaaaaaatataaaactcctaatgtccacatacaaggaactaattacattattatattaatgacatagttgaggatgttctatgttacacagggtaaccagttcctcccagtttgcctggaattttcccggttttagccccatatgctgggacaccagtcaatctgcacaaaccaggatggttagtgccccctaaggctgcaataaaaattatgtgtgccctgtgaagaggaaaacagaagggacactgttacaaaagttacaaatgcagaagtgctaaatgccaagtttgtttgtttgtagtgatagctcccagttccttttttacagtgaaaaaaaaaaaaaaaagactaaaaattacactggtctctccctttttctttttactctcctgaaaaaaaaagagttaggaaaaaacattttccttctcttacaagattgagaggtcactacaggactgactgctgaagtagtgtctgcttcacctagcaagctcctgcacccagctttagctggagagaaaatgtcatcatctgtcacccctgacttttgccacatttaaagacaaatccagacaatttgtgtttcaggttatcaacagtaaaaaatccaagaggcctagcaaaaatcaagattcacttcacaaatagggcattcaacagatgaggtgccaggcacagtggctcatgcctgtaatcccagcactttgggaggctgaggcaggtggactgtttgagcccaagagtttgagaccagcctgggcaacatggcgaaactctgtgtctacaaaaaatacaaaaattagccaggtgtggtggcacacgcgcccatagtcccagctactggggaggctgaagtgggaggatgtttgagcctggcaggccaaggctgtagtgagccatgatcatactatcgagtcagagtgagaccctgacacacacacacacacacacaaaaaaaaaaaaggagggagaaattaagaagtggttgttttactagaagctgaatggagagcaaggtactcctgtacaaactctaaggcagggattccaagcaggcgggcggctccctgcccacaatgatggagcaaaactcttctagtagtggtctaagcaaatggttttaaaagttaatctgtgaggttaagaactgacttctaagaattgagtctcaaacagaaaaggtaagactatataaggcaagaaagaccacacacttacttcctggacctaaagctacacagaaaccatcgttgttcaccaccccaccccacccaggccacttccccaccccatctccttctgactttgtcccaagatagactggacattttcagaagttcttgaatcttaaaacgccttaggttctttttacgtatctggagatggaaccaaataaacgttgtgtgactcttcctttctctccatactcatactagtttattgggggaaggaaggaaatatacttggaaacatcttaaaaggcaacatctttgaaattcctgctctgataagccctgaagaataacttcctctctttgtaagaccaagtaatacacttctcactagggttgatcttgatctaggaagagatgttttcttgtaacccttacaacacatccaatgagatgatggagctatcctataccaactgtagcagaaagtacaagcacctggaaggcagaagacaagagctagtcccagtcctgcaggcctatagctggcattctttgaggaagacttgcttcacttctccagatctgttttgtcatttagaaaatgaagggtttgggctagatcatccttagagtccttacaactctaaacttctatgtgatgttctttcttatatgtgataacaatacctattagaaccattctttgtactttgaagatctagggattaacagacaagtacagcaacgtgtactagcaaagatgacaggcccaagacacgctaaaactgtaggatttaaaatacgcaaatgtctaacagttggcaaagtatgtgaccaaaaggtgaaggaaatcctgatatcaacttacacttttaaatgctctggaaccaatgagaacaaatacattcatcacaagtaccagctgctcttcttactaaatttaacaataacatgaattttaactcagtgatttccccatcaccaaccccgccaaacacctgtaaatatttaggaaaaacaagctaaaaaaattgaatctaaaaggcaggagaacaaatcattgcaaatcattgtggtgacggactgcacttcagttgcaagatgttctggctggatactaactggagaacgcaaggcagcagatgcaacccatggacaagtttgaggtatttaataccaagggctggcaagtctgaccctgtagtcaaagtcaagattgcctctctgcctaccaggaccccaaaacaaagttcctttcactacccacgaataaacgggggtgggggtagcaagccgtttccttttttcgtggaaagagctgcaaagagttttgtcatgcaacttggtttggtgcctgttagtgtcaatgtaagagcagcagagtccgcgaaggtggctgttaccattccacagacctgcggcgaggactgtcaatccgattcagcaaataaccccacctctccaagccaggactccagagctgccctgtgtggtgtctcagcaaggaaagccaacaaagctggtagacacaggcagaccgtagcccaccgcctgtgagtggaggctccgagccgacttcacctcctcctcagagggaccggcccgatccgaaagggcggtctccaggggtccccatcccgcaccacgcacacagcctggcgcaactaaagaggaagtcggatgtcacatccaacggataaataaagacagcccggccacacaagagccgcattctgggcaggactcctgctaggtttggggaggggtcccagtctgcgatcctttctccctcttcgtgcagcgtcctcctccccggggcccgggccggcggcgcccacgcaacgcggcgcggtgcgagtcccgagagcacctcgagcccccggccccctccccagccccgccgggcccgcggccgccgcactcccgcacgccggctgcccagcgcccacgggccctgccccagactcgggcgcgcagttccgacggcccagggcggggacggcgcggcggaggggagctgccgccgcgggctctcggaggcaccggcggccgcacacagtcctccccttcgccgcgagtaaacagctcgcgggcgcgctccagccgcgcccccatccccccgccgggctccgcgccgccccgcgcccgcgcgtcccgcccgccggcgccgccgcccgctacctggtcggtgagtttgagcactgccattcttccgctccttcgcgcgcacacacatgcaggtccccggcccgcagatgtcacgccgggagccggggaagcggaagggattgccaggagaagggaaaaaatctggctcccgaatttgacagccctccccctgctcctcctccgccgccgcctcctcccgccgagaggctgacactggctagtggggtttgca

SEQ ID NO: 1113 - DNA, 211327 bp, Homo sapiens
acattctaaattggctcagttaggttttatttttcctgtttaatatgaagcattgggaaggacagaagaatattagaaagaaaagttacgaataaagttcaagtttccttaattaaaaccactgaaatagacctcatttggatgaagctaaaaaataaaattggttcttctttgcctctgtcattaaaaggcacttaatttatttaaaatttaatttgtatttagtataatggtatagatccaccttaacctggataaatgggaactatctactgcacggaagaatctttttggcagtattcccacttgaggcaattattccaccgtatttttgcggtaacctacttggctgtgtcagctccgctggttattaaggtgttaatcaaaagctcatgaccgtatcttgcagccacatggagaggagtgttgccgtccttatccacacagtcaatttcacctcctgaaagagatattttaatacaggataacgcaaggattcaggttgattcaggtcctatgttctctgctagtctctcgtatcaaccaaatgttgatttctttcctattccagttgtgcatctttgctccgaaatacaagaatgcttttaaaggggacaagtcaccatctgaagcagtagtagtagtatatctgcgtagacagaagtctattagagatgcttttgaggccgggcgtggtggctaacgcctgtaatcccagcactttgggaggctgaggcgggcagatcacgaggtcaggagtttcagaccagcctgaccaacatggtgaaacctcatctctaccaaaaataaaaaaattagctgggtgtggtggtgcatgcctgtaatcccagctactcaggaggctgaggcaggagaatcgcttggacctgggaggcagagattgcagtgagccaagatcgcaccactgcactccagcctgggcgacagagcgagactccgtctcaaaaaaaaagaaaaagaaaaagaaaaagaaaaatgcttttgagaaatctttccatattgtcttagttaagaatccaaaatctcacaactaaatgcctgctctgaatgaagaatgtattcaaatcccataaagtgtaattctgaagacatgttcaattttaattttccctgctgaattaaaaacctatgtaaaccttgtgctaaaacataagaaccaaaggggatggacagttcaggaaatgatttcatgtaatttgatgatctagcttatagtattttaatattatgactaaaatgagtaaaagcatagacaataaactgaaaatgcctatatttataaaaactatgacaataatcatccatacttcttttaataatatagtattgtcattatgttttattttgccttctcttcccccagtttttatttcactaaatttctttttttctctccctttttcgtgtgtgtgtatatatacaattggtctattcattcatttatctgaggaaccatttaaaaagttagctatcataacattttaccgctaagtatgtttttcctaagaacaaagacattttcgcacataaccacaattccatcattttacccaagaaatttaacattcataaaataattttatgtaatattagtgcatattccaatttctcagactgtccccaaactgtgctttataatagttatcttgttgttttaatccaggatccaatcaaatatcctgatagcacttggttgtcatgtctctttagtttctgttaatccaaaacaatcctcctggctttttttttttaagtttctcatgtcgttgatattattggagcccaaatcacgagttgtgttggacgctctacattctggagttgtcttttggtttcttcattattagattcaggctaaacattttggcaacaattcccagagcagatgcgtgcttcccgctccattttcttagcgcacacagttattccattaccaggtgatgcaaagtttgactacttgcaatgggtaccaactttcagtttgggaaaagaaacagccctgaaaatggatggcagtgatggttgtacaacagtaggaatgcactggatgccactgaactgtacacttaaaaatggctaaaacggtaaattttatgttatgtatattttaccacaataaaaaaaaaggcttgattatgtggttaaggtggtgtctgtcagtacacttactgcaaaaatatcttctcctctttgtaattaacaggcaatctgtgcggtgatacaggcaatcagagtgtacagatatctgatttcccaacagactttttccacaataatttttagcatatgtggggagtactttgttcaaaatttacctgaattttttactgtgtgcttatattatctatataagttaggttcatttgattctgtttgctttcaaatatttttactgggttttattttattttaataatatgtaaaatacatgtttcaaaagtcaaaagtcatatttttgaaaaggcttactcattcttatcccttcctcttcatcctcatacacaacctacagcaagcattttcattagttttagtttatgcttctgtgtttcgctttgcaaaaaaaaacaaaaaacaaaaacaaaaacaaaaaaaaatccccctacttaacagtatttcctagaactcacttctaaagatgacttcttggagatcttcctgatttttgtacagttttattgttttccattgcacagttgtactagtttagtacactcgtctcctatgggtaagcatttaggttgtaaataacattttgctattatctggaatgccacagtgaataatctcatatgtatgttgcttcatatttgttagatgtatcttcaaggtaaattttcagaagggagatatctaggtcaaagggaaaattaatatgtggttttgtcagattttgccagatttctctctgtaggcacggtgcaattttacactctaaccagcacagtatgagaggcacttttccttatagccttgtcaagcttttgaatatctgctatctgatgggtgagagctggtatctctctgcagctttcatttgcatttctcttattatgagggaagttgaacatcttttcatatgttatagaaggaccatttgtttatctttttctgtaaactatttttcatgacttttgctcatttttctaagtttgtgtgtatgtccttaaacatatacacaatactgatatctaaaccatatacacatatgtatatatgctagtataagtaatataaaaccccaagaaatagaaatatgtgaatggcttaaatgtcctcaaacatacaaacaaacttagaaaaatgagcaaaagtgattttcaataacttttaaaatgagtaagctctatttgggagattactcatttatcagcaatacatgttacaattatttttctcccaggttttgtttttaatttttgatgtttttttccctgtcaaaaaaatttggggggtggcggggcgtggtggctcatgcctgtaatcccagcactctgggaggccaaggtgggcagatcacaaggtcaggagatcaagaccatcctggcaaacacggtgaaaccccatctctaccaaaaacacaaaaaattagccggcatggtggcagacacctgtagttccagttacttgggaggctgaggcaggagaatggtgtgaacccgggaggcagagcttgcagtgagccaagattacgccactgcgctccagcctgggcgacagagtgagactccatctcaaaaaaaaaaaaaaaaaaaattgggggaggaatgtattagtcttttatcatgtttgggtttgttgttagggagtctttccctataccctggtaacaaagaaattgacacatgttttctatacgtgaaaggttttctttttcagatatagatatctgatccttttggagtttatcttggtggtgtgtttgttgactgactaaataaatgttccctgaatgcctaaaagactgaaaattcaagaaaacagcctgaacaaattcacagaggcagaaactagattagtggttgccaggggctggggacaaatggggagtgatgactaacgggtatgaggtttctttttgtactgatgtctaaaccatatacatacctatatatgctaggataagtaatataaatatgaatgacttcaatctagaaaggtgtgatacatttcttttaagtaccttatttctgattgagaaagtattttcttattgtagaaaatttagaagatgtagtaaaatagaaatacaaagaagaaaacagaagtcatctataaattcactgactatccaagatagtcagtactagtattttggaatatttcctcccagttgtatgtatgtgtgcatgcgtgtgtagaattttcccatggttgagttcccggtgtagaaaaagttttttagtcctacgttctcctttaatgttacattacaatccttcccatgtcattaatctttttcattaatataattgtaaatgactatataatatcagtatctagagaatttacttagcaagtccccaattaataggcattgagggcatacccaaatctttgctattaagaaaaacacaggaatgaacatatttacaaatagtctttacatttcagatgatttcctttagtaacttttttctttttcctgagacaaagtcttgctttgtcacccaggctggagtgcagtgacacagtctcggctcactgcaacctccccttctcagattcaaacaattctcctgcctcagcctcccaaggagctgggattacaggtgcttgccaccatgcctggctaatttttgtatttttagtacagatgtggttttgccatgttggccaggctggtctcgaactcctgacctcaagtgatctacttgtctcggcctcccaaagtgctggaattataggggtgacccaccacacccaggcagcaacatttttaaaagtaggactattggactaaaagtatggagacccttgatacacaccagcaaaaaacttttgagaaaggctctgcccattagcattcccattagcagtatacttgagcattataccaaaaagaagccattgagagtcttctcagctctggggaaagggcattatcttccaggccaggacactgtcccttgtaataagatcgtccataaggtcctcatcagatctatatgtccttcattccaatgaatcctactattggccattataactaacaactccccaacatttattttcagcaaacaacgctttttctagccaagtgtactggcaaaacgcagggctagagtataaaaatatttgctacaaagtgaaatgattaacaaaaatgtgtgcactttgtgaaggggacaattgtttcaaaaactccaattagcacacacaggattttggatgcttccctctactctcaagacttctgtgtgtagaattttgtttgaaaatcaacttgctgccagtaagtttacccatttgggggtctgcaacttaatagctgtttacgaaaagggaatccctttttaactgactgggacagagaaatgtaaatgggaacttgaatagaaatactgatctttcttcaaatctttgtttctgtgttacagtggggttcttttgttgttgttattttggggtttttttttgagatggactctcgcttttgttgcccaggctggagttcagtggtgtaatctcggctcactgcaacctctgcctcccgggttcaagtgattctcctgtctcatcctcccgagtagctgggattataagcacatgccatcatgctcagctaatttttgtatttttagtggagatgaggttttgccatgttggccaggctagtctctaatgctgacctcaagcaatccacctgcctcagcctcccaaagtgctgggattacaagcgtgagccactgtatctggctttatttttaaaatgaattgtccagataatagagtatgatcacttctgtaaagtaataattaaatatctttacatatattcttaaatacatagaaaaatccagaagtgtcaccaaactgccaataaaaattattgggatagggctgaggagacacattggtggagatcacggaatctctttcatgacttaattttagtttacggtgagcatgtactaattttataatcaggaaaaataataaagttagttattgtgatcgtctagggactcaacagacagttaactatgatctgaatttagaagtgtccaattgagatcaattcattttatgacttgatggtagctttggagacaggcagccacctcgtccccacagatacctcagagcaatccagtgtgcacgtatccatatcagagctgcccacggtggtctgcctgaaagccccagctgtcgagctgatccagggagatgtgggacagagatccccagactgcagagaagtctgccctggacaaacactccatcaatccacatccttcccagccaagagtcaccaaatcattcttaaaaagtgttagagcctccaggtttaccagtctcaaatatgccaaaaattgggtagagaaagggaagagtgaaaactatcaggaaggatggagtaggggtctgagctgataaaagttttttcttgtagttgttgctttcattttacaagtcagcttaaaactgtaaaaatatagataactggccaggcacggtgactcacgcctgtaatcccagcactttgcaaggccaaggtgggcagatcacctgaggccaggagttcaagaacagcctggccaatatggcgaaaccccatctctactaaaaatacaaaaattagccaggtgtggtggcaagctacctgagtagtcctagctacttgagaggctgaggcaggggaatttcttcaacccgggaggcagagatagcagtgagccgagatcgcaccactgcagtccagcctgggctacacagcgagatttcatcccaaaaaaagaaagataattattgtccatatgtgcttttgttatcatttaaaatatatttcaggaggccagtcgcagtggctcacgcctgtaatcccagcactttgggaggccgaggcaggcagatcacgaggtcaggagattgagaccatcctggctaacatggtgaaagcccatctctattaaaaaacacaaaaaattagctgggcgtggtggcaggcgcatgtagtcccagctactcgggaggctgaggcaggagaatggagtgaacccgggaggcaaagcttgcagtgagctgagatggtgccactgcactccagcctgggtgacagagcaagactccgtctcaaatatatatatatatatttttttttttttttcaggaaaacataacttagtggaaaaataaaagacagactctctatttgttatctgaaaacatgttttctatataaacagcacctctagataagtgcatttctatcttacaattactccacaaaccttgccattttcatttgaaaatttttaaaacttgcttggaatgcaaatgaaatctctttaccgtttgtcatttgaaggttgcaagttaaatattggagattgatcattgacaaccagtgaggaaaataaacatttgccagtttagaagtatgcagagcatgtcagaaaggataattaattagtatcctctaagcattcatctgaaattagtttttcattgcacaaacaagaatgatcagcttattaagttgccttggaaggattgtgagccaaagggtcaaaaatctcacattgactcatcctaacctacaacttgactcttccttttcaaactctatttatttttaaagcttctgtgaagaaaacatcatttttgaacttgtgtaacctgctggacggcatctgaggggggtgcctagggccaatggtgaggtcaaatgccttcagacaccagatgctgtctttggtcagttgctttccctctattgctgtgacaacacagcttcagacaacaaacaatgtgattggatagcagaggtagtctttgcttactaactaaaaaagagtggggttttttttttcattattgtcttactaaagctggatgattctggaaaaacaaagttatgaaaactagtaatcctgactggagagcagtcagagaagcagagaaaactattcaaagtccaaacaccaatgcaatttaacaaaacaaataaatacaaagaacattcctcagtagcatgtttagttgcttcagggagccaaatgctgtgcccatgtggtcctggaggacagaggggctcctgctaggtgatgtcccactctggggggactgacaccaggccctaggggcatgagcttctggagagggagtgtcccagcaacagcccaagattcttcccagaaggaagccaacaaacaggaggtaaaaaaagaacttccttttcttctccccaagggcattttaaaaaatgtcaaatggaagaattcacagttctcacatgtgttatgaatgcaaaaaaattgtcagttgagataagagaataccaaagcatccttttacagggaaaactctatttcaaatataagtgactctcagagtaaacagaattcaattttaaaaggaatttttttaaaacaccattggtttctggaggtcatgtttataagcgtggtggttgagagttcagtctctgatgtcagacttcctgtgttcagatccctattcctcaacatactggccatttatccagacacaagtgacaacctctctgcctcagcttcctcatctttgaaatggagataatcatagtacctttttctcatagggtggttgaaaggctttataagtggtgtttagccaagtgcctggcacactatgaacacttggctttatcattatcacttagctttatcattatatataataggctacatattatagccactatatccttatcaattcaggcccctggaccccacccaatccataagcaagatgccaggacaaccaagaatgagagaggttctgaaacaaagatcccctgaccacagaggataagagacagggtctcttttaggtctcccccaactcaaaagtctagcaacagcagggcacggtggctcacacctgttagcccagcattttgggaggccaaggtggacagatcatttgaggccaggagttgagaccagcctggtcaacacatggcaaaaccccatctctagtaaaaatacaaaaattagctgggcatggtggcacacctgtagtcccagctacttgggaggctgaggcacaagaatcgcttgaacccgagaggcagatgttgcagtgagctgagatcaccccatttcactccagcctgagcaacagagtgagaaagtgtcttaaaaaacaacaacaacaacaacaacaacaacaacaaaaacacaaataaacaaaaaaagtctagcaagaatatccaggcaggacatggaattcttccagcccacatggctcttgcagaggccaaagctgccagcagtcccctgggactgttgtaagcatgccagcaggacagagaggagatgcgtcatagagatgaccagcatggcctgacgcacagggatgaacctgcggggaaggcagtgcttagaaggagaaaagttgttttccctccaaccttgtctctggagcttgaagttgctctaaaagggaaccaagctgtttaagttttgtttgtttctaaaagttttgtttgtttttaaaggggggtggacattatttctgaaaaacagttgagaaatacagtggcataagagacgtgctcgaaagagactagggtcactccccccgaccccctttatttacattcagcaaaataaaacacggtggccttttcaataaaatgaatgtcaaaggcatagcacatatttcaaattagaaataatgggtattgcacggttaatttctgttttaccttccttggctcactggaaacttgttaggatttcttttccctatagcttcactggaatgcatataaatttcctttgctttgctgcagatattttgcttgctaagcataattccactggctggtcttccatccaaatgtcaaatgacttctttgttttatgtcttaagtgactaagacataactcagtgccactaataattcaagtgtatgtggtccgaaattcttatagatgagaaaaatacaggtccaaggaaactgactaatatcagaattttgagaagtagaagtatgggtcaactaaaaataggaactgccagattgacctggaatatcagcttaaaatctgaactaaacctggtttttgtcttttttaaatactctctaagatttactaatagaagtgatgctgctggccatgaccccctattagtaacatgaaccaggatgtaaaatgatactccctagtactttgacttcagtgacaacctgatggttcaagcatacctttgtcgtaagcccagaaagttactatattactgtgactttcccaggtcttctctgtcaagcctgtgaatttttttttttttaagacaaagtctcgctctgtcacccaggctagagtgcaatggcacaatcttggctcagtgcaacttcctcctcccgagttcaagcgattctcctgcctcagcctcctgagtagctgggattataggcacctgccaccactcctggctaatttttgtatttttagtaaagacagagtttcaccatgttggccaggctggtctcgaactcctgacctcaggtgatctgcccacctcggcctcccaaagtgcctgggattacagacgtgagccaccacgcccacctaagcctgtgattttatgatcctttatatcacatccttacctgcttttcctctaagtcatctcatttttcctaattttgcccaactagcttaataagttttaacttaggaaattatagtgaactctaaaatttaaaaataattcagatttgttgctggaaaatgaatgctacttacctttattagtttcagagtgagatgcacaggatcttgagcctacataaatacatcatttccaatttcaaagctcatgctctgtgcctgactccaaattgactgtgaaactgtggctttatgtttttactattaaggtggatgttgatgacatgtctgatgaacagtttttagcaaagtacatcaaagaattatgtaattgcatgcttactaaaactccaaaacagggcatcgactttcatatgcaggtgactgacagccaaattcacaacaagaaactatcgaaataatgacactactgaagcatctctcttaccattctgaatgagggtctgtgaccgtgtgaaccttccatggacagctgtcatgtgcagtggacttttgccatctttactctaaaaaaaagagagggagagaaaaacaatggaggtgctcatgagccagtgacacccatctgaaatacccctatggacactcctaataatgccctgaaaacattcatttatttatttattttttaagtatgatcaacatgaggctgcagtgagctaggattttaccactgtactccagcctgggtgacagaatgacattcttctaaataaaataaaataaaagtatgatcaacaattacaagaggcaaagataattttgaaaggaaaagataaaatgtacctgacctctcaagttattgcataacatcacatgttttaaaagcttagagaaacagttatctgaaacctttattcctctcctgtgatctactggagaaggaagtttccttcaaggtgtttttttcaacctttgtctatagtacacaaaaaagacaaatgtgttaccttgcatggtattctttaagctgaagctgaccaaatggctctgaatcactgcaactcttaaaactgacctgaggccggtcgtggtggctcacacctgtaatcccagcactttgggaggccaaggcaggtggatcgtttgagatagttcaagaacagcccggccaacatggtgaaaccccatctctaccaaaaatacaaaaattagccaggcatggtggcgcatgcctgtaatcccagctactggggatgctaaggtgggagaattgcttgaatccaggaggcggaggttgcagtgagccaagatcgtgccactgcactccagcctgggtgacagagtgagactctgtctcaaaaaaaaaaaagaaaagaaaactgatctggaaccctctactattccctccattataattccatttaaaaaaaaaatcacttttaaaataaaataaaacaaaaaagaaaaaatttaaacaaaagaataaagaaaaagaaaaaaacagaaaaaaacaaaaccataattttttattgttccaaaagagaatctcttactttacttaactcattagaagtcacaggactaaggcatgcaactgtttaggaaactgccttttgaatgaccagctgggaatgtgtgctgaattcatatatttgttactattcatgatcgaaattatgaaatttcctgacacagattaagccaaaacacagaaaatgtacaacagctatataccaatcatcattatactaaataccaagataccatatgtaactaagaaatagtaatttacagaatttcttctgaaaataggcccaaaagaaaatattactgttattttagaataaaagtatccccaatagagagaatgtattttcatccaagtattgttatcaaaaaaatctatgtaacacttatttttataagtctcagaggaaaaatttctctaagtctgagattaaaatacgaggttttaaaaatgcatgttcattttgtgatgaaatccaaatgcctgtattttaaaatgactgttttaaaaactccatcttggaaaacaaataataatttaggtaagtatttcttagagtggaccaaggactgcccacgtctgaatcacccaggattcttgttagaaatatgaattctgggccaggcgcagtggctcacgcctgtaatcccagcactttgggaggccgaggcgggaggatcaagaggtcaggagatagagcccatcttggctagcacggtgaaaccccgtctctactaaaaatacaaaaaattagccaggtgtggtggcggggcctgtagtcctagctgcttgggaggctgaggcaggagaatggcgtgaacccgggaggcggagtttgcagtgagccgaaatcgtgccactgcactccagcctgggcgacagagcgagactccgtctcaaaaaaaaaaaaaaagaaaaaaagaaaagaaaaaaaaagaaagaaagaaaaagaaatatgaattctgtaccttaaccctgaactacagaattggggtaagagggtcccatttttaacccctgctttggactgtgggctaaaataggttataaaaccaaggttttaacacaagcattttattatattctataagtctattccttagaaataaaaaaggaattacacatagtctgtgccaagaaaaaaaagttaattagaacggtaagttcatcttaattgaaaaaaaaaaacatgtatcattataattcaatattctcaggtagatgtgggaagaaaagaaataataggatcttttctccatcttctatgagtataatctgaatcagaacagactgagaaaggagagctgaagcttgataatacttttagaggaaaaactggagcaatcaagagaatgagatacaaaaccatcgctgaccatgagacatactgggaaggagagctcctaaaagttatctgattccagagctaggccttagttgtcgggactgcacacagttccaaggactgaaacacctgggaactactttggaataaggatttaaaacacccccttccaattaaaaagtgatgacacttcaaaataactaaggcgagagaaggcagaaattgtggagttggcattaacttgtccctaggtggtgctatttctttaaattttgctccagtgttttctcttaatatgaaaccataagtaattattaattaaatatatctaaagctataaatacttcagcatttagaaaatatcttcacaatattcagctaagcaattttccatgtctataaaagagcttaaaggccttaccaaggagtaaccaccaacttggtggtagctatctaagttgcaggcagagagacaaagcagaagtgatctctgaagtgtgtggtgggcaaagccaggcccatttcagggatagcaaacaccacaaccttcttttctctgagagtgcttgtgcacttgtaaagggacaagtaaatggagatgaccaaagttaggtaaaatgcaaagaacagccatatgatcagtggtgacaattgctttgcatccatctttgcagatctttgcctgggttcatctatagcctgagtccaggctatagctgatatttttttcttcacatagggaaacaggtagataaggtggggaaattgggacagaaagcattaagagtatcatggcagccattttgggacaactttgttcacatggtatgggtgtaaagggagctcattatttcaaaaagctatagaaaaccaatgaaactcaaaaggataatactttttatataattcttaaaagttagaactcagaacattaaagttgagactagggaaccctactgagtttcatgatctgagaaattgaaatttatcatgcaggggtactggctgttgctactattcctagaattgcacaaaaagataaaacattccttgcgttctcaaaagagagaatatgtgcaattcttccatctattcaaagcttttatgaaaatttttttcttaatttctagtctccctccaattttctagctacattttcccatagaatttagggctttgaaattattgttattttgataatccatttaattaagcaagaagcacttctattgagttaggcataatcaagccctaagtcataaaggaaaaatactgaggattaaaatatttacaacaaatattagtactctttcagggcagaactcagcattgcctaaggaagattaatctttgaactaaaagcagtgtttatattttcttgaccaccagtctcctcagaaatccattcactttttcttttattcctaatgccttctttcctcatcttccaatatcccatatacgttccctaaatttacagacattgttgttccccagggtcttgaaagcataatgttctctgtggcatggtacacccctggggtcacagagctcagtggccctactacagagcaataaaagctctatgggataacattaagtccaacctgcggttaggggtggggtcaaataaggtgagaaacccaataagtcttcctaattcaatgcaagagcctcctaaaatactggtgtgaaaaagccacacattgtccaatttattttgttttgttttgtatggttctaagggcaagagagatggaacgtggttggctcactcattcctctcctttcccttacttctccaacgttctaagtaccgtccctatcactgcctactcttgcccattccagtttccaccttcaacttctccaacacaacctattccataatttggtcctggtacatatagagaagggaactggtccacttcaagcagacatgtttcaactcccatctcttagagctaaatgatctaagagcctgcagacagaaaagaattgagaccatgcacaggctaaatgtcagtgaacaggaggtagacaacctggcaatggcaatttctgagtctgtctttctaagttgtatccagcacagctctatgtctagtgccttctttaacgcttactttgaatgcttgctaaaagagccttgagatgctacagaaattacaatgtagtctctaatggaaaagaaaaaatattttatactttctcatgttctacctatttacaaattataagtaaaccatcaattgattattgtatcagtaaagtatatctttattttatcacaattaaactcatatcatgaagtcaaaaaacaggaccagagtcaatcaatgtaagcaaaatgaggaactgtgaaatgcaggctgaacacacatccctcctcctcttcccatccatcttttagttgctcatgaagacatcacttttactattttgtgagaatagaggaaaacaaagtgaacatgtggataggtaatggctgcatttcaatatgctacttccctcaacttttggaaaatctaaacaaatacaaattgtcttgcaatctacaaacactttcaaaatccaaggagcaatgtggtacagagagataacaactttaattagacagctacctccagagtcagacaggatggctctatggaaatgttagatgatccgtgcatccagagtgaatctggaataactaaggaggattcaaagagatttaggaaatcggaggatacagacagaatagatgaagggagactgagaatgaaggctagatttgattcaaaatcctatttacacagagtcaatcataataaactcaaatctcagagttttaaaatggcatttcttatattctagttatgatcagcagtccacaggaaaaaaataaatattaaaattaaggaattatgcttttcagctccatttgtggaagggaagaaggggctgcaaaaaccaatgtatcacagaagctgaagtcccttatccaatctgaactgaccactggtcagttaactgggagcagtaggccggtgtgccagagagtagccttctagcctctggtatggggcacactgagagcattggtggcatgttttacagataaaatgaagtgcatcagacaactctgtgaattaattaagtggaggttggtaaagagagcgcctttattaaattccaataatttcccttcctttgaaggattcacaggatgtccttcagataccaggatggcaagacagatgtctacagttttgggaacgctggcagtttgaccacccacgtgcttcctgccccctcaacaccacgctctgcgacttcagcctcacgcaaagattccttaccaacctcagacgacagttccttggtctctttgatgcccccattcttttttgtctgctttccatcttcatgaaaacacgacactccttcctgtctcctctaactccttttatcatccctttctctggctctttctcctcctcctgttcctaagagtaaagggctgtttcactttctgtactcatgctattacatactctctccttgggcggtctcgtccctttctcctggtttcaacaatcacctttacatgaatgaagcaatctacattttttcttctgttctctaccagtctgccatgctagaacaccacatttgacactattgggcttctcagactggctataccaaaacctaaaaatcagcttgtcaaaaactaaatatattggtttaactccctaagcctactcttcctcctgacgtctttcttaatgaacatcaataataacatctatttttctagtgcttatcatgtggcagatattattctacatgatttatgtatgataaagctgtttaatattcacagcagttccatggagaagacactattgtttccctaattttacagataaactgagacacacaaagagcttgtttatgattatatagatactaaaagtcaaggctaggattggaatttaggcggtctggccccagaacggaacacttaactactctgctgcaccacctttctttgccggatttctttcttccttcctaccttccttccttcctttattatttatttatttatttttttgacagagtcttgctctgttgcccaggctggagtgcagtggtgggatctcaactcactgcaacctacgcctctcagattcaagcaattctcctgcctcagcctcctgtgtcgctgggattacaggcatgcgccaccacacccagctaatttttgtatttttagtggagactggcttttaccatgttggtcaggctggtctcgaattcctcacctcgtgatctgcctgccttggcctcccaaagtgctcggattacaggcgtgagccaccgcgcctggccaatttttgtatctttggagacagggtttcaccatattggtcagactggtcttgaactcctgacctcaggtgatccacccacctcggcctcccaaagtgctggattacaggcatgagccaccacgcctggcctctttgccacatttcaatccttacattagtcttcaactcctccagttcatgtcccaccaagtcttgctgattttctttctgcaaagcctctcccttcagtcccgttcccctgttctcttattacctcttaccaatgccagttttattgatttctagttatccactaatcagctcttctctaggtccactatacctgggttttctttttttcaaaagtgaaaatagcttttttggttttctggatataaaaataacatgctctgccaggtgcagtggctcatgcctgtaatcccagcactttgggaggctaaggcaggcagatcacttgagctcgggagttggaggccagcctgggcaacatggcaaaaccccgtctctacaaaaaaatacaaaaattagcagggcgtggtggcgtacacctgtaatcccagctactcgggaggctgaggccagaggatggcttgagcctgggaggcagaggttgcagtgagccaagatcccaccactgcactccaacctaggcagcagagccagatcctgtctcaataaaaaaataataataataaaaataattttttaaaattctcattgtatcacaatcagaagactaaagcaaatacacaaaaaagaaactaaagtctgggcgtggtggctcacacctgtaatcccagcactttgggaggctgaggtgggtggattgcttgagctcaggagttaagagaccagcctggccaacatggcaaaaacccctctctacaaaaaaatacaaaaattagctgggcatggtggcaggtgcctgtaatcccagcttctcgggaggctgaggcaggagaatcacttgaactcaggaggcagaagttgcagtgagccaagatcctgccattgcactctagcctgaatgacaagagcaacattctatctcaaaaacaaaagaaagagagaaagaaagagagagagagagagagagagagaaagaaagaaagaaagaaagaaagaaagaaagaaagaaaaacctaaatcataattttgtctctctgcagtgataattgttgctagcatattggtacatactccagagaattttctctgtttttgcatcatctacacacataaccataacattttagcattaaaaaagagatcatatttctttattgcatttcaatgttttcattgataatactaggtgttattagccattttgatatttgccgttctttaacacaaatgtacgtttttgtattagtttgtatttttctaattaccagtaatactagtttttcacaggcttaatgtattttttattctctcttgtgatctgacttttgctccatgttttctagtaatgatcactttttcttattgatttgtatgagctctttttatatcaagcatattaactatttgcttatcatgtatattgaagaaaattttccctaagttgctcttattttaatttcatgttagaggttttattgttgttgttttgttttataaatgtttaagacttttttgtagtcatatatatgattattttcctttttttttcctgcctttggtgttctgtgaccggattactgtttttaatgctcaggtctgatcatatgacccctagaatgattcgtggcctgcagagcctggagaggcccaagctccttgggctcaaaatcatccagtagatgagtcctcttccttggtcaaatcacatttcagctcatttctggctcctttctgtcatacaattaaaaataaaaaagctttttacagacaggatctcactaggttgctcaggctgatcttaaactcctgggctcaaggaatcctacacctcaggctcccaaggagctgggattacaggccgagccaccacacttggcatgttcataaaattatactctatttgatacaatcaattgctattctgaaaatttgtcacatctttcaccactattagaaattgtgaaaaaatataagattttaatagtgaatagagaaggttattaaaatagactgatgtgatattcttgaaattacaccttagaaatcatttttcaaaaccagagacagaatacactgggaccttgcttcaggatccctgtgtgctgggaagaagggaagcctgggttgaataaaaggtctcctagcacagctaaggatattctgctacaatctaaatgcattcaagtgatgtcgcccaaattatgaatgctgcgtgataagctccccttggttagctgtcacatggcaagctgacaagttacctagaggttttcctatccagaattcccacccctctttgctcatgctgttctatctggaacactctctctcaaattatctctatccctcctcaactcaactacattaatcttccaagtctcccctcaaaatcgatctccattttttattcccaagcaaaaaacaagtcaacaattgcttcttagagtttgcaatgctttatgactcttctcatcatatcttctcttgctcatgattacctgagtgcatgctacctccctactacactgtaagttccttaaaggcagagactgaatctcatcttagagcactctttcagtaccaaacagagggcactgggtagtccttagtaaatttgctgaataaaggaatgattgtgatgaccagctcagtgctacatcactgaagccactatctggggtttgctttaagaaggtattggctgggcacagtggctcacacctgtaatcccagcactttgggaggctgaggcaggtggatcacttgaggccaagagtttgagaccagcctggccaacatggtgaaacaccatctctactaataatacaaaaaattagctgggcatggtggtgcatgtctgtaatcccagctactggggaggctgaggcaggagaatcgcttgaacctgggaggcagaggttgcagtaagctgagatcacgccattgcattccagcctgggtgacaagagcaaaactccatctcaaaaaaaaaaagaaagaaaagaaagaaggtatctgagaagctctaaacccacactggagttggaaacaggcctacaatcattattaggccttcctttgaattcttagcaacactgccctatcagctcaacattcacctcagtattagcttctgggcaagtcaatatcctagagatccagtatttgtcctgacacattcactaagctaacaagaacacacggctggagccttggtacctttcagctgataccaccactcctgaagaaaaataacacaacttttttttttttgtttttgagacggagtcttgctctgttgcccaggttagagtgcagttgcacaatctcagctcactgcaacctctgtctcccgggtttaagcaattctctgcctcagcctcccgagtagctgagattgcaggcacccgccaccacgcctggctaatttttgcatttttagtagagatggtgtttcaccatcttcgtcaggctggtcttgaactcctaacctcatgatctacctgcctcagcctccagacaacttttcttatagcctccaaatccaggacaaggctgtgaggttccaactcactaaaacatggcataatttgcagcagttgattttgctcaaacagaagctcaatgcaaaggcattcaacacagagactaagagtgtcatacctgaatgttaacatctgccccgttgtttactaacaattcaagacacaaagcaccatgagtggaggcagcagcaaaatgcaaaggggtgaacccattattgtttggctggttcacgttagcaccgtagtcaatcaactcgttaaccacagcatcctgtccattgtagcaggcgatgtgaagcgctgtatttccatagacattgatttcatcaatctgcaaaagagtccaacacagggtgattaaagtcattagagccagtttactccattttccacaaaaagcataacggctgtggctagagaaaggaaatagccatccgccaatataattgttcagagcttactcttgccccagtgtggtcatcttgggaatgcttgtcaccccatggtaaagatcagcaaaaagtcaatgtggcaaaaaatgaactggagacagagaagtttcatcctggggagaggtatttttcagctaacaaaggaataaaaggtgaagggcaaagctgctttcaaaacaccaaaagagaagtaaatcagaggagaatgaaaagagtcccacactctaggattggggcacagaaaacctcaagaaatggtgggggatggcagaggaagtggctgcggagatggcaggggaggtggctgtggagtctaaacatggaaggcgggtcagaatccactctctgttttgctctggagtccgacacctcaccaggttgcattttagtagcagagcagtggtgccgtcaggaggtgtgtttcgtccacggctccctattgctttctgagacctgccctggatgcctggtttcctcattatggttttccataatgatgcaacttggttttcctttcttgggggacaggatgttccagcctcaccactgctcctgttctaccagcagaaagagaaggcagcagtctgccttttccagctcaagagtagacattgctgctgtttgtctctgccatttattcattcatttctgctgtaagtcatgacttagaaggctacatttggaaggtgggatgcagaaccttggccagtctttaagaacaactggttaatatatattacatagaatctttatgtctatatatttatctatgttgatatagaaagttattcagtttccagttttcctctgcttagtgtatgcccccactgcccttcatcagttgcccacaaaaactcaaaaagacaggatgctagaaaacaattcccctgcccttgaattaaagtgcaaacaggatttaactttagaataacagaaatcttacaaatacactggccatgcattgatgcattcatcatagctcacctccacccccaggttcaggagatgcttgacaacattaatctgtccattggaggctgcagcatgcagaggggtataacccttcttatccttacaggtcacttctgcgccatggttaatgagcaatgctacaacatccaagtggcctttacaaacaaagcagcagaaaacatcgttaacctttataggacaatttgctgattcatttcacctaaattatcaactattagctttcatcgccaccagtattttgctgagttatttgtaaaaagctggttcatggcaactattcaacaaatatttattgagtacctcctatagtcaggcataatgtaaaagctgtggggagaaaaaagatgattcatatgtgagccttctcttcaaggagatctaggtgatgcttgttaccacactaatgaataatggtgaggttttgccaagatattagtagagagcctttaaaaatgttgtattaaaatgaaagcaatgcttttgaaaacaattgccattcctcactgaaaagtttaacaatgacaattcagttaggaaaaactgataaaagaaaaaaaaacaattaatgagaatgaccccagattattgtttaatcatataaaattactgctgctcaactgtatttggacccacaaaaatggcaattacatatgcctcaacttaaaagtatcctcatgaattagaggccaaacagaaaacccttctagttttagctcctgttagcatttttttctacaatattttactctgttccataattcactatatatagaataagcctgtacaacatggtgaaaccccatctctactaaaaatacaaaacttagttgggcatggtggcacatgcctgtagtcccagctgctcaggaggctgaggcatgagaatcacttgaacctgggaggcagaggctgcagtgagccgacatcacaccactgcactcctgcctgggcaacagagcgagaccttgtctcaaaaaataaataaataaataaacaaagaaacaagcatatttgacctttatttcgggactgaagattgttcaatgcttcaggatcattgctctaaatatggctgaaaattgaagggtagaagacaagtactgactccaggactttgtgtgtgtgttggggtggggggaaagtattggcttgttttattaaaatttgactcttttctctccaagactttatatagaaaaaatttttttcgattattagtgctgctatcttaagctatttgccctggttttgcctattattcctatttgtatcctgacagcacacaaaacaatgatttgatttctttagagtcatttatccaaatgctttaactgtatatacatcagcagagagcaatcgtgaaactttgcattctttgagtcctatccacactagcttagtgtgtgttcggcctacacagctgtctcccacagtcactggctccagtcctgcaggtgccacgcagtcatttcatatgcttcagccaactcaaaaatccatgtcaacttttttttttaaatgctaatgcttgtaaaagtttaagattctgtttttttaagcccaaggattcactcagacccacctttagccacataatttatttcatccctgccccaacctactctttctccctacaattaatgttaatttttaaagtgatgataaaaggcacatatgcttgttaaaaaggattcagaaaggcaaaaaggtattaaaagaaaaccaaaatcatccacaatcataaatccccaaagacaatcaattaaaattttagcatataatattttccaagtttgttattgtacagatttttcaatgaaaatgagaattatattatttatactgttttataatatgctttcatttaacatatcacagactctgtgttaataaacactcatggactcatcactgtagttactgcaaagtgtccccttgtgtggatcttccagaatttaccaaaacaatctcctgtggatgggcattcaggttgtttacaacttggtgctgatagaatcctgtctatttttctaatggcaggatgttctccaattagaaacacaaagggaatatcttagttcttcatttcccacaagtctacacttagaataaactctgtgagatctctcatttgtcagtgggatttgccaacaaaagtgaaaaggaaaaacgtagaaatgtgaactctcccaagcgggtagaaatgagggctgcaggcttcagttttgtcgtcagtggactatcaggataatcaccagcgcctctggtgccctccatctataaaatagccagaggtttgtcttttcttcctttctttttgtttctttcaaaaatatttataaatttaaaaagacgaatggaatttgtgtccttgctttccgagccagtgctctttctttttaaaacaccttattttactgccatgacaagttaaaataagcacaatctgtgcagctttccaatccagactgaagcacattcaaagaggcccaagccatgattcattcctcctcttctttgtaggataaataaatatctgacaaagcaactgcccgactggagtgcactatgcatgccagtaaaaccaaccaaatcttcattcaattgcaacccaagcttgaaaagaagtcagactggagaaaacctacatggtcaatgagagacccatggcttatttagttaaggttatctgtactttgctttccatgcatggaatccttacccatgtatgctgcccagtgcagagcacgccggtccttcttgtcaaatgcattgatatttgcccctttggccaagagtaaattgaccatctgaaagataaccaacaatgaaatcaagcatacattctgtaatggtgaggcctcctcactgcctgcagatgatctgagccaaattaacatgaaatctaaaggcaggtcagagatctggagttctgacaaagtagaaatatgatgtcagagcaggacatgtgtcatgtgtgtcagaggaaaagactgaagtgacagcctactttttcaattcattgtggctctaaagttgagaatgatatagatgctgaaggtttggtgtacaaatattttcatcacattctttaaaatctcagcaagaagatcagtttccacttgtggctgaaagtcctggagggagcgttccaattctgaatgataaaaatacccacctccacgtggccgttcagagccgcatggtgcaaggctgtgcgcccccctcggtcggagacattgacactgctcagcaggggaatgatcacttctgcacatttgacagccttgttggctgctgccacatgaagaggggtctgccagttcttgtcccttgcattgacatcagctgagtgcttaatcaaaacctgtactgcttcctacaacaaaagcagagtttgcagaggtcactgacagacgttcaatcaatacttactggtgtaagatgcttcaccaaaccctggaactatggagagaaaggctccccaaccctacaggctggctccagacaagccaggtaatatttggtaaagatcaaaagagtggcaaagataaagacagaatcactttacctttctttgtcaagccaagagccccggcacatctctaaaatcaaataaaccttctaagtatatgatgatgtccttacaatgtagaaggcactcttaggccaaatgagaacacccatgtgcaagtgtgcataccagggtaaaataaccatagacaaaaagacctcagacattcttggatcagtttataaatctttggttctctctgccaacatcttaaccctcagcatcgtgtgatcaataagtggtcaagacgggaagtaacatctctgttaccatctcaacttaaagctatgagttgtttccatcttttccatgttataatgggtcacttcttttgccattgttgagttccttcaccttcattgggcctcccacattttttcttctattggcccagtcagctccctaacctcttgatctatgactttcaaccctggctatgcaatggagtcatccatgcagctcttaaaagcacagaagccaagcatgggcaacataacaaaaccccatctctaacgaagaaaaaaaaaatcgacaaacatatatacaggtgcaaaagtaattgcattgcttttaatggcaaaaaccgcaattacttttgcaccaaccgggagtggtgttgtggacctctctaaatcctagctactcaggcggctgaagtgggagcatcacttgagctcaggagtttgacgtgatcacaatgagctgtgatcatgacactgcactccggcctgggcaacagagcaagaccctgtctcaaaaaaaaaaatacagtagtttaaaatgattatggaattaaattcacagacatatggaatattagaaatggagaaagccctaaggttcatctgagctgaccccttcatttcataggcagctttattttataggcaagatgacagaagtccagggcaatgacctgtcagcctggctgacttatgggctcttgcattttctaacaggccattttctactaggcttactcagtgagtagtctcagtcaagcatcctgacataaatagattcaacagttaattctccttagttatttacatttttaaatcctaaagttttagtctgctacactggcttaatacatataatagaaatttaatataatattttggcaaaaacaaagctttgattaaaaacagataactacctttttaaaaactgcatttctcttttaaaagttttaagcttggaagctctttaacttggttttacaagggagtaatttgatggctatttagggaattaatttttttttaattaaagaagtctgccttctcctgtatcacatattggctaaaaattaatacccaggagcttgctctggcagaaatatacaaggtaaaaaagaaactaatgtgggggaagggaagctgaacacttcctgaatcaagaaaagattatttttcttctgttaaattttttttaatcaacttttattttaagttccagggtacatgtgcagaatgtacaggttatataggtaaatgcatgtatggtggtttgctgcacagatcaacccattgcctaggtattaagtccagcatctgttagctattcttcctggtgctctccctcccttctccccactgacaggccccagtgtgtgtcgttccttctcacatgtccctctgttctcatcgttcagctcccacttgtaagtgaggacgtgcggtgtttggttttctgtttctgagttagtttgctaaggacaacagcttccagctccattcgtgttcctggaaaggacatgatattgttcctttttatggctgcatagtattccatggtgtataggtaccacattttctttatccagtctatcattgatggacatgtgggttgattctgtctttgctattgtgaatagtgctgcaatgaacataaacatgcatgtatctttctaatagaatgatttataattggattgctgggtcaaatggtatttctgcttctagatctttaagaagtcaccacactgtcttccacaatggttgaactaatttattcccaccaacagtgcaaaagctttcctttttctctgcaacctcaccagcatctcttgtttcttgacattctaataactgccattctgactggtgtgagatggtatctcattgtggttttgatttgcatttctctactgatcagtgatatcgagctttttttcatgtttgttggctgcatgaatgtcttcttttgagaactgcctgttcatgtactttgcccactttttaaaggggttttttatttcttgataaatttgtgtaagttccttgtagactctggatattagacctttgtctgatggatagactgtaaaaatattctcccattctgtaggttgcctgttcactctgatgatagtttcttttgctgtccagaagctctttagtttaattagatctcatttgtcaatttttgcttttgctgcaattgcttttggtgttttcatcatgaaatctttgcccatgcctgtgtcctgaatggcactgcctagattttattctacagtttttatagttttgagttttacatttaagtctttaatccatcaagaaaagtttctttaacagtgtttttcaaactgtctgtggtaaagaaccagttttctaaaaatagttattatttcaaatccatcacttttgagccaatacttttgtaaaatacaataaaaagtaatcagtagaataataaaatgaaataaaaatgagataaaaactataaatgtaattattttattattaaagttaatgggcatgaaattatcaaattgccctaaaagtttctgaccacctactcttttcacaacagataagataaaagctcacagtccagccccagtgctcaggcatgctgtgaatcatgctccttcaaagcctttgtttgtttctttttcttttttttttttttgagatagagtcttgctctttcgcccagcctggagtgcagtggtaccaacccggctcactgcaacctgtgcctcagttcaagcgattctcctgcctcagcctcctgagtagctgggattataggcatgcgccaccacgtccagctaatttttttgtatttttagtagagacaaggtttcaccatgttggccaggctgatcttgaactcctgacctcagtgatccgcctgcctcagcctcccaaagtgctggggttacaggcatgagccaccgcgcctggacctttgtttctttcttaatgaacgaacacctgtgaggattctggtatttcccccaaatggaggcatcagcccagttaacgttctgttttaggattgtaggccttgttggatgacaccctgtagcaggctgtcctatataagatgcagaaataatagaaaggaggagctgtcatgggatgtcatatgggaggtaactggacatgccatttgcgagtcagtcaatttctactttttacaactctttttatttaacaaaaggccacttcaaccttgaaataagaagtagaaacatacactgtggcacatggaaaagatgagaataggaggcatgtgtcttagaaactatcatccttaatatttgtttctttactctcaaatgtgcattgcatttcagtggtcataaattactcatggaaaagtaactgtttatgactacacatagtccctgcagccataagcaatgtcaagttttataaattacaagttgctttagataggggtcaaaatgttatacaactgtctgtactctccacaaagcctggcagttgctttgcacatagtgtatattcaataaatttgggtagaataaatacattgctgtaatcatcagcaaagtctgtaagtaataatctgtaagtgttaattttacattactctgggctgatgtccctgaggctgctcttaagtcctgcaggcttatgctatattactgtaatcatagcaatttcatattttgtaagaattgtataaattgatgtccaaccaatttgctcaattaatgggattgttcctctaaaagtaccaaagtaccaagcaccaaaaaaactcacccattattttaattattattacagcacaattattctaagaactaggagtgcaaaggcagttcactggagactttgggatatgaaagaattctaagcgaactatttaagaagtgctgactttaaccattaggaacggcagacactaaagtatgaccagtgtttaatctcagttctcgaagtgtggcatgtagacgacatgtatcagaatcttcttttgaaaaggcaaatttctgggcctaaccacaggcttcattcagaatcactaggggtgaggttttagaacaggaagtttcaacaaacaccccagagagtttaaatgcactaaagctgggtaccgcttgtctacattctaatagattataaaatgcttactttcttcctattccagatatgacctatattctacacatgaacaactttttataatcacgaagataatttaaagaaaacaataacattctactcttccatataatgtttccaattctcctgtctactagcattaagcccacaataatgatcatgttttttagaggaaagggtagaacataagtttttaaaatttcaactgtaaaataaaatgcttatcctgctcagctctgggaaagatctgtataccagttgggtcttctgtctgcacagaagccaaaaatagatgtgctttattggctagaacaggctccataagggtgctaatgggaattgaagaaagcagcacagaatggtggttaagcaggcagcttctctagtcacactttcctccactttctggctgtgacatcaacttcgttggctccctactaactttctgagattacatttcctaaactagtattgccaatagcatccgtctcgaagggtggatcagaggttaaaagagaataatatacagaaagtccttagcatactgcctagcagatagtaagtactttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccatgttagccaggatggtctcgatctcctgacctcgtgatccgcccgcctcggcctcccaaagtgctgggattacaggcgtgagccaccgcgcccggcgatagtaagtacttaataaacactcgtaactacaacacctacatggacacagtgtcctcactcctacactctaaagataagatacaaccatttttaacttttctaaccaaaagacagtctctagaatggagaagtgaaaagttcagcaattctcctctgatgctcctctcaactggttatagcagaaagggcacctgggacgggccagccacgtctgcacataggccacagcagcctgcatgcctggttatctccccaaatactgtatactaaaactaaaagccacactttgtacacactttaggcctcctgtagcacacttaacaatgccttctaccaagtgggcttccataaacgtgcgttagactttctgggtttgtgtacatttcgttcctttcccctacagttgctcttttccaagaaagaaaagcaaaaaaagcaagaacaagctgaacacaggaaataatatgaaataggcttcacatgaacacttcagaatattcccactggcagccccaattcttgcttatctatgttagctggcactataaaagatgtttctctaatattttagtaagagcctctcttcatttcttcacagcctagggagtacacagaaaaaaaaaggagaatgagttcagagaagcccttagggagccaaaaaggagacagtgctgttgggctccaagctgtttccaacctgggaatcccagatgtgccagatgtggggagcaggttgggggtaggaaagggtcgtggaattgtgtctagaagggaaaacacaagacagcctggtcagcatcacataagtcttcaagacttatctctagagctcagttatattttaggagattttcaagaggtgtgattatgtcttgatctactttcttgtctatggaggacataatgtcaggcatggattcatatttaatcaatattatgatctgacacccttattgcttaacatactcaggaaatgaacttagcaatgcaccttatttttccagacacagaaatctgaacataaatcttgcctggatgaaaacaaggctccaaaattttgacttagactgatatctgtgttatatgcaattgcaaaaccagccttgattttgcaggtttcagtggcttagttggcttttagtgtacacattcccataaacatgcttcaactctgttcaccctgcatgcataaaagattattaccatcaacattctgatatggtgtataccagttctatcttaccagttgtacacagaaaattattatagcttaaattgaaaacccagtctttaatgaataactcaaaaaaaaaacaattcttttctaactaggcaagatgctagaaatacaacggcaagcaataggcatggcatacatttcaaggagcttactgtctagaagatctttttaattcaaatagaacaacaatttctatggtagttttgtattgtgccaagttggctgagttgaactaaatttcccagaattcctttccctgtagtactccctttagggttggccacaagagatatctgatgagttttggaaggcataagtgaaactacagcctaactggtatgctgttgggcaccaggtagtgttgcagcttcacatgatgacactaatcggctggatcaccacgttggcaaggggcagtgcctggcttgatgcttcttcagatcctgctgcatctccttcagtttctccaattcttgggccaggtgcatgcacaactccttctgcaagtcacccatgtccatgatgttggaggcagtgttagacagacctcagttccagtttgtccttgatctcccccattttacatccagcttttccactgtagactctgctgacctacagtgacttcagggcctcacagaatccaaggtgatagcctcacacagaccacagcagccctacacacttgtgtaagatctaattcctataataaatatcttgctctgtatctctcatggtggttctgcttccctggttgaacctcaaaccctgagagatcaattatctacattttataagcaaataggctttgaggacagacagtatagagtttataaacttttcaatgaagaaatggtttcaaacacatgaacatgtaatatcagtgcttaccaatctaaagaacagacctgtgccagctctcagctgaaaccatatatccatcttgacaagtgctaacagttaaattccaaaataccagtccaaaccttctcttttcttcccctcaaatctactttcttttccccaactattagttaggagaggcataaaataatggcaataagactaaattccaaagaagaaggaaatctgaatttaggacttccacaggacagcaatgtgcttggagttaagatgtcttctccaccgtcagctctcacaatggttacagagactccaattttcttttcctttcttttcttttctttttctttctttttttttttttttttttttttgagatggagtttcactctttttgcctaggctggagtgcaatggcgtgatcttggctcaccgcaacctctgcctcccaggttcaagtgattctcctgtctcagcctcccgagtagctggggttacaggcatgcgccaccatgcccagctaattttgtatttttagcagagacggggtttctccatgttggtcaggctggtctcgaactcctgacctcatgatccacccaccttgtcctcccaaagtgctgggattacaggcatgagccactgcgcccagccgagactccaattttcataagaaactgtccaacttgctgtgacagatactaatatgaagacatcatgagctcatatgtgacccaattatttacagttcagggtttgtttgcatttaattcctatctggctagtgattcttttttcctccctgcaaacctacagagggagctggttacttggagaagcaacaaaagcctttctcagattggaaggtcagtccatcattaggctgactggattcaaacacactaaagatacttacagaatgcagactggttgttgatggaaaatggatgttttgaggattgaagtctttgaagctagttgagctaacaaagatagagatcacttgggaaaggtcacagagtaatgaaatcatcttttttgtgtctttcttttccactagactacacacttcctaagggcagagaccatcggtcttagtttttttttgtagctccatgagctacaaagaaaaggtgcctggcatatgggaggtacatattgaattattttcccaactaaaaagacctggttcttgttgaagaggaaacaaatccatacatatttttaaagagacacttaaatttactaaagaccaagtggtcttaaaaggccaggaaatactcctctatgaaggggttggtctcatgaagctggtaatacccactcagtcagctcactgccctcgttttcccagacaaaatggaaataaaatgtgggaccatgagaagattctgaattctccagggtctgagccaggcaatttaggattattgacctctctcattccatgcgggatatttggaaggagaacacaaccaaccccttttaaaacctactaaaatcacaaagcgcagcaagaaaaaccatgactactaagctgtcacctagcaagtatatattaaaatttccagatagttgccaaagaggaaaagctgacaccaataacggccaaagacacctgcaacttctgtatattaattctcagcaagaccttttgctcctaggtgtacctggagaacatcaccttctccagtagcagaggagaagctgcatttggtaaattcagctatggaggtcagtcatccagcaccaagtgcatgcaaggtttgaacctcttgtatccctggataatgggcatctcctctgaccaggcttcaaggctgacattcaccagggttccctgccacccctgccttcacattgatcttctcatcctttatacttcccctgagctacctgatgcatttaccatggtttgatgatcatcctccctgtccctgagtgctagacttgtataaataattatagataatctatcagtcatcttcacccgaatttccagcattcaacaacaaattatttcttggatgcctagactgtaccaggcttgggatacatccaggaacaaagtacagatccctgtcctcatggagctcccactccaacgacatgtttgctgaactcagcgttagcaaacaggacccaccagcctcccggcccctgctcccctgctctgtgcctcttctgttaacagcatcgccatttacctaccagcttctttcccacctcacccctactaggtactaaatcctgccaggtttacctctaatgagctctcaaatcatggactcagctttatgccctcatcccagctgcttcaggcctcttttggtctcttactggcgctcctccctgagacctctccccctcagcccattcacatgctgccaccacaaaggttctctgaaacacagatctgagcataccactcccctgctgtgaccattctccattgctcagaggattccaagccctctgccatctggcccaacctccactatcagatttaccttctactatagcctgagttccagttatacctcactgaggcccccattcactcacttccttgcctcagtcctccctccttctcctggcctgctaagtccttactcaacctttaaggaccagatcaactgacatctcttcttggaagatttcctctattcaagcaggcagttagttgctttctcccgcaagtcaatgatgatattgtaatgatatgctttctgctttgcctcctccccaggctgagaactcattgaaattcaggatcatgctgtccatgttgaactaccccagatactccccagccccactcagcactatgtctggcacacaggagatactcaaataaaagctgttcattttgggtaaccctcttacattagaggtaaaagccttctgcttaccagtaaggattcttaattcgctagcaagactttttctttttctaggcacagtaggtattagattaaatatggtaatcactcacttcacttctggaagcaacagcccggtgcagtggagtcagccacatgttgtccttggcatttacacgagctcctggaatcaaacagcacaagttagaggcataatggggtcaagggaagccctgccgacgttaaatcaaatgctgtatcttgctcccatttgcctgacataaccaccacctcttcttttctttgtattagtcatgtgctgacaagatttgatcaaggctgaggggaccagaagaaatctgctttacctaaaaatctgggactagccagatattttggtaaaaagaagtcagtttccatgaggcttttggatagataggacatcaggcctataaattgctcactactttctcaaactatggggtaggcagataggctcaagcatgagccaaaaccagctcacactcagaagagtgcccatgctcagctctatgaagccatgccatcatcatggaacagaagctccctgcaaatgaattcacaggaagcagagttcacccgccttccatgacaccctcgccattctccatgatcaccagcccaccaagtccatgtctgaacagctaagacatctgatataagcttccttttagggggttcagggttttgattagtcttctggtcagagatgggatgttttataaaagggctacgaaaggagaggaggagaaaatatgtgtatctttgtagaagcagcaagagaagtcaattctagccttaggatgatgaggaagggagctcatgaggacagagagtggagaaacaaatcaaagaaactagaaagtaaggcagagaaaaggaaacacagaggtggcgcctcaggacaagggctgagaaagtgagtcaaggggaagcaggagctgactaatctccaagaggctaaggccagctgatagctggaaaatagaaacttttttaaaaggcagtggacttccatgcgtaaacgtgaactagaggtttagtttaaggcactggctaaaagtaaataacaaatcatagagcttacactattcttttctttaactgaagaagaacaaatgccatcaacagcattaatcacagaaaacaagaacataatccctaaaacaaagacagctggaatgcctcccatccaacctccactttgatttcattggtttcagatggagtcaggtacaagggttatcatactatgctgtcaaagttgagagccactgatgaattgttgcttaatttatccaggttaaaattatttaaatcctaattccactaacaccagcttgcctgaaggagttcaagctccttacgtcagtaaggaccacagtaaaatcagtttgggtgtgcaaaaatcaataggcatctctggcctcagtaacaggaagctgtgggctaaatgctgtggcatgaaatgaatgcggttttggaaggacagtgggattcatggtcagaagatgtagatttgagttctgatttcagcacctgctggcccaatgaccaagagccactaatctgcacagcgaggctaacaacaacagtaataatacttctctacccatttcaccaggtgctaaggagaattaagtgaataggaaagtgctttgtaaattgcaaggcactagaaaaacattagcagttcttatttccaaatcacctccaatgtctcattcacctctaaatctatgactcagatttccaaaggaagtgaaaggcatgatctttgccctacaaaggaagaagtcaaataggaactttaagaacacaaagaaccatcacctagagactgtagaaatacatatctttttaagagcaagagagactcaagtgctagagaatgctagggagaagaaaatccagatgtgattaagaacagcaaaattggttaattttaaaataaaattaccactaccaaaaccaaacttcagatttcttcttctaaatattagttccaacacagtgtcaggtgatggtcacaaagtctacctttctggtttagcaacacagcatttatcccttcagatcttccaacactctggattcaaaccttttaaaattacccgcctttacgtcaggacttttcttgcatcataaataaatatatgtatgaccacattgtgtggtagatttgaccacactgtgtttctgtctagtaagccgagtgcacatgtatttcttattttggggctgtttctttggcacccatgtcacaaacatcactcagaccatatgcagtcctagagagctggaattatttttattatagtctttggcagagtaaattttgtgctttaaattttttgtaaattcaaaaaatgaatgcaagtagaaacccaaatgtcaagacacatatggaaaggtacttctcaaaattcgtcagggagaagcaaatgaaagcagcatttacataccatttcacatccatcaaataggtaaaaatgataaagtgtgacgaggccaagatttggcaagggtatggagcaacaggaaaacttaacatacagctggcaagagtgtgaattggtacaacctcctttgggaaacaatgtggcattatctagtaaaattgatgacatgcatgcccaaccacctagcaattccaccccaatcatataccctagagaaactctcacacatgtacatgaaggtgcaccgcaacatgtttatgtcaacaagaaactggaatcctaaatgtcaatcaagaggaaaatggataacgacgttgtggtatacccgtacaatggaattctacactgtcatggaaaggaacagactgaagttctgtatatataaacagatgtacttttaaaatcataacaccaaatgaacaaatcaagctgcagaattatacctatggcataataccagctgtatttctatatgttgtttatggatgcatagatataaaataaaagtttaaaatatggctaaggagtataaatactaattctggatagtgactgcgtctagggaaagaggaatgtgaaaaggaatgaagtaagagtacccatacagctgcaactgtattttcaatgttttatttccttaaaaatatatagatatagatatagatatagatatatatatagcaaatatggcaaaatattaagagttcctaaaacttagtggaaggtatatggatattcactatattattctccatagttttctgtatgtttgaaatattttctaacaaaatattttcaagaaagctagtgcatttgaagttttatgtttcttaatgaaaataatgggggaggggggactaagctgcttttgtgtgtgtgtgtgtgtgtgtgtgtgtgtgtgtgtgtgtgtgtgtgtgtgaaacggagtcttgctctgtcacccaggctggagtgcagtggtgcgatctcggctcactgcaacatctgcctccccagttcaagcgattctcccgcctcagcctcccaagtagctgggattacaggtacctgccatcatgcccacctaattttttttattttttagtagagacaaggttttgccattttggccagggtggtcttgaactcctgacctcaggtgatctacctgcctcaggtgcaagtatttgtctaggataaataatttaaaatggactttatgtgtcatagataatacacactttcagtttcaaaaggtcctgtaaagcctctaaagtgtgccggttcacaccctcagaatgtataagattgcttagtttccccacatcctcatcaacacttgatgttatcaggcattaaaatatattgtttaaattttttagagacagggtctcactctgtcactcaggctggagtgtagtggcattatagctcactgcagcctcagactcctgggctcaagcaatcctcctgcctcagcctccagagtagctaggactgccagcacatgccaccatgcccagctaatttttaaaaattttttgtagagatggggtcttgctatgtttctcacgctggtctcaaacttctgccctcaagtgatcctcctatttcagccttctaatgttctgggattacagatgtgagccaccatgcccagctagacattttaaatattgcaaatctgagtcaataatactgtattatgcacttaaacatttgttaagagggtagatctcatgttaagtgttctcaccacacacacatcccaaaaaaccccaaaataacaagaacaaagggacacgaggaaacttttggaggtgacagagatagacatctctgtctattaccttgattgtggtgataatttcatgggtgtttgtatatgtccaaactcatcaggttgtagacattaaatatatgcagcttattgtatatcaattatacttcaataaagctgctttaaaaatcaataggccgagcgcggtggctcatgcctgtaatcccagcacttttgggaggtcgaggtgggcagaacacctgaggtcaggagttcgaggccaacctggccaacatggtgaaaccccgtctccactaaagatacaaaaattagctgggcatgatggcaggcgcctgtaatcccagctactcaaaaggctgaggcaggagaatcgcttgaacctgggaggtggaggttgcagtgagccgagatcatgccactgccctccagcctgggcgacagagcaagactctatctcaaatacatacatacatacatacaaatctgattgaaaaaaagagcatctctttgttttagtttctggtctaacaataaggttagacatcttctaatatgtttgattactagccatttgtaattcattttctgagaattacttgttcatattctttacatatttctcccatttttctgttgttttttcttatttatatttacacacttttatcattattattattataccgcattctgaaaatttttagttttatgcagatccaaatttggctttcaatattaaaactctttcaaggagaaaaatgatcccacgcatgctgaacctcatacagtgacccacacccggggtgtaacgacaccagcattgttcgcgtgtagcttcagagtcccttgagaaatttcaaggtgattagaaatgtaggcaatggcttctttcagtcagtgtttaagtcctccattcctccatttctctttttcatggaggttgaataggcagctgccaggaaaacctcctctcccccataacaaaaattattataacaaaaccagagttatctgaatggagacgcaagaagcatttcatcagtgtcatctcttgctgccagcttcctcatcctcttcctctgaacactttcaagagtcttgtttacatgtcagagggagatgtcagatggttttggctatgaattgaatatttatagctgattttttctaaaggaagcttcacattatttacctgcctgtcaggcaccattgtgcactgaaggacacagtctgcatgtctaatgatttaaaggcaaatgcttttgtacccaaggacatgttaaagcttaaacatgaaaataagcactagggtatattgattcttcagaaacaaaggcccaatccatcagacatgatctgtaattacaaactaaggatgttcttcatcttatccctgttacctcttaattttattttcatagagatcaggggtgaagtgaactctgggcatcttttccagaggcaatatttctgttctgtaagccatgtcatctagaaagaagtagaataaagaaaacggaagtggtgtgataagggtggactgagtgtgactgaaaaatctcacaagccaaagagaataatttcttcccaagcttaacttatctaaagtttggcttttaattgttgaagtaaacatgaaaagtcataaaaatatgattataatataacaaaatcagcttgctattgatttttttaacaaaccaaatcatacagcacaggagcgcttcaaaacaattaccatagaagagggtatgataattccatgaacgtgacaattgctcaaaacatttaacaaactctccttggagttgcctttatggccaatttacacacccaccagaaaatggcttattactttataattgcaccacatttgtaggccaaaatcagcattgcctggtttaatcacccctctttcaccagataaaaaatatcaaattcatcctcaaaggacgaatatttgttatgcataaggaatcaaaagaatgatgtgcccccagctctggaaataatttgcattgagagtaagaagcacattttgaaaatttttgggaataattttgcaggactaccacttgttgggttgcataaattctatggccagatgtggtggctcatgcctgtaatcccagcacttcaagaggccaagatgggaggatcacttgaggccagaagttcgagaccagcctgatcaacctagcaagaccccatcttaaaaaagaaaaaaaaaaaagtaaattaaattaaaatttaaaaaataaattctaataaattttacttagtagttatgcctcacaaacactcccgcattagagagtacttccagttttcttctttcaacccagaaccctataatccttacttgtcctcagagttttctctgtaggatcttttttttttttttgagatggagtcttttttttattttttatttatttttttattttattattattatactttaagttttagggtacatgtgcacaatgtgcaggttagttacatatgtatacatgtgccatgctggtgtgcgacacccattaactcgtcatttagcattagatatatctcctaatgctatccctcccccctccccccaccccacaacagtccccagagtgtgatgttccccttcctgtgtccatgtgttctcactgttcaattcccacctatgagtcagaacatgcggtgtttggttttttgttcttgcaatagtttactgagaatgatgatttccaatttcatccatgtccctacaaaggacatgaacacgtcattttttatggctgcatagtattccatggtgtatatgtgccacattttcttaatccagtctatcattgttggacatttgggttggttccaagtctttgctattgtgaatagtggagatggagtcttactctgtcacccaggctggagtacagtggtgcgatctcagctcactgcaacctctgcctcccaggctcaagtgattctcctgcctcagcctcctgagtagctgggattacaggcacccaccaccacattcagctaatttttgtaattttagtagagatgggtttcatcatgttggccaggctggtcttgaactcctgacctcaagtgatcctcccacctcagcctcccaaagtgttgggattataggcttaagccaccacacctagcctttgtaagatatttctactgtggtcctttttctgtgcactctgctttctatatctcaaccccagtatcttaactcttagccactgattggttctcactgatctctctgacttaatccagattcgaccagttcccaaacagaagctagagtcaggagggaaataaagccagaccctggactggcagttgtaagaaagtgaaatttccaagggctgaattcttcgccaagaccttgtcttccctgtctgctcagaggcattcagggttctatccacctggctaacaggagataatgccagcaggaatttagcaagcttgggttacaccatgctctgtaggttaatacaacaatggagaacacagctataatgggctgttctggcaaggccgaattatttgtccaacatggtaatcattagcacctcattcattattaaattaggaaacagtttggttggattccctaaaggctcagctgccagacacaagctcagagataaaatcatcatgctcttgcaatattatgaacttaatatataaattgagtaaaggactttttgggaaaataaaagtcaagtgaattccaagagtttgcctcagcttccacaggtaaataaaattgctaaaaaagaaaactttcccaatgctccccatgccctaagtcttcttaatttgatgagagggaggaggaaattttccatagcacattgaaccaaaattatgctaaagagattaagagctcagaaattccaagaccaaacaagtgaatagattaaaatatatgcaacagcttctcccagctctactaaatcagccagagttgaagagaggctggtggattctatgcccttgtgaaggtgatgtgaaaccatgtttgtcaaacaatcactggccccagatacaagaaaaaaaagagactggttgacttcatgctgcagaattaaaatctcccctttcagatgtagaaacaacaacaacaacacaaagttggcatataagacaaagttctgaatttgtacattcatgaaacattcctctgagactctgagaggtctattaatacaacatttaagaggtgggtgggctgggcacggtggctcacacctgtaatcccagcactttgggaggccaaggcaggcggatcacaaggtcaggagatcgagactatcctggctaacatggtgaaaccccatctctactaaaaatacaaaaaattagccaggcgtggtggcacgcgcctgtggtcccagctactcggaaggctgaggcagaagaatcgcttgaacccaagaggcagaggttgcagtgagctgagatcacgccactgcactccagcctgggctacagagcaagactccgtctcaaaaataaataaataaataaataaaataaaatacaaaataaaaaagaggcgggtatagctgatggggaccaatagatgtcataccacaaagttctttattttatacctccactgattctgcctacaattttccacgggccaaattgcaattgccagggcaaccagccaggtgtgcattggcccttagtctgtgccaacaccaaacaatacacatttgtttggaacatggccctgggacatctttagatttgttggaagaaaggcctattctcaaaagcacaagaaatgccatgtgaaatctaacctaagctccatgtgaccatcaggagcgtggggcacacgtgttttgaggcacagaacacttgtttcctggggaaacccacctcaagaacatgaacacaacaaaataagggccgtgttgcttatgcatcacagcacaattcttgtttcttgtccacagtgttcaccacatctgcttgaatgcatgtctcagctcctacctctgcagagcttactttaagatgctacagttcccctttccttactgcaaacaaaggcgaaaacttactataggccttttgactagtctgtaggcagtggcacttcctctagatgttaatctcccaaacataaaagaggaagaagaaagacagcttgtctgtgaataatctacagtgagacatctgcacatgctcaattcattccaggatttgtctagtaaacactcaagggagaaagcatataatggttttggaaacctgtttggtgagatatactgagcatacaggtttccaaaaattaaaccactggcatttttaaatctgatgaaatatttaaaatacattgaaaaataaagacaatagcatcacaaagaccagtataaacacaaatcagatttaaatgtttgctatactcccttctaaatttttaaacataaaatattttacagagagttgtagtagttcttttatagccttccctgaagacattttttacttaacctgcctacttagaggtaaccactaaccagaaatcaatatggttccttgccttccatgtttttatgctttcatcacatagtcacagtcatgtatccataagtataacagtattgttttgcagcccaacttaaatatatataaatatacaaacacatttagttggcatataaatctagggtgtgcatatatatatggcatatatacagtgtgcatatataatagcatatatagtgtatacatgctatacatagtgtttatatagcatgtatatatagagagagagtatatagtgtatacatgctatacatagtgtttatgtagcatgtttatgtagtgtgtatatatactcactatacatagtgtgtatatatactcactatacatagtgtgtataggtgtatgttcatgtagactttaaactagttttatttccttttgtataataaaaaaatcaaaatatatccaaatgtactgaattcatctacaatgctgggcctgactagacagccaggaatcagactttcaaagcaagataaaaatgttactggagaagtcatttttcaataagaacaacttcttgcatttttctttgtgtaatgataaaatcgcctatcacataaacttccatgaacataacaaaggaattttgcttgggttcactgtagtagtcaatctagtaaattggttatttaaatttttatttgcaattgacttttgagtatagcagttatttacctgacaaaatcaggagttcaatgatctctgcatctcccagaaatgcggccacatgaagaggggttcgtttctcagaatcctgaaatacacaacgtcaaagacatacaacaggtcagtggcagctggaggtcccttttgtagacatagtaagacgtgtcactcactctgtggttaatgcatgtggaagagtgtgaacaccaaacattcgagtaacttctggttatgcattttctctcaacataccctatagttacacataacaaagcattccattttctgtgtctgtgcttggtatttgcccacttgctgcttttactgaagcccagctgaggtcatagatggatcattatgccctggatgatgaatttcaacttacagtatttccaaaccttcaggatggttaaaaaaaaaaaaaaaaaatctaacctaccatagcaatatagttcaaagctttcaatgacttattttctttctaaggaaacatagtggaatggttcacaaggacattaaacattaaacataactgtggtcattttctcctttctatgcttgttaattgttgtttggaccactgcccattcatgaaatacttactgaatgcttactctatgccagaaaccatattctggggacagagggatgactacaacaggcctggtccctgccctcatgaaactcacattcaagtgggaaggctgacaatagtatactagacaatagtatactagatacacatgagattatttcagataaaacaccgtatgggattaagtgattcaggagatgggaataagagtggtcagtgaggcctttctgagaatgttgacattaaggctgagagctaaggttgatattatctctgttttatagataagaagactgtagctcaaattttaaaatttcctcaagattccacaggtatatagcacagtcaagatctgaccttcacccagcagacttcagtctgtatctttggcaaggcattgaacagattgtgctgaaaggcagcatggtaacatgcaagggaaaaaagcgttgcttcctcatctgtaaattggcgataataaaatctaccttagaggactgataagaggactaaagatcatataagtaaataaagccctaggcaagcaggagataagtgcacagcagtgctccatacgaagcccattattgtcattggcatagagagttgtgtgatatctttcctccaaagactgaaaacttcctggagtaaagaaccggcctcactcttctttatccccatagtagcagcatacttggtgctcagcataaattggctgaactaactagtctacacgtatggtttcttccactaacttctattgactcctccatagcaatggtaaccaaagcccatctgctatgtctttaaggtttctcctaaaactagcatgtatgttagtttcaagtttcttggattcgctgttgattttaatcattattcctttcataatttgattatataatacatctaacaacccttgattagcccaaggatattattccattttctgacagtccagaccctctgctcttcctctgtctctcacagattattgcttttagacatttcatgactcactaatatctaaaacagatggcaggcaggggacacaacaagaattgatcttcaaaccagtctattttttagaaagtctggtaagtaggttttataaagaatgcactaccattaagtagacaaaaaggagtttggattcactggaaactcatgttgtctatgtatggctgcaggcaattactatggaaaagtgaaaatagggcagtcatgcaactataaaataatggcatgcattggaaaattcagtacgatatatgactacaatcaaccttgttatagatatatcaccctatctttgaaaataaagattcagtatttgaaatcatgttagcttatttgagaatcaagtgtattaatttgtgcaatgaactatataagctgagaacagattttcacaaatgttttctatttctattgataaccctagatgcattttccattttagcctcatgttccctttgaatcctcgctatatctacttaaaattttctactgggatttttggataaaagctatgtaattacatgttcttttgtgaactgaattggtttcagggtttggttcaacaaattaaaccctgcctaagtgatttaaacagggactattccaacccaaattatgacttcatttgacctgaagcaaaggcaactctatttgagatcttggcctcaaataaaaagctaagaaaactccaacatccctccctaccttgcaaatctggttggcctgtcatgatatgactggttttgctgattctgtggccccttttatggcacagcttgttcaaaccaaagtttctataacataaaaagggtgtgttgcatgaatactgtaaaaattcttgatgatgaatcccagtgttcctgttaatatgtgcttaaaggtttctggtagtttccagaataactatgcgaattgatactctcctttagtgacatggcacagacaggtaactgcagagaagacttgtattcaggcagtactcctttagttctccaaagcagcagaaccacagaaacaatcacaagtgctattaagaccttaaccaacataatagtgcatttccactattgaccaagggttgctaacgtcttctcttctaacaaggaacacctgatcatgagtcaaagcgtgaatgaccgagccacagtaatcaccatgctggatagagagaaatcagccaggaggtagcactatgtcctctgcctaggtagaaggccactctactttgccataagctaaactaatggaataggagatggaatagaaggagggcgaaggttctggagaaaagagaatagtagtaataatactggttaaaatgggttctagcccaatgacatccttagggtgtctagaagaagaaacaaatctagctggttattatgaagtgcttttatttttattttttccaaatatctgctcaactattctactactccatctcaaaacattcctatcagaggagtcacaccttttacaactgtgttcttcagtcttattatcaccatttaaaagataaagaatctgagcctaggacagtttgtatgacttaacccaacgcagcaaactgatgccaaagaattaggtgtcctggctcccaacctgaaacttttttctttataaaaatgaaagtgggctgggcacggtggctcacacctgtaatcccagcactttgggaggctgaggtgggcggatcacaagttcaggagattgagaccatcctggctaacacggtgaaaccccatttctacaaaaaaatacaaaaaattagccgggcatggtggagggcgcctgtagtcccagctacttgggaggctgaggcaggagaatggcatgaacccgggaggcggagcttgcagtgagccaagatcgcgccactgcactctagcctgggtgacagagcgagactccatctcaaaaaaaagaaaaaaaatgaaagcaagagcatcttagaagttcatgtgatagtctaaaaacccttctactatgatccctaagaaatcaggaggaaaatgtgacgaacatacggtaaacatcattttaaatgaactgagaagaaattaaatagaaaggggtcagaaatggagggtaaatagagaaccaaagccgcaggcacatgaacttagagtgcagggataggtcaatacaccaggggcttggggcttaacacttgcaggcagtgagagataaggcagagaactagaactgcgacctccaagcaaagaaagacccttgaagtggccttgaagaaagactcctgaggtgaaatagtggacttggaaaaaaacaatgacaaacactcacgtaggcagatggcaaagagatgccttgtcccgggttcttggtaggggaataaaaatgtttccactgagcattcacatccccagagtctgccctcatgtggtttagagctttgaattcacattgcctgtatagtctgggaatttacttttttttttttaatccaggaactttcaagttgaaaatatgcaaaaaaaaaaaaaaaaatgggttttagaccaatgatacccctaaggtccctagaagaagaaacaaaacctagctggatagatatgccctcaatccagtcaacctgggacacccacagattaaatctccattgaaaatgaactcacaagcctaagccataagactcacgtggaaacgttcaccataagcaagagtcagcagactgaagaaccagcaagaatttgagatcacagaagaatgagatggagaacagggatgacatttaaaataacttaagacacaaaggacaaagcataagggggaacacccccactatttttgaaaaacaaacaaaatttggaggaagagataatgaagcaagtattatggaaagcagtaccaaaacatgatgctagacagcatctaaaattttggtctaagagggatcaaactcaaagaataaaaaaagaaaggggaggagaaaggaaaaataagcacaggaactttgggctacgttttacaatcatttattcagccatattatctagacatagatatttatttagaatctattatatgccagacattgtggtacacattagggatacaaaatttaaaatatctagccctctaaccctaaagaaacttgcagtccactgatcagtttctaaatgtaggatattagaataaaaacaatagcagggaagtggcaaatagtgatatccatgatgttaaatgatttgtgaacgtatcaaatgcaataagacaaaaatatcttggtgaatacttcccccaaacccatccatatccgaactggcctgtgcagtaagtctcaactgccaagaaaaaaaaaaatctcttctgaattgggaattaaacacatcttgcccaggactccctaaaggtcctattggctccagcttatctgggaatcttggaagccctcaagggccagccttctgggtcagttagtgagcctagcctctatcttacaggctggctcaggggtagttcctggatcaaaattggaatccagtaccaggacaggaccagagcagcattaacctatagtggccgagctaagtgcattatttgcattcatttccatcttttgcccaagtggactctctgtgatgaccaatagttgaatagttacataggcttttataacacccatgaatataagtggggaaaataacccaaaagcaggtgcagcaagattaacacacactgaaatggctcatcagcatagtttttaaagattgtccaaacatcacaaaaaggaaggtcttttttcatcacccagtagctctaattccacatagtcctttgcagacagattcagatgcatgagaaatgagaagacccaggttcctccagaaggaaggatggtaaaccctcccattctacgaatagccaaagatacacacagccagcaggggtctgagctaaatttgcagtatgtctcagagagatcaggcagaggaagttgagctgtctgtttaccaaagaagaagcagataaaagaaaatagggaacttgaagtaggtacatgcaaagtgagtttgacatgggcagagaggccattctggtagctaaaaatactgtgtagacaggcagactgaggggcaccctacgcctgttttgaagattaagaattgttacatgctttggaaattctcagctagaagtacatgatctaatctgcattctaagtaactgtcatacaccaaaacaaacattccaccctgtatatgaatatcttacataccaagacagaaagatggagcaatattaagaaaacaagcctatgaaatacagaagttaagtttgggccggacgtggtggctcatgcatgcaatccctgcacttcgggaggctgaggcagatggatggcttaagcccaggaaattgagaccaggagacctcgtctctattaaaagtaatttttttaaatcagctgggcgtggtagcatgtgcctgtggtcccagatacttgggaggctgaggtgggaggattgcttgagcccagaaggtcaagaggtcaaggctgcagtgaactgtgatcacaccattgcactccactgcaccatcttgctctgggtgacagagcaagaccctgccaaaaaaaaaaaaaaaaaaaaaagaagaaacaagaagaagaggaagaagaggaagaggaagaaggaggaggaggaggagggttccaattatcaatccaaacttccaaattcccactaaaattaaagaagctgggagataactgacaacctaggcccaactaccttaatgtgatattgaacagagatcactagaggcaagaagatgtctaaagaaactctgaacacatacacacaacaggtacctcggaagtatttcaaattacatgaggacaggagccaaacgacacaaaatgggaagaatgcttggccttaaggtggggaattaaaagaaggttaaagaagaaaggaaagagaaagacagaaaacaaatgccatgcttcttttgaaatttttcatgtttactttcaatttttaacatctcataaatacacagaaatacagaaagtaatagtcccatatgtgcccaccagcaaaaacaaacatgttaacatttttctatgtctccttcagaactctagtttaaaaaaatacttttagggataaaagtgccatcttcagaaatgcaaatggttctgaaaataatttgaagtatgtgtttgcatgtgtgtgtttgtgtgtataagagagaaaggtggggaagggagagagagagagaaagtgggaaggaggaaagggattaggttgtttttaattcttcaaaccactattaaaaatggtgttgcagtgtacacctttgtacatgtctgtctgtgcatacatgtgagaatttctctgaagtagatacccaaaaaaggaagcactggattagggtacacacacacattcaattgtattaggtatccctaaataacttccaaagtattaatagttttactaatttacactcccaccagttacattttagttccttttcctaacatcctcgccaatatctgatgctatcggctttctttttttttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgctaccacgcccggctaattttttgtatttttagtagagacggggtttcaccatgttagccaggatggtctcgatctcctgacctcgtgatccgcccgcctcggcctcccaaagtgctgggattacaggcgtgagccaccgcgcccggccactatcggctttcttactccttgccagtatgttatgcctgacatggtacattctggttttttcaactgcgaactgcctatatgtatctttacctattgttaaatttggttattagtcttttccttgtgtgtggagttttttatattgtttaattcaactttcaatgaaaattcaagttatgtattcacctagacacaacagaaatgaatcaatgttttccccaagttaccataagagaaaaatttagatttacagtccttattcatccctaatgcatgcattgtctcataaagctgaattttccttgtgtggagcctcccatgcctcaaaggtgacagcaaatctctgtcccaacatgctcccaccaccacacaattgtattcaaccatcacactctgctggtattgtaacccattcatttgaatgtaacatggatatatatttctcatatagaaaatatagatatattttctatctctaaacatgttcaaattatgttatactctcaatatgatatctaactcctgaaacgaagaatcacgcacaagaattaaaatgatgataaaataagaaaaataagaatgccaaagacatttttattttatctcccttacataactagacactggatattttattgcactaatttctaaaaatcaaataatgtatattgagcaaaacttgtatcagagagtttatattttcaaatttgatccttaaaacaatactgtgaagtaaatatgagcatccccatttcactgttgaggaacctgagattttgaggtgatgagtaacttgtccagagtcacaaagctagtaagtggtaaaaccaagattcaaaaccagatctgattccattgttcacgctcttgctggcttttggatggttacaagccttggtaaatacaatgaaagttattctccattataattagcatgcttgccctaaatactctagacccaagggcaaaaggcttgtatgtaaaaaagtacaagcaggcaagaagaataaaattggagaactaacattacctgatttcagagcttattataaagttacagtaatcaaaacaatatggtattggtgcaaagaaaactctggtgaaagaatagccttgtcaacaaatggtcctagaacaatgagatattaaactttgggccataccttgaaccctaaacaaaaattaaatcaaaatggatcacagaactaaatgtaaaacttaaaattataaaatatctaaaggaaacataggcaagatcttttcaccttgggttaagcaaagatttcttagatatgacatcagagcaaaacccataaaaggataaattggtaaatggaattttatcaaaatgaataatgtccactctttgaaacacactggtaagagaatgaagataagccacagactgggggaacatatttgtaaagcatatattggataaaggacttctatctagaacctacaaaacaactctcaataactatgaaagcaaacaatccaattaaaaagtaggcaaaagatttgaacagatatttcaccaaagatatacagatagcaaataagcatataaaacaatgctcaccgggccgggcgtggtggctcacacctgtaatcccatcactttgggaggccaaggcgggcggatcacgaggtcaggagatcaagatcatcctggctaacatggtgaaaccccgtctctaccaaaaatacaaaaaattagccgggcgtggtgtcaggcacctgtagtcccagctactcaggaggctgaggcaggagaatggagtgaacccgggaggcggagcttgcagcgagtggagattgcaccactgcactccatcctgggcgacagagcgagactccgtctcaaaaaaaaaaaaacagtgcccaccgtcattagtcattagagaaaggcaaattaaagccatattacatacttattaaaattgctaaaattaaaaggactaatgataccaagtgttggtgaagatgtggaggaactataacattcaggcactgctagtaggagtgggaaatgatatagtcactttgaaaaacagtttggcaatttcttaaaaacttaaacatacaactaccatataagctaggtatcgtacccttgggtatttactggaaagaaatgaaagcatatgtccatacagagacttgcacatgagtattcctaacagctttatttgtaataccaaaaactagaagtaatccaagtttccatcaaaagatgaatggacaaacttatttccacataatggaacactactcagcaattaaaaggaatgaactatggatatatgtcacaacatggatgaatcaaaataattgtgtgagtgaaacaagtcgggcaaaaaaaaagtacatattgtataaatccacgtacataaaattctagaaaatgcaaactaatacacagtgacagaaagcagatcagcagttgcctgacgggcctaagggagagactgggaggggtagcagggagggatttgaaaggggaacaaggaagcttttggagcactgtatatgttcattatctcaatcatggtaatggtttcatatgtcaaaacttcgcaaactgtacactttaaatatgggtagtttattgtatgtcaattatatttcaattaagcggtttcataaatacataagcaggcaaataaaacacattctcactcttacgtaaagtaaaaaaaggcatatttaaaagttaaaaatacccctaagcaacaaaatttattcagttaatagaagaaaagaaatagcaaaatcgaattaaccaatagtgggttaatttagaggcagctcatgttatgccctggttatgtgtggatgtaaaagtgaagttcttacaaaagaatggcctgttggcttaaaatctacaggctttaaaaataggcacaaccagccaggcgcagtggctcacgcctgtaatcccagcattttgggaggccaaggtaggtggatcacctgaggtcaggagttcgagaccagcctggccaacatggtgaaactccctctctactaaaaatacaaaaaaaactagcctggcgtggtggcacacacctgtaatcccagctactcaggaggctgaggcaggagaattgcttgagcccaagaggcagaggttgcagtgagctgagatcgtgccactgcactccagcctggccgacagagtgagactctgtcaaaaaaaaaaaaaaaaaaaaaaggtacaaccaagattcctcttcaaaatctcttaggttattttgtttcctaaatgaaacctttgacaaatgtgtactgagtaaggatgtagaaaataaatctagaaaattaagtacaagtgggaaggtaaatggtttatgcctaacctttgaatacactgcaacatggcagcactggattgacatagaacccttgggatcttaccactgtgcccagacattcccaagtgacagaagcccttttaaagggtctctgctggggaaagttgataaagtaccaactatttgtaaggccctgatatcacttggccaggaatatttcttgagagccagtggaaacagaacatgggaaagggttctggtccttaagtcccacagaatgaaaaactggccaagacgctgtgctttggtgccagcgaaacaggaatatacaaccacccactgccaagataatcatcaggagcttctgatgaaaaccgaagcaggtcttcggagtaccaccttccccgacagcctaaaagctaataaagttcacaattgttctatgcatgaccccaagcatattaagaaggagtgtctttaaacttaacgcatttgttgaaaagttttccattccgttcttgaacacatggtgggaatgttttactgctaagtgtatttaaggaaacccacagattggaactgctctaaccagtgaggcgagaagtctagtttcagttacggccccaccacaggctcactgtctcttttaattaattcattaaccaatttattaaacaaacatagattaatgagaggcagataactaaaagaataacataatcatctgggaaactatctcctattgatgaaagggtaaaaagaaggcagctgctagtttttcaccactgtaaggggctagcaatggtgaaagtttgtcatcagataaatgaacacacagtgtcaggatcaaaatcacaggagaggaagctagaattacaaaatatttaaacttaacctggaagggcatcagagacatccggagagtttaatcgattggctgaaggtcacacagctcttgatggcaatggtggaatctttcattcatacaatagacaaaaacatttactggggatccaccatacgccaagcaccgtgctcagacctgaagatgcagcagccttcaagggacagggtccctgcctttatgacgcctgaaagaatcttgctttcttgactccaggcaggggacattctattacagtagactaatgctagattaaacacacccatcagcaaagagcaaacaaacacacacacacacacacacacatacacacacatacacacggtattagaaaaagttaaacagaaagaaactgtgcaatgaaaggagatgctcaaaggcatctgctctggatataacaataactcctagctatggggttcccccttcttcctttccactccctggaattaaaagcaaaagcttatatatagaacagtttctgtggtccacagaaaaccattttaacagaaatgattagtagttctttccaagtttttttcaacctccaggtggatattttagaaacagagcttatgtgtaatactcacaataaaaatcaacaatgcagttttctggccgaagatatcagatcagcacaagacactaagatgttaacactaattatctctgggtgaataattttatgggcattcctcactttctactttgtttgactgtgtttcaagacttgcagtttacaaacaagaaaataaaattcctcttgtaaataataaaagactttcctattaaaaaaatacaggtctgctctagcaaaagcttttcttaagtaatcacaaatagtaaagcactggacattatttcctgtccaaagacttcaataccttgtagtaggttctgaataattgatatgtgagtgtgtttctttgaaaacgacaaaacattacatttatgattaaacatggcaaaattgtaatttgtctaatgattcataaagttgccaagtactgttctatacagtgcatcagctgattcttaagaaaatccagacagactgatcaagtatgtattattgtcctcattttacaggacaggaattaaggttgactcagagttaagtgactcacccaaagtcacacaccaatatttggtgaccctggatttcctgactccacatccgctgctctctcaacaccactaggtaaggcattaactaaccattaagaattcctctctaagaaagaacctgcttcatcctcctcacagcattttggaggcctttggttctacccaaatcttcctttcttatctaatctttcttatcaggtggcctatatgatagacacacacacacacatacacacatgcacacgcacacacatacgcatgcactttcattataaaaaaacaaactctggagtcagaatgacccaactttgaatccctcctctgccacgtatgagctgtgtgactttgagtaaataaatcaacctgattactcatttttctttttcattctaaaatgaaaaataggattacctacatgcaggcacagattagatgtccaataaatattagctcctcttactactattatcaatgacatctctgtggcttatcccaatttttttagttctccttgatgactatagaggaaaataaggagatgcagacagatcctggggggaacaagtttactggcaagaagttatatttgtttacaagtagaagcatttactctgcccacagccagccaatagcagtgcttgcctgcctcctctcccctccatgaagtagtcaaccattgcatcttgtatcctggccattgtagcctgtcctatcccaacccaaaggtaactgaagcctctctcatactctagagtcgggccttccattctttatccttaatctcataggacctgcagcagtctcttcccctggtagaatcccctaaaacacctatatatcagcgactctcactccctgctcagaatatatccctgctgccctgaaggcctcctttcccatccagtctcaatatctgagcagagtcagatctggttaaaactggacagatgggagcttccctgggggtttggatgttgtaccctttctctcctcacccaaagctgaaaaccttcaaataagtcaaccccaagccagaacatcctcaccaaatctttctgacacttgtcaggaaaattctgcaggccaagactcctatgttatcaatagaagccccttcttagtaacttaattagaagtaaatccaccacagactcattacaggtcctcaggcagataaccagggggtcgctttctgtatcaacaaaaaaaaggaagtattcttctatgccctttctaaattgagccagtgggacagaaaaccgaacacactacaaagattcctaatggagtattctgcttagtgaggctagacctcaaaatggcaggcttcgaagccccttcattacagattgacacgagtgctcccagaattgggagatggctacgtaacagcacttttcgaagataaggcatatgggagatgcatctctacctccagggcaatgtcaaataaacctacacatacttgagcacacccagcaaaaaaacggtcactagggatgcatttagccttcataaacttgggctgtagggggtgtttttcccttttaaagggaaaaatttaaagtttaaagcaactttaaattgctttgtatttcaggactaactagtattttttcacatgggctaagaggccctagaatccacacttgaaaaaccttgcctctgagagaatcaagaatgcaagaatagagtcttctcctacaaaaatctcaaatactcatatactcaacaccagagaggacacagggatattgcattccatggatggattaaacactaatatatatttggatggtttgcttgcttgcaattactatcttttctctgttgtgtttatgtgttcatggaagtgaataatttttaatttaaatgtatcttgcttaccatatgtatttctgaaagtggtctacatatcaaattgtgaaaaactgattattttttccattgaattataaaataatgactagaggacacggggttcaatcagctgaggatcctggggcatcacctcatgtctactctagattggaaatctttgtgtctctctctgggcaatctgacctcaagatggaacagatccaggcatatctctctagcacatcagacttccacttcctctagatagggaaagttagctcacaccatgctacggtctcgtgacttggagggtctgctcctctatcacctaccttctttccaccagcccctagtcactggcgtgcttcatactcagtcttgaaatccccagaagaccccattactattcgtgatccatctggctaaatgccttagcccacagtgtgttctggtatgtggcattttcctctctatagtcctcaagtcaatgctaatcttagatcactccccaacttcacccccaagatgatatgcttatgttttaagcacagctgttccaacatgattttctcttcccaccctaaatgtgacaagacattgaggcttcattccctgaatgccactgaacaaagccaacagagctctatgacctttggtctacctcttatgaaccgttttatttctaagaattggtatttcctcctctatgaacctgatgagctccttctaccttcttcccaccaaagccaagactgctggcagtggtgcattcctgtccaaaaggcgagtctcagacggaaatgtagaagtgtgatgctttgaaatacggcacaaaacaactccctcttgagaaccaaggacattagacataaggacaatgttttattttaaagccacaaaacagggagcctctaatttaagatttttgggtcactcgaaagtcttttcacactgagctcaagtgtcctttcctctgaaacctcttctggttctccaccctgcatcccctcctccatgctataggcttctggacagtaccatcacatctaactgcctgctttcctttttctgcctgcccctaactgggctatgggtacagggcagaaacagtcttattcatctctgtatcaacctaacaacacatctggcatacagtcagtgctcaatatatgtcttgcaggaatagaaagaagtcttaatgcatcttaaactttttatcaaagcctatgccacaataagaaaagggtctgcctatatgagggcggcctgcaggtttctgtggtgagacagagaaccggttgtctactagggtctggatggaatcaatggcttggttttttttgtggttctcatctatccctaaccttgagtgaagatagcaaccacctcagtccatcacaggcagggcttggccttgtttcaaagctgtttgaccatctcagaaccctcagcccttcaggcttcctatcaattctgttgttctaaattagagccatgacttgaacctgacttacccagtgggtgagaaaaacaggcttgctaaggtggtacctagaagctatgaggctgggttagcattccacagcaacgatgctcacctgtgtcccctcctatgagggctgcctgctgtgcagttctggtttctgtgagacctcaacctgcaataatccttagagagtgacactatgtccacaaccagtcccacagtgccagttcctgggaggccaagtggcttgttgaataggaaaccagcactgagttttttaaagatgtgggacatttacttagtagtctctggctagccccaacatgcgcatgaaaaaattagaggctcccattagaatgaaactactggtgtggaacatttccaggcgtaggaaatctagatgttggaacagtcatggaaagtggaagaagtgggctggtgatctttaacaggccagggcaggcccagtgctgggagggaggactggggagcagaaggttaacaccaggctggagtgcagtggctcactgcaacctccacctcctgggttcaagcgattctcctacctcaggctcccgagtagctgggactacaagcgcacgacaccacgtccagctaatttttgtatattcagtacagacgggttttcaccatgctgggcaggctagcctggaactcctgacttcaggtaatccgcccgcctcggccctccaaagtgctagaattacaggcatgaagctccgcgcccggccaccactatttcttaaaaggtgagggtttaagagattacagtgggggagtggatccatccgagtgcttcagaaagtacaaaaagaaaaggaagccgggtcacgtggagtccttactcttctcaatccctcaagaatttcccagaaggatggactttcctaagaggctgcggtgtgctgcaggcccagtcctggtccagccctgtcgctgggctagaaccagagttggtggggaagttccattcccggggagcgaggctcctttattcccacctggctgagtgggggctttctacattcctcgggtcccgggaggcctggcctctgacaccgccggctgcgtctgggtagcaagaccccttggtgcctgcggttcttgacccctctctggcagcacaaggtcaaaggtgtggggaggggcgggaggcgcagctgcggggtccctggagttccctggcggggcctggtagcggaagacctttccctctgaggcgcccctctgttctctgggggcggccacactgtggggtcgggcaggtcgcacccttcccccagctgaagagcagcgctcagaagagcccttcccccaccgcagcggctcctgggtgggaaagaaacaaaggccggcttcgcggccgctcggagccgggagcatgcgcggtgagccccctcccctgctgctgcggggttcccgcgccccaacccctgccccggacctcaggtcgctggcccctcctgccccggacgtccgctttctcgccaccaggcctccgctcatttgggcctgccgcctcctcatcttctgcagcccaaccctcagcctcctccatgcattcccagcaatgcctctcagaagtagttgtcccttcctctgtgttccctgggttttgagggttttttttttccatttagtttattctaccttggtttttagccatctctgaggatggcagtacatcctagtgggccctggaggcggaagaactgggttcaaaccctgccccctgccacttggagccatataaccttaggcaagttactagatcctcctctaaactactgtttatttgtctgtaaaatggggctaatagaatcattctccctacctcctgaagatgtgtgagatggaatgaaatgatgcttagaaagcatttggcacagttcctatcacatggttagcactcagcaaatgttgccggttaggatttaacccatgttttcaccctttcctcaacacgccccttctggctggctggctgaattcgaaagactgagcaaattccagagtaaacaagatggcaccatcggaacaagaggaaggagaatatgtccaagggccaggtaaacatgctctctaacaggtcccatgactggagatgctcaggatcagaggaacaaaatggaacgtgccagactccgtgggaggtgtcacctgacagaggagctgaccggacaagccttcatctttagtgaacaaaatctaatccttggcacagccacttgtaatttctggggtgacagaaaggtcgagtgagcacgaccacagtgagtgggtcacaagaagtgtctctgatctcaggttacctgtgatcaagtacctgtaagcagctaggaatagtgattgggaaccagaaggccaaatgtaagaggcactcagcactagagatgctcagaaaatgctgttccatgtctagaagatgatggataagttagtcaactgctggagttttcctgggagcaaacaccataaaatacaatttgtggaagcattactgatgagatatgatgctggcatatatagcatcaggaaccatttaccctaagacctaagcaatgaaagaaatgtttaatagtaactatgagcatctattggtacgtgatagcttttaaacttggacttcttttagttcaaaatcatttatatagtgataatgtaaatgatttgactcattttatgacatgaacagaaggattttctaataatttttacaatgaacatagagattccaggcaagtttagacaaaaagacatgacactgttcttgccttaagttcatactttagtagagggaacaaacataactttgtaagttccaatatcctgttttaatctataccaaagcttaaaagttgaaccctaaatctgcctgcagattttgcttgactgttacagaggtttgtaaaatctaaagtggaatatctttattggggtatgaatggtccagttcagtacaacccccaccactccctaacaccttctttacacaatggcactgcctcctggattctgaaagcttttgagttggcaagcaggatctgtacttttctttctaagtatgcttatgcctttggccaaaagcaacacaatttggacccaataaactgcaatccaaagacgtgctctgaaggacatgtaatgccataaactgttatgggcagcttttgagagccaagcattgtgataggttctagggatacaaagatgaatgagtaaggatccctgttctataagcacttaagatacttaaatgacaaaggcaccaaatgaaagcgaggaatattgaaaagaggatgttatgtgataaggatatggctacagaatttaaagtttgctgattctagacaaaaagtaaattctttagaaagaaatattcctagaacagagaagaagaatcactgacaatgattgttttaaacatatgccagaacctgctataagcatttttcatggattatgctcagaatgggatatccccattttacagatgaggaaatagaggcacggagagattaattacctaacccaaggtcatataacagctggtagacagcagagccacacttggaaccaggcactctggccaccaatgctcacactcttagccactattctatgctgtatcctagaataacctatcgctaggctatattgacttcttgcaaataccatttaggaaccaaatattttcttttcaagataaatcaagtcaattcttatgtgatatatagtgtcctgagagaaattactttgtccaagaataaaagcataacatcataagtgacaggtctagtttttaagctaatagaaattaatatatgtggtatttttgtttataaatcagtctgagtttatactgtgtgaatcattttcccaaattccagtcactcttgcactgtgctgagaaaaatcaagcctcctcaggtgatgtgtatgcacatcaaagtttgaaaagcattagctataaggtagaaataagacatttgcctttcagcagcgcctgccaccaatcagccaaaagaaaaaaaaaaagtctttttgaacacatacatttttattctttcataaacttcatatacatgccactatattatcatatttaatatgcaataagatacacataaaatatacattttaattttttaaaaacagattgaagtagatatttcattgcccccagtggatcatctggcacacttcctaagatgcctatattcccctttttggaatctacataccttacatcaaggatcttatctaagagctagaccatctatcttagatgggtatcttccaatcatcgaagacttcccagaacccaaatcaagaataatttctacagttaaagaaaatactgtgtattgttactttgtcaatgaagcccaccagaatgcatctaagagcaggggttttgggaaatctacatccaggtgatgtttttaaatagttcaagaccattcttctatgtcttaatttacaaacattctctaataagcatgaactatacttggttgcttcacctcccgtggctgggcatgtggaagaaactgaaaaaatacttgttaactgcatgactgtcttccagccaaagtgatgatctttgtcatctggtttcatgcaaaacatgcagattttcccctttaccatactcttcttccctaagagtgagactatcccagaggcagcatgttgagcagagccatctctttttatctagcattctattgggcagaacatgaatttagctacctgtaacatataattcagagattcaagagttttgcaaaaatgacttgtctttggagccttgagccgccctgtcacaagttcaacaaccttgtggctgccttgctgaactgaagccctggccacatggaaaggccacatagaagtgttcaggctgacagccagcatcagccaccggacatgtgagtgaagtcacctctagatgattccagcccccatctgtcaagtcaccccagctgacaagtctttccacagaacagagaaaagctatcccactgtgcctgttggaattcttaacccacaaaatccatgagcatcatcaattggctgttttatgccactaaactttggggtggtttttatactgcaatagtaaaagtctctgtgagattctgaagtgctctctgaattattatagaaagacaacattatgtttagtgttaaatggccttatttattttcaaactcagggtaaccaggcagtcattgattattaaaatatacaggggactctaacaacaagatttattaaaccccatcatcatttcctttgtgtaccagcaaacagccaattactacatgtgcagaataatggtggcaattgtcactttgctgtcccctgcgaagcaactctttagttctgtctcctctctcagaaatgaattgctccttctcctcctctagctcttccccttcttctccctattgctcaggctgggaactcaggactcatttttagatgctctctcttccttgcccctcacattgaatccatcatcaaatcctgagtggtctaccttcatgacacacttggaagcaatctgcagctctccccatgtagaggttagaagtaccgtaatccatgtgagtggcgccccctagagctcatgagtacatggcgtcatggccactgcaaacaccctacttcaggcacatcatttctgccctgaccccaactatggtcttcctgctgctctcacagcttctactctccctgtcacaatctgtaattcacacaacacccagagtgactttccaaaatattctccagaacattgtgcacctaagtggaatccaaactcctcgctcagctctgatgaccggcccctttcttgtctcctctccaacttccttttctaccaccttccccctccttcactctccttcagccacactggccttaattttcttctgggaagttgcactctctcccctaaccctccttggggcctttgctcctgtctttatccagcctgaaacattccccccaatcttctcatggcccccaatttctcatggccagtctcagcttaaatgtcactgccacctcaagagacctttcctaactaccttttgttagtatcatagcacacttggctttcttcatagcagtcttctcagtttataagtacctattcattcatttcctttacctgtttacttcctttctctccaatacactgtaaactcctgatgcaaggaccaggcctgtgtccaccactaatacaaccccagcacctgtcatggtgcctgacacatagcagattctgtcagtatatgttgagtgaataaatttacttgcatactatgtagcagtggattgtgataccctactccactcccacctccagaacatctgttttcctcccagttgaccacggaccaatggttctcaaagtgcagtccccaaccagcagcatcagcatcaccggaacttactagaaatgcagattctcaggccccaccctggacctcccaaatcagaagctctgagggtaaagcccatcaatctgtattttaacaagccttccaggattctgatacacactcaagttagagaaccactgccacagactattccagagactctaattctagagcagtatgtctcgaggtatattccactggctctgagggatcatcccagctgttaaaaattttttaaaaaaaagagggaggaggccaggtacgtggttcatgcctgtaatccaagcactttggcaggccatggctgatggatctcttgagtccaggagttcaagactagcctgggcaacatggcaaaaccccatctctacaaaaaatacaaaaattagctgggcatggtggtgtgtgcctgtagtcccagctacctggggggctgaggtgagaggtttgtaggaaccgaggaagttgaggctgcagtgagccatgattattccactgcactccagcctgggcgatagaacaagaccctgtttccaaaaaaaaaaaaaaaaaaaaaaaactgggaggcattcaaagccaaatgacattgagaaacacggtgttcaagaaagttaaacagattcccttatggcaggaattctcagaacctttaatatgacagttaccttgtaaatcactaaaatacaaggaaatttgtggtagaagtgcttcccaagtttacttggccacaaaactccctttctttccctcctaaacacttgtcagacttgttctggactctgagaaacacactttggaaaatgctgtcataatgtagtcttccctagagaaaatctttctaacaccattccaattcattgtgcctagagcaatattaataatgactgagtcactggcagcaacttctttaagctttgtgcatctttatctttcttagacttgaaaataaatgcttaatgctaaacacattttcatatgtctttttaatatcagtaaaaagatcagatttttgttaaagtctgaaatgttcatgaaggcaaatatggaagggtagaaactggtggcaatttcaagttgaattaaaatgagatgcagagtttagagtctctttcctgtattagagtaggcagcagtgagattctctatttaaattgtgaaagtttctttaatgagcatcagagaagcggcttcatgtttggggcactggaagagccttagttttctcccctagttgatggggccgggggtggtggagattccctgatgatggagtggcaaactgtgcaggtaaattattggtcccagctgacaatcagtacttgagaaggctgaggcagcttagaaataggaagttaaaatattcatgccaagcatccagcgtttgtttaatcagggctaatgattagtttcttaatgaaattttacaagctcagttgaacacagaaaacatttgcttctctaaaagcaaacaggtctgtttctattataatcagacatctgaaccacagaagacccccagcccttaggagtacagaggtgaatctgttcaggaacttccgagttttctttgaagatgatagtggccaaagagtgatgggagaaggaagctggcgatcaacaagatttgaaactgcaggatctaatgccacagaccctgacataaactttgggcagttgtgctaaacacagcagctctcaagtagagggacagatgatcaaaggagctaatatagtcagtggttatgctagaatgtctgtttgggagggctttggagtgacagtctaactggaactacttttacatttctggcaggctgttcttacttaggttatatgagaaaattaaataaaatgaaatttaaaattcagtgaaacaggagaaggaaggatgattagggagaacaaaagggatttttagatcagtgaaactattctgtatgatattataatggtggatgtaagatatgcacttgtcaaaacccacagactgtacaacaccaagacagaattctcatgtaaactatggactttgggtgatcgtcaagtgtcggtttgtcatgatgatgttcatcgattgtaacaaatgtgccactcttgggtgggatgttaatagcgggaggaagccaaccatgtgtaggggcaggtggtataggggaagtctcttaactctgcttaattttgctgtgaacctaaaactgctataaaaactttaagccttcttttagaaattcaattaaaaggtttcaaaagatgttttaagtcatatttagtataagatggagaaaacaattgcctaagtcaaaaattactcccattattattaccatgtccgttatttttcttcttttttttttttttttttgagataatgtctcactcttgtctcccaggctggagtgcagtggcatgatcttggctcactgcaacctccacctcccagcgtcaagtaattctcctgcctcagccttccaaatagctgggattacaggtgcccaccaccacactcgactaacttttgcatttttagtagagaggggggcttcaccatattggccaggctggtctagaactcctgacctcaagtgatccacccaacttggcctcccaaagtgttgggattacaggtgtgagccaccacgcccggccccattattattcttaatagcttgaagaaagtggttgataaaggtggtaggtaagctgaaaagctctcccgccaccaccaaatccccctacccatgtacttcctgacactgttgagtgtaggagtctagtgctgtaagagccctggctacaccaggaacgtgcagtgatggaacatttctacctctattgcagtactgacgtttcctctgtgatcttggcttacatgtctgtctcactcacctgattgtatgatccagcagggcaggaaccctgtcctattcatcttattttgtttgtttgagacagaatctcactctgtcgcccaggctggggtgcagtcacaacctccatctcccaaggtcaagcaattcttatgcctcagcctcccaagtaactggggttacaggtgcccacgaccacacccagctaattttttgtatttttagtagagacagggtttcaccatgttgcttaggctggtttcacactcctcagctcaagtgatccgcccaccttggcctcccaaactgttgggattacaggcttgagccaccacacctgaccaactgtcctattcatcttatagtcccaacccctagcacagcaccaggaacacggtagatgctcaataactgtctgctgattgaatagaagtgaaacagccaaggttaaatagataatttagctgtctgccctatatgttttaaaattgtttttccatactcaagtttaataaagtttgaggaaatatgctaaccaaatttattagtttgcattaaaaagacctgttttgaaattgttaaatggctaaagtctgactgtatctttagaaacaagatattcatagtacagccccaacaatttctataagcaaaatgcaaaacaggatcaatcatgtgatctttctagaaaagtttcacactgagccctagactactaagtcattattcaaaattatgggtggtaaaatcttccttaactttttcagtgacacctacaattatatcacaaaatattcaaaaccctttctaaataaaactttgtcctctagcaagtattcttttaataggaagctcacaaagaggatatttaaatgtgtcctaaagaaaacccaggcactgcagtaattctgtacctatatttgaagtcgagttgtcatgttatagcaaaaacagacttccctgacatttagaatcttgtcaaaagccaagttctgaatattactttagggcaccttgacacatttgttctctagtttccctgcttgagagaaaaactatcaaggttttctaatatgggagacctatatattgaaatgtatcatttctgagggaaatctatttttaaggtaccgagaacaaagtcaaaagtccttgaaaaagagatttttataattaaatggattcaatggtgccaagtaaaattcattccctaaaaatacaacttacagcccgggtgtggtggctcacacctgtaatccaaacactttgggaagccgaggtgggtggatcacctgaggtcaggagttcaagaccagcctggccaacatggtgaaaccccatctctactaacaatacaaaaattagccgggcatggtagcacatgtctgtaatctcagctactcgggaggctgaggcaggagaatcacttgaactcaggaggcagaggttgcagtgagctgagattgcgctactgcactccagcctgggtgacagagtgagacttagtctcaaaaataaataaataaataaacaaacaaacaacttacaatggtgttatttttacaaacagtacagtccttatgaaaattcttacatggttctcttgctatcccatttttctaaggtatatgacttaataagtttttaaatttttttaatggtggtaaaatacacataacataaaatttaccatcttaatcattttttctaactcatgtttattatttgtacaatcgttagcacaggtcagaatcagagagcctaggacaaaaggaggttgatagagccatgattaaaaagctgtaactaagaatggatccactgtgataaaagcctacaaggaatatcataggaatatgaaatatatgaagtaaatgctcatgtatccacatagatgaatctggaacatataatgttgagtgagaaaaagcaagttacagaccatacaaactgttcacatatgtaacgtttttaaagatacacaacactgtttattgttctagcatttatgtatatatgtgcacataaaggtattgataaaattagagtatataaagacaaggataaaacttcaggacagtggttccccctggggagagaggcggggagggaggtgatgtgtcagggagattaaaagaggcttcagctctgttcatgcgttcctagccagtgctggcaccactgtaggtgcaggtgactcaaccataagcaaagccatgatgagctcatggagctgaacagttagtggagaaagacagaagacaaacaaataaattcactacatatgtcaggtggtgagaagtgctaggaaggagaagttagaggttgattaagggttgctattttacatgggaagatcaggggaggtgtcccagataaggaggcattcatgcaaaaacatgaatgacacaagggtgtgagtctatgtttacatatggaacaaacctttaagtctataaaattttatgatggttcttttaaagtaaatatggcaaagtgttaacatttattcttagtggtgggctcttgttgttttttgaaagtttgaaaattttcataataaaaaaagatttttttaaacgcactgtctattactgaaagatgaggaggcaggatgtcagacatctctggatcttttccaaatgaaatatcttgagcctgtgactggaggtcctatttctttaagtgttcttacatattgggacttcctgagaaaagccggtaatgggcaatacttcccaaccattaggttatgcatgcttgtttgcctatctgtccatctttgcttcccaaataaaacgcatgcctgctcaaacatggagtgtcccctgcttgaaagagacaaggtcagaagatgaagagtcaatcctgcatgtgtgttttcagtaggagaaaaggcatatatgaaaagcaagtgaggatgcaaggtataaatcaacatgaagcactgatgacaaaagacagatgctggagggaaaaacacacagtgtcggtaccactgagctgaagagccaccatttagtatgtactagtgtcacccttctccctccctcccccaaagaaagggacatggtatcatgttctgttcccaggtgctcaaagcagaaaaaagttgcagcaatgtgattccttcaatgctttttggagttaacataaattgaccaagaaagtacacaatgaagtattcagggtgtcagctctagtgctacatctgtaagaagtattttaaaaatatttggtgaatgaatgaatgtaactgaggttattcatgacagtattacataaatgatacatatttctgtactcagagcatttcctaggtcacaaaaggctattacataccatggcagagactgctgttttaccccaacatctctcttgctttcataataggaaccctgatttttaggttcctaaaagtacatcaccacctaatgcagttccggacaatatataagcaattgtgtccttagtggaagtgtccttaaagagggagggcatacccttcttctgccttcttccttcccactagttggaatttggatgtgatggctggggctcaagtggccattttgagcaaggagatagaagccatctaccaaggatggcagcacaaaaggaaacaaagattggactgtgacaccatggagtgtcatgctagtcctggacagcctatctctggacttgcacatgggaaataaataaacttctatcttattcaaaacttcgaaattttagtaaactacatgtctactttactgaaaactacggttttgctgtttttgttgtttctctgttgaatgcagccaaatcttaccctaactgatatacatacatcatctcatctccctaaccacaccttataaagtttattatgatgcccacattatagaactgaggccagaggaggttaattggcttgctcaaggacccatagaacccaagacttctatcttcaagccaagcccagtgctctctatactcatagttgtattttggtgtgactgatatggattatttaccaataaatgaaatatattaagtgaggacatagcagcttggctgtaaaggaattatatcagcaactctggacatgagcttgtaggagtagggaaaaccagaaagaggtttagaaaggggaactgagagattaggaaaagacagcctgtgttacatgcagaaagactttagaaagtacaaagtgagaaacccatttatactatcctacactgccagaaatagccttctgagcagacagttggcaagtgacccgggtataaccagctatgcaacctcctggtaaaaaatcttacctacctctccaaccccctaggcttcttaccctaactgaataccatatacacatttcaggtcttttaaagtcagtgtttcaagggtataataataataataataatacatctacaaacttacagttggaaggccctctggctgtcataatcatatagttatttaacatttgaaacctaaagcaataggtccttggtaaaaatcagggccggcacaattagttgatctaaaatatactttatatccttttcatttaaacatgtcttttaagaataatctgggtatgtggttacctctgcccattcacttttgaaacgtaagagttattacttttccaaaaagcttcttaaaatttttctgattacgttttttcattgtaaaagaaattggaaagtaaaaggtatctgaaaagttttaattgatttttagcttgagcaaaactaataatccattttccataatttattatataaaatgtgatgatggtagaagaaagaaaagaattctactaagatggcaacaggtcccaccaacaccacttcctcagggtccagctaatcccatgagaagagcccttgcaatatgtaaaagatgggagcgccattatgcttgtcaccgtgagtagtaagtaccacgccactgaaatgtgctctacacttattcaaactgacaaatacaatgaacacattttaaaagtcaaatctttatagtaaagcaatttgggaagctagtttgctttctcgtgagtttgtgtgtgtgtttgtgtgtgtgtgtgtatatatttatataaattttttaccatttctaaatataatacatggtcagtgtaaaaaaactttaataatacataaagaaataaagaaaaaggcaaaaatcccaccaccaagattcagctataattaatgttttggagaatattcttctagatttcttcttctatacccacaaatacacatgatatctgctgtttaacaactgtttcactcaaaaatatatcttgaagagcttacctttcaatatgtaataaatacatatgcagataaatacaaagcacactttttaaagataacatgatacaacctcatgtggatgttctgcaataaatttaagaaataacctattggttgtttgcaatttctggttattataaaccagatagcaacaaacatctttttgtatatatagttaaccaattatttctcttagggtgaatcccccacagttagaatgttgatgcatactgccaaactgccctccaaagggtagtacaaattactctccccaaaaaggcatcagagtggttgggatttgattttcatctttgccaactggagggtcaagaatgacaccacgctgagcacagtggctcacacctataattccagcactttctttgggaggccaaaacaggaggataacttgaggccagaagtttgagacgagcctgggcaacacagcgagaacttgtctctacaaaaagttaaaaaattagcagggcatggtggcacactcctgtagtcccagctacttgggaagctgaggcaggaggactgcttgagaccaggagttcaaggctgcagtgagctatggtcatgccactgcactccagcctgggaaacagagtgaaaccctgtctctaaaaaaaaaaaattttaactaaaaaaaaagaatgacagtatatcattgttttatttgaatccttagatgccatgtgaggttgagaaaaagataaataaccaaataaagaaatgggcaaaggacatgcagaggccactcaccaaagaaaaaatgcaaatagccaaaaaatatattagatgtttacttgattgacaaaggtaaccaccttttccattatttttatcttttctattatgcttagaaagtccttccccataccaagattgcagaaatattttcccctttttgtattccgctgttttcatctttttattttctacatcttgaatttaccttggtataagaaattaggtaaggattcagctttacatatttacatctatctagcagttgtctcaatgccatttattaaataatccattccagccccagtgatttaaaatgcttcctttggctgagtgcagtggctcacgcctgtaatcccaaaactttgggaggctgaggcaggaggatcacttgagcccaggagtttgaggctgcagtgagctataaccacaccaccgcactccaatctgagtgacagagagagaccctgactcttaaaaaaaaaatgcatcctttatcctataccaaatgtccatatatagttgcttctaatcctggactttctagtctgttctactactttgtctattcctgtgccattaacatactgttttgattgctatcgttttgtaatttgttttaatatattttatgaaaccctcccctcatcagttttctttttcaagagtttcctagctagtctcacatgtttattcttctagataaagtttagaattattttgtcaagtttccccactcaactcctaccaccaaatcgccctgaatttatacattaatttcaaacaattaccatcttaagtattgtcttctttctacctaataatgtgccttatttattcacaattacatcctctgtccaaatgcgtatctaatatgaagaaagggccatatcctttatgtttacatgctcaaactacttacaaagtacatttttaattcttatatttttctttgtactacaaaaatgtccagtaattgcaaaataatactaatgccatacacttgaaatgtttctccatagctccaaaacatccatctctagtatgtgagggtacaaatcatataccattataagatttgtctctcttttggaggctgggtgtctggcctccatgtccagtgctggagagctcaggcctcaagctgctgagcatcctccataggataattagtgatgatgcaaaccagacctgcctttgcacattttaaatggccgtgaagccacatctttgaagcctgctcagtgctgcctggagttcataaatcattctttacagggtataggtcagggcttccaaactacagccccacatcctgggcaggggtccaacaaggggggcgtggatgagagtggatggggagtgtgacaatattgtcaggcatgtgctgagagatgggcacctaccctcaagacaaaaagcaccattctcagatctgtgaaaaaaccatcagctttcctccacctcccccaccccggcccctaatcagcgagccagaaacagtgtcaacgtttaaagtgcaggccactgctcttcccagaacactggggcccttggcttcgcaaccatggcatttactttccagatgcatgtggccagagaaaccttcatcactgaatatttgctgatctcatccacagttagcaaaacggtgacctgcaggccggatttggcccacggatgtgttttctttggcctgcacattgttaggtcatcttttggaaccgacatttaacaatttagagatttcctgtattttctcttaaaagtctgaaaagcctgggccacactgcacctgcattcctgcagggtgcttgatgagagctgagccattcatcactcgtgatcactgtgcacttctatcatttatgggacctgagtgtgccaccgccattccctgcagcctccttactcccagtggtttctgattcaggtcttgtttagaaggtgcccaagtctctaagccggcaaaacatctcagtccttcatcttcatatcaaattatttattaaaaagaaaaaaaatcaagtaggatatatgtaggtgagaaaaatacataaaaatctagaagtttaaaaagctgggctacatagtttgtatttctaatgtttaagagtcttagacataatataatcaagcagagaaaaacttagagaaaaacttaaagaagatattaaattgatcatcccaagttctttgagtggagccatattgagtccttctgggtggatttttaaaatatactctattttaaaagaaatagtgcaacacttcaacatacacatacacatgcatacatattacaagcttgctattgtaaatgtgccttatttctttgaaaagtcccctcatcatatagtgtctattttttttctcacttggctcttgagattcaataattaatccatctgaattaattcctgtagtcaagaatggcagctgtaataggtttctctcttgtttactatacattccttagcaacataagcttagcttgcacctccagatttattccattgtattcacaaagcatcccattttggaactggagagagtaagcaaaatacaccaatctacttgggtcaaatcctattagagcaaataataagtgttaacagctttacaaaaaaaattttttataaagtagatggattaaaatgatcaacttggggacaattcaactgaaaaaaggatatttttgaaactactgaaaacaaaataaaatggaggatgcactggatattaaatgatattgaggcatcgttgttaattctatttggtatgataatgtgtgtttctattaatgatactttaaaaaacgaaataaacatcatggatttgctatcatgtgagactcacaacccttgggactataatctttcacagttgtaagagactttaaacattacctcgtccaggcatggagaggaagtttcaatttacgtgcacttcaatttcatagtactatcctgagaagaaattttagtctctaagactcaaaggaaaaaaagtgccatgaaccattagcaatgttggccagggtcacaagataggagaatggggccatatgtgctaccatattagtcacctttcaaacttccagtctagcggtctttcagggagcttacttcttgccaattcgactcattgcttctctagacagctctgtctattaagttaattcttatcttttgagctaacatcttattttctatagcttacaaccacatgacataatgacaagcctagtctagttccgttttaatttgacagtgttaacttaaactatttggggccattctcttgtcctctccaagtgtgaaacatcaccagtttcttcaaccactcttcacatagcatggttccctccccatcatcatcattcaccactgacaggcgtcactttgtctctgtccctgttccagtaggacacagtaaaagtgtcctcttgacatcacattgtcataacataatcctcaaaatgcctttattgaattcaaattttggtttataaaatctctgccttccaaattttgaaatcagatgctattctccatcttgagctcagtttggttagtcaggtggaggcttctaaaatctttctagctatctgccaaatctgcgtcgatttaaatagatttctcagagtgtacaatgatcatcccatatttccaggccctggtatgccattaaccacagaaaccataaaaagactcagtgtgcccctcctgacccttcagtggctcctcaattcaatctacagattttcaatcttacaaggagaatttccagtcttacaaatgatacctgagggaaactaactaagctggatgcttcctctattcaacaatttatcctcattgggagaaatgaactataagctaccaaaaactggctcagcataagcaataaagtagggttgagtcattcagtcaaatgtgctgcaaggactggactaggcgattgagcagatgacagtgaataagatagtgaccatgtcatcaagcatatacagttttccctcagtatatgtgggacattggttccaggacccccacatacactacaatctgcacatattcaagtccctgagttgggcctgcagatcccaaatatatgaaaagtcagccctccctgtatgcaggtttcagatcccacgaatgttgtattttcatcctgcctttggttggaaaaaaatctgcatataagtgacctgccaagttcaaagctgtgttgttcaagggtcagctacagttttaagcagtagtcaacagtgattaatgcagtacaaagagctgtgggagttgagggtagaagtaggtttctttggctgggttgagaaggtggtagagaagagagcagaaaggaagtgagaagtaggacaacttaatggaggaagtagtaggtatggaaggacacatggaattggaagggtggagaagtgagaaaagggtgagagaatagaataaatctcaatgagtcaagtcatgtggttagtggggcacagagtttataaatactattgggggaaataaagtctggaaaaacacagaggccaagctgaataagatggctttctatatcaggatcagttaatgaatgggtgatttacaccagagaacatgtgacccatcaaaaagcgtggagaggtgagggcagggaaaggtgaaaaactcagaacctaggacagaaaagcataattaagtgaataaatgaggggaaagaaagaaaagcaaggggtaagaagacaaatatggccttccaagttagtgagtagtggctcctgcactatttattttccttccttgacatttaaatacatggttatcagccccttttcccctttgaaatgcacctccaggcttagctctccaatccttatgtgtcctccatctgtctatgccttttcttaacaaccacttctcttaaactacctaatccacccccagcaaaaatagtcactatgactcatccccaagggcattggcaaaagaaaaccatgacaagaggacatgctggataagtgtggggtcaaatgatctttgtacacacctgaaggagcagaaagggggagttaaagggagagtctaaagaggggtgagtagaacaaaagggcctgtggatcccaaaaagtggtaacatcaacctaagaactcaggccctccttgtgttctttatccattcattcattcattcattcaaccactcttgtgttcatttctctccctccctccatcccctgcttatctgttgccacacacccaacagcccacaaaggcaaagcaaattcctatatatctctcaagcctcaggttacacatcactttatcaggtcctcatgattaaccttctccctacatagcatcccggattttttctttcaaaactgcatcacagtgtaatttctcatttgttgacttctctgctatgttgtaagctctatcatggaaagggtgccatctcactgctgtgtccctagcactgagcacacagtctcaactcaatacataactatggatgaataagacatctcccagacaaataagtggcatcactagaattctctaagaccaaaaattggtgtggccaagattgctaactactcactaaaatccatgccgtctctttgggggcacacagatacactaattccttactctccctcgtagctaggtatggccatggctaaattctggtccatggaatataagtggaagtgatgtatgctaattccaagctgacccataaaaatccttccatggtggccgggcgcagtagctcacgcctgtaatctcagcactttgggaggccgaggcaggcagatcacctgaggtgaggagttcaagaccagcctggccaacatggtgaaaccctgtctctactaaaatataaaaattagctgggcatgatggcgggtgcctgtaatcccagctacttgggaggctgagacaggagaatcgcttgacccgggagatggtggttgcagtgagccgagatcacgccactgcactccagcctgggcagctgagcgagactccatctcaaaaaaaaaaaaaaaaaaaaaaatccttccatgcttttcctccatgctctttttccctttggggtggcaggactgcacacaacccctgtggtgatcttagaggccacatgttgctacctgggatcctgtttggaaaaggaccacccctctaatatgttcataaagagacctaaacttcatacatcatacatccatcatacatttaggggtctatgtgtaacagtagttaacctatctaattcagtgataagttacaactgaagttaggctcccctaacctttaccagctagcaactgttttgtcactttcccaaaaagaaatgaaggccattcaggggccagtacaaacttttttggtatgtatgacagaacaaaagttccatttgctcatgatcattaggaaaatatagtaaccatggcttgggcttccctgggcttgggccacagccacaaaacaggctgggtggattcccgtgatgtcagaacactggaaagggagcttgctggcctggccttggctcagaagcacaggtcgcaacccgcaggccctggacaaatgcccaactgccttctggagtagcctgtccctggcctcatctgtgcttaccttgcaaaaatgtcacaaaccattgtcctgttgtgcttagtgccagctggggagaagctgccaaaagcttttgcaaaagccacaccaacctgcactgccatggaacaatggctacaccaaatgactcgccttctgaataaagcattcagccgaccagacagacgtaatccacctccctgtggcaaagctcctcttacactgaagatgtagttgacaacttctgtttctacttaacactagagactttaaagagaactcctctccctggtggacttcagtatttcacaattgaattacattaagagaattagtagcatgtactgtacataattgcttgttcaactcaaatctaggaaactactaaaagggtaaatcattgactaaatcattttacctttctttattgaaggtttgtttttttgtgtcaggaccttccagatacagtgattcttaatcttttgggagtcagatacctttttaagaacttgatgaaatagtttgattcatttcacacaaaatatgtatatagtgcacatatctactgcctgtgacttcagagggcacacaggatgcctagttcacccactgatcccagacccagagtcatgaaccttttagggcaagggtcagcaaactttccctaaaaaaacagatagtaaatatctttggctttgtgagccacttatagtctgtttcacaactacccaattctgctgttgcagtgcaaaagtagccacagataatacataaatgaatgagtatggccgtgttccaacaaaactgtatttatgaacaccaaatttgaatttcaggtcattttcatgtgtcacaaaatattattcttctcttgatttttttctcaacacttgaaaaataaaaaccatttttagcaggaggcctgcagaaaaaaatgtatgatgtaccataggttgccaaccactgctgcagggcatgggttccaggggttcatcaccttggaaaaaaaattgcacctctattatcactgacttctgattggaatttagcatttccttccactatgaatgtaggccataaaccacagtagcaacatcagtaactgtaatgctgtcaccagcagaaatcacaggtatgttcatataacattagagttgttgcacacaactcaaaatactgattatgctcatcactatatttaaattatgctcactcttagatcttctgctgtatctggttatttaaccagattttttttttgaggtagggtcttactctgtcaaccaggctagagtgcagtggcgtgatcaaagttcactgcagcctcgaactcctgggctcaggcaatcctcccacctgtgcctccatcactatgcccggctaatttttctttttttttttttttttttttttttttttttttttagagacagagtttcaccatgttgcccaggtctcaaactcctgggctcaagtgatctgcccaactcagcctcccaaaattctgggattataggcatgaaccactgcgcccagcctaaatgtgttattttttttaaaagcacatatattaccatattacaaagtatatttttaatatttgggtaactgtatctcaataactgatttccattgtaaccctagatattttatttcttatatagggtttaagaacagtgtcctgagaaacagtctggagctttcaccagatatcaagagtccatggtatataaaaggttaagagtcctttcctgctccaggctaacagggcctgagtagcaaaaccacagtatctcttaccagagtattcacatcttcagttttatggatgagcatccggatctcctctggatcaccgctgaagattgcctgaaccaatggtggctgcaaacacaagagaatgggaatcagaactaaaattaatacatctgatcacatacagatgcagatggtgagaagatttgttccttaaaagtttattgaaccattatcagttggcagacaaagatgaataagactcagaccaacccttacaagaagtccagtgggggagatatttacataaagaaataactattatacaatctgaaagccaggccagatagtctctaacctgaactatgaactacagtgaatgtaccatgaacaccacccatcactgaaactttgataggcccttaaatccctgacaaggaaactactaaatctgtggttttgtgcatacaatccctgttatgaattgaattgtatccccaccaacattgatatgttgcaagccctaacccccaaagcgactgtatttggagacagggcctttaaggagataattcagattaaaagaggtcgtaagggtgtggccctgatccaataggaccggtgtcttcataagaagaggaagagacaccagagctcacgttctcattctctctctctctctctctctctctctctctctccctcttcttctccctctctctctttcttctctctcacacaggaggaaaggccatgtgaagacacagtgaaaacgtggccgttggtaagccaggaagagaggcctcaccagaaactaaccctgattttggacttccaacctccagaactgggagaacaaaaatttctgttgcttaagccatccagtctatagtattttgttatggcagcctgagcaaactaagacagttccctatgattcctctacttcttgttagacaatgttccttgttatcctcaaataattccattcctagaggatgctaatggccatgtttctggccaccggaacacttttgtgtcggtatttggaaaacccttgaaatcattcccaaatgcctcccatagctttagccaacaagtactgtcttaaacatgattacatctactgcttattaaaagtaagtggcacgatggcagtttagggaagaagaggggggtgttaccaagctcttattattgaactcatctacattaaacaagaccccagcatgcagtagaaggatctatatagtgtgatggaaacacaaccaaaagaacagctagctccacttgggtaggaggctgggtgaagacaagggtgtatccaaaaaagcttaaggaaggcaccttaatgaataaatatgatttgctgacagggaaggaagacagaggaggtacaggtgtgcaaaggtgtggatgtgcaaagaacctgatatgttactgaccagagtgtggggtaaaagaggaacagtggcaggctttagggttgatgttgggcttgcctgcatggcaaaaaatgctattcaaagccagtctcacacttgctagccacatgcaaagcccatttctacatgcaacttgggggtgagcatgatcatcgctgcctaacctcctcatgggattgttattaggatcaaatgaggtagtacatgagaaaatgtcctctaaccagacaaccctacatagatgttttcattaagaaatgtttcacgatgacaagatggagtagttgataattttcttttaaccttaagatccttggtaattatgcacacacacacattcacccaaaattctagaaatatcttagtcctagtagtcgattagatgacagcagtttccccaatgtgtctgaccataagaatcaccggagatgcctattaaaaaaaatagtcccagatccctttcctaaggatataatacattcagggtggggacctgcaaatctagattttaacaagtacctatcaattcttaggaactggtggcaagcactggcctcaggtgaaatcactagtgtcacataccttgacctcaccctgtgatctgctgttgggaatgtgagttgtcattttccctataaaccctcttttctctttttatcctcctgttggctttcttacaggttatgttgctgtttattgctagtttgggggaccaatataagtactatcagtaagacagagtaagattccttgaggaaacactatgtaaaaatgtcaaggtgcagaatggatatttcaatatgccaggaatttgtccatgggtttctcctctgccataaaaattcccagcaaatgaacatatatctctttttctttctcgaaaacaccctctcaattctgcttcttgacaaggtgtatggatagtttctgaaattgccaacaattaagtagcaggaaagaagtcttgaaaagaatacaagtttactgctagttcagtcttagctacttactctgcttaaagacaggcagatccttccacactccccctaactacctgctaaccaagtctccgttcgggttacatctgccccgtggcaaggaccacatttcacacaagacacagagccagacacaaattcagggtttcgacaaaaaaaaatattgaatcttgtttatctgctccataattctccatctgctgtgctcatggccaaatgctcatgtgtgcatttctgcctttttggaccttaaaagaaaacaagcaacaaacctccacaaccagagaacgataagtagaggcagtgtctgacaagattttcatgttaaatcaggagtagtcaatcaacagctgaacagttaagattccggggaacaaacccaacacagtagttaatgcaccactacttagtcactttaagggaacataatgaggtgagcagagtctcccagttgcgagtgtacggaatacatacattctgttgcattcactccgtcctcacacttctgaagaaaggcaagcattccaagctatggctggaatgttaccaaggagaggcatcccaaaaaagcttccagagaagggcgccagcacagtcctcagcagggagtggtgcctctgggactaatgctgctaaaagctactttatagagaattgtcaaggcacagaatccccaggagccattaggaagaagaggctgagctatcattataactcttccaatactgaagtcacatatatgcatacatatgcacctaggtacatatgcatacctatctacactcaggcatgcatgcatagagacacatgttgagtcatacacaaaccccttctacttcccgtggaataaaaaagcagctgttctccacatcccaaagccttgctatatggacatctctagctcaactgtgccatgtggctactgagacatcgccttcacaattatgaatttaagcatcatgggatttcaaactagaacttcacagataacgtgctttgcttcaactgaagctgtgtgtttgtatggatataattactgaatggaatgcataatgattcttgagcaagtaatatttattttttaaatattatgactgcttcttctttttttctctccacactcccaaaaacattcccagagagcactttggcactcctttttgttggaattttaatgagatcctgctgttttatttttccccaggtaaacacttaacctaagaaaaaatattggggaaaagatatatctaaatactatattatatgatgtttaaggcaaagaatattctaattacaatattcttgctcataagtattaaggacatatattctgttgttcattaatttggcaaccatcataacttttgcagcttttgtcttaacttaaataaggcttagaagcaaagtcctacctgcacaagagcagagtcccaagccttggcatatacagatatttctttttaaagtttcacacattttagcactagcatatataacacgagtgctttgtgtacagtagggtacagagttgaataaatacaaaattgtaacaagggtcaaaattgagaaaaacaaatagtggtaggaaaaaaggagattcagataccatgaaatcattgatcatcatcccctaaagaaatttaaattcctaagagaggtatgcagtctttttagcttcaattgctagaattttcttagcatgcttagcagctgcaaaatgattgtcagtgctgcagatattggtgcagtgcctctggtagattcagaagacagaaggacacttcctgggccaaatttaccaaaagcacaagtgggatttgttgttcagatgggacctgtccttgccttcaaaatcaccaacaactagccccctactacctttccaggagtgttgacggctgccttctagaggtgaatgtctgccaagctgatgacacttgacccctctaagatagaaatggggaacagaaagaccccttgatcttataaattttgtagctgaacttgctaacccttggaactgaaatctaatcagccgaaagccactttctctacccacatcccctatcggcacatccaataaaatattctgtttttattctcaccctgaaaacaaactgggaaaataccagacttccaaaaataaaatgctaaatcaaatatgtactagggatagttattctcaaactttgaagtagagtcaaaattccactagggggagcaagatggtaatttgttacctgggaggtaaaagcaaaggttcaggatgtgtaattaaggaagtaaggtaattgaaaaatccacttcattaaaaacataaaagaactcaagcttctgaaagagttcttagtcataagtaaacatgcacaccatgcacatactaaaacaaacaaacaaaaaaacaccaaacacaaaaaattcctattgatccctgaggatccaggttttagaaataagaataaaactatctaaaacctacgtgctaaggtatcattttcatcatctgtgaaatccaattcaattattatgtcaattccatgaaaaaaatatgctactgatgtcatcagacacaccctccatttaagaatgaagcccatcatgggttctacaaagagagccaagctagtttagagtatccactccatccggctatgaagtcatcaatgccctcccacatcccgcaaaatcccctaatgaaaccaccattttgatttttgctaaaaccactgtatagtatatttcactttccctttgccagagttgcatgctctgtactaatgaattggctttggaagataggcagagtgacagaggctgtcattgagcattggtaactacagtcaatggtaataagcccaagcagcatccagggatgctccagcatttcattctagatcctggtgtgttgcttgtgtttttctgattagatcgggaaaataaagactccaagtctaaaagaaaaacattttgcattccaatcagaaatgggtgttgggaatcaatcaatagccaagaaggaaaatttgatattcctaaacatctgtccctccttgagcattctgagtacatatgtcattaaagtaagatgggagtgtgttatcagtagctgatagctgatacagcaataatctagccatatgaagccatcaacttatatgaacaagctgaaacacttcgttaggtaacaactgttttttgtaggagccagtgcttgcacttttgtgaaaggataataaaaatttgttcaagtcactagatttaatgaacaaaacctgctaactgaattcatgtgagttctgctgtatgatctcctgcaaggatttcattgagttcttcctgaatatagatcaccctttacttgagaagttcactccatcccagaaagataatgattatcataaaatcaaaatctgttcctcttaagtaccataaggacaatacaaaaatatactgagtccttataaatacattttttaaaaaatcagggagtgaggcaggactgcatgtctgaaaatgtctcctacaggctatgctgcagagtaaatatatataatattttccattactattaaaaacagaaaaaacataaaattccatgttatagtcatgccctccaagtagcatatttgttaactctatatttaacattatgaaaaaagaattacatctaattagaaaatggagaaaattaatttattacctaatcttttcccaatgaaaataacacatgggtactgactatgaaatagttactcaaggaccaactaccccaattacccaatttttggaacatttaatcctttgttgctccttcctttcctgagattctctttgggtgtttctctgctctttaataccactagttatcaccctcacccgatggccaacccaaagtaaaacaaaattcaactttgttaccagttacagacaaaaagttgggccaaaggaagtgatggaataacagtatcagttaaattgaaatctggaggcaatgttaatttttattgattaaaatgttaatttttattgacctcctttttttccatagtagaaagattaatgctatggtatcagactgaccaattattaaatccaatccatttccgtttcagttttctcatctctaagatggggttacaatagccattttatagatgtgtttaaaaaataacgtaacggccaggcgcggtggctcacacctgtaatcccagcactttgggaggccgaggagggtggatcacgaggtcaggagatcgagaccatcctggctaacacggtgaaaccccgtctctactaaaaatacaaaaaaaacttagccgggcctggtggcggtcgcccgtagtcccagctgctcaggaggctgaggcaggagaatggcgtgaacccgggaggcagagcttgcagtgagccgagatcgcgccactgcactccagcctgggcaacagagagggactccatctcaaaaaataaataaatacataaataaataataaaaaataacacaacatatgcaacacccccagcacggggccagatgcctggtgtgcacgcaataaaaacagggatgattgtttaccttaacaagctcaaaaaccttcatagacaagtacctttatgtgcatcctaaaaaaggaaaaataagagatcttgaaagatttcctaaaatactacagagtaaataaattgagttaggattataacccactcaacaccacctctaaagcagaggggcccatcatattgggagagaagcttttacaggcctgggagcaaaaatcaaactgagcatgacttggcctttgttacactcagcaacctcgaaattgtcacacagtccctctgtactcagaagtctaatctataaagccaataactcactgaactaatacatcatttcttcttgactaatcaaaaggtaactgcatatattcatgccagcttaatgggacctgagattgtaattttactacttaaggttgtcataaatacatgtagttacacctttcttttgtgatctcctgatagacacaaaggaaatgaattccctgtttggagctgtgacgaagtctaatgatttgcctgttagtgacaaagttgagactagaacttagttttcctgattctcgcagcttggtactttctctcacatgtaatataatatatatataattcatgatcagaattcagcttcagtttcaacatacctcctatggagaaatattatacactaaggaaaaagctgccatatatgagatacattctctctatacgtatgcatatatatttacacaaatagtggccaaatgcatatacatagatagatagatagatatagatataattccttgcaacaaaatggctaacaataaaataatcttaccaaaagacagaaaacaaagggctacagtctttcaaagttgagggggctccgcatgggtctgagttataaagatgaagaaggtaggcactaagcagaattttgaaggatgagactggggactggagagtaaatctttcatgttggaaaataatagaagatgaagttagaaaaatgaataactgggtggggggagcatcacatcagcataagaagctttaacctaatctttttggtgcaatcatatagctcattaccacctcaaactcttgggctcaagcgatgctcccacctcagcctcccaagtaattcagactatgggcacaggccactgttaaacctggtgaatttttaatatttttttgtggagacagggtctcgctatgttgcccaggctgctcttgaacccctggcctcaagcaattcttctgcctcagcctcccaaagagctgggattacagtcatgagcactgtacccagcctttacctaatcttatggacaaacaggaatgggggtcatgagcaggagaaaggaatagagttttcccaagaatttaatctggccaaagtgtacactgagtactggagaaggagagattggagttagaggcccagttagaaggctgttgctacaatccaagccatcacaggaaagaactttcccatcttttttttaatcacagtctccccaggtgctacttacagggatacggtgaaaacaacagatatagtttttggttctttaatgtctgctctattcctggatgcaattttggcccagcatcttggccactttccttcactctttatatatagcccaaatcccttgcctccgaaacactaatgtttccaggtgaaactgaggttacttcctttagttctggaacatttccattttttcccccacagaacctctgcggatgtaagctctgttttgtcagacttgtcacttgatcgctgaatttaaatcataacatttcaaaaataggccacatccataaagagaaaggcaaatcaaaacaaggcagacagcctttgccaagtgccatatttctatcaggatctgctgccaactacccacagattttttcactctgtctagtttcaaatggcttgagatcaaacctaaactttagctaagataattaaattgtgttggggagttaacttttaaagaaagctaatttgggcaaaaaggacaatggatccaggaggttagttcatacagaacatttaaatccatgtaattttagtgaaacaaaaagaacaactatatatacttctgcaacagtttcctgttttgaaaaattggtatagaggttttatttctcatcttggcttgggttacattctttgtataactgtatcttactgcatattgaattcatgtagttgcaaacatgagaggtggatttaataatgttaatcaatataaaccactttagtgatctttgtggggaaaaaagaaaaatggccagaagatgattttcagggttgtaggtatattcagtataatttatttgtctgttcaaatagagacagcagttcagttttagggtgcactggaaaacatgactttttattactacctggtatgtgcatcacttataaaaaagacaacaataaaaaagtattccttataaaaaatagcagaaaatgatccataactacagaagtatcttcttgtggtcatgagtaattttaatttttgagaatctcacaaattggaagctaaataaagcaattcaagtgtcctttaaaaacaacaacaaaatcagcatgtagaaatgaaaggtactctcagaaaggtggcaatctcctgctacatttgaggaggctggaactactgtatacaagatatatggattaactcagtcacattaaatcattcatgatttaggcaactccagattgggtttgtctaaaatctgttagcacctgggttctttccaaacaccagcaagcaatttttacacaatcaggtctttccaaagcccatgacaattttcctttaaaccctctccttcccttctactgttcttttctttgaattccacgtgcattcttggaaagacagcaagcagttaaactctcaccacctctccacaggtgagggactagggacatgtgtaaaacggagtcaccttcctgttctggccattgtcaattttttttttcctaaggcatcttgttatagcaaccattctaaaattgttatagcaaccattctaaaatttaaggcagtgggttgatcaggacctgaattagtttctgcctgagatgactggaaggtcccctactccctccccagccagaaaaagtcacatggaatgaaaatctattagagaatcccctcagtgtagtctttcaggaagcatcttctcatttccccatccaaaatcatggtaaggacatccagtgacagatgtcaaagggaaaggataaggcagcaggaagagagaggagcctaagagactggaaaacattcgataatataaaatgggaaaatgggaaattctgcaaaaaaaaagaagtcatatcatatttcctttcacagacaccaacccagtgcgtagctcctttatttctttacacactaccccctccaacaggggataaaagatatgttttctaaaacttaatttggtacatttcagataaccacattcaattcaacaaagatgtattaagcataagacatttactgagcataagaaattcagacactggaggccgggcgcagtagctcatgcttgtaatcccaacactttgggagaccaaggcaggcggatcacttgaatccaggagttccagaccagcctagacacatggtgaaaccacatctccactaaaaatgcaaaaattagctgggcacggtggcgcacacctgtagtcccagcgactcgggaggctgaggtgggagaaccaactgagcccaggaaattgaggctgcagtgagccatgctcacaccattgcactccagcctgggtgacagagtgaaatcctgtctcaaaaaaaaaaaaaaaaaaaaagaaagaaagaaacacagaaaaagaaaaagaaagaaagaaattcagacactggaatgtcagagtcagtctctcccttgatgaggttaccaaggtgtaacaggaagtatacaaatacgcacagctagaatgtaaggcacaggccgcaggagaagtgcatggagaagggagagaaattgtacctggcctcctgaaagacgcagcctctgaaatgaatattgaagactggggaggatttaaacaggtagagacggatggaatggtaagggactttcccttcttcatattcagaaggctgtgagcagaagctagggagcctgaacatacacagggaacagtttcatttggctggaggaggggagaagtgaggtaagctgagtagtagacagggatcctatcatggaaggtcttgaataccaagctaagaaatttgagctctcttctgtggaactgggggagcagtgggtggtttttgagcaggggagtgacctaagatttgtgctttagaacaatcactctaaaaatggattgtatgatgacctggaggaaaaggctggagtgtcataacaagttaggaaactgcaataatagtctgcacaaagggctctggggatggagtaccgctcagttgtcagaggaagcattcttctggtggtaatatgtgaatctaaaaggtaaatttgaccgggcatggtggctcacgtctgtaatcccagcactttgggaggccgaggcaggtggatcacctgaggccaggagtttgagaccagcctggccaacatggtgaaaccccgtctctactaaaaatacaaaaaattagccaggcatggtggcgtgcccctgtaatcccagctactcgggaggctgaagcaggtgaatcgcttgagcccgggaggtggaggttgcagtgagctgaaatcgtgctactgcactccagcctgggcgacagcaagactccatctcgaaaaataaaaaataaaataaaataaaataaaatgtaaatctagctccacctttaatgtagcaagggctagcctcctcaggagtggctgcctacattcaaaacgattctcaccaacttcttccacaggacacagggctcgggagcagcgccagcccgacatcggcggaggagcaccggaagttctgcagcactggctttctttgctcttccacctatgcaagctccttctctcttgtggcttgccgagcctggttagctctgagaccggaagttctgaagtcagctggcatcctacatctgtgcaacctacttctctccccatcccaccacagaaaccagagcctcgaggcttttggcttgggtgctgccttcacagtttaggttttggtaagaagaaagcttatcttcatgtcatgagaaagaaaaaaaaatgtatctttacgtaacgagctgaaagaacaaaacaagtatacctaagccaagtacatgctatctttatttctttatttccacactgaaatttagtcagggataaaacttacttttttaatcacacgaagtttgaaaaataggaagtactatgggaaacacctaatgcatcaaaacccctgtgcattttatctttgtcttatgtttgctggattttaatcttagtaggtttcctgttgcaacaatacaaaaacagataaagaaaaaacttaataacctttcctaccacaaatgtgaacagcccgtgttcttgttggtaggtacagatacagatatatgagattatcgttatttattatcagaaaatgggattttactatttcccacacacacactttttttgagatgggggtcttgctatattgtccagggtggtctcaaattcttgggttcaagcgatcctcccacccaagtatctgtaatccaagtagtctggattacagatgcataccaccatgcctggcttatttccctctcttacaatttgcaaaaataatgatgtactgaggacatcccccaggtcgatagctacaggattaaatcatttctcttaataactatatataatactattccattgtatggatatgccataacatattcaattattccccttcgaatgggcatttgggttgtttctagtttgtaccacaacaaacaagcctctatcagtgcttatccacattgcacagagaagtgctaccagagccaaaagcattttctgagtacctacaatatgctatttttatgaaatatacaaaagaaatgtgtgacatagtcctttcctaaaagactgccaaatatagttggggaaataagcctaacccacacaaaacacttaaactgtgtaagacagtactgaaccatgttctacagacctcatgcaaatggatgccaagttgtccttctgcacaatgacagattggagaggtaatctggaggtgcctttagccataatattctaggagccttcttgattcagaaaaggggaagcatgaaaggctaagaagccagagtggtgtctctggaggaggcaggacttgaacaaggcctgaacatggtttagatggaggaaggaaaaaaatgtattttggaatgacaaatgaggcagggcacagcactgactttagacatgtatatgctcaggagaatgtcctgagttacagcatttctaaacaccctcttctcatactcctcccaccaccaccactcgccagactctgcttaaagatataaaaaattcccaagcttggctgctgcagaacatcacactaacactaatttaaaatgcactacttccagacagcacgagcttgaaattacctccaaatctcttccttccctgtccttctcatgccctatgctaccccctgccaaaacacatacaacgcttgctgtgcccttcaaacaacagtagtcatttaagctgctcctgcccatctggaaaataatatgaataacatgaaagaaagcaataatgaagtgactggaatttagcaaccaaaaagacctcagttcttttgataatcaaaaactttgttaaaatgtttacatcgacagtcactacagtgttggtctttcactctatgttgcaatagtatgtttgcaacttctccaaatccatttaaatgaaaatatttaataacaagttttaaattttatcaattgttaaatatgatttgaaagtttagtgtatgtcctgatatatagtatgccttgagactgaatataagtagctctatgggaaaattctgaaaatgaattaggaataagtagattaatgtgcttttagtctcaaagactagagattaaaaaggcatgggtaatttttaactgagaggtggtgccacagagaagtctatgattctctctttttcattacccatcccagtttaaaattagcttgcagcatgttttttaaacattaggaaaacaagatgcactcccagaatgttcatgtgaagggcacgtgtgaagacataatcttgacagtcatattacagaaaataagggagtgagttactgagtttttaacaaggagagtaagttactgagtttaaataaaacctaatttgctgtgtgtttttatttagcagaattttgaatgcccgttgcctccgtggcactaggcaaccacaaaggcaactgaggtctgagacaaggcatcagggagataggatcctttggcctcctctggcccaactgacataactgaggttggttcctttcctggtatccacactcccctctcctcaccaacaatccccctgacgttggctctgaatgatgtggagaccctgttagtgtcgtcgcatgttaaatctagatttgggaatctgcactgcacaccttatgtcaaaactcagagctgttgtttttatattttgtttttgtgttttgtgtttttatttcagatgcaggggatacatgtgcaggtttgttacacaggtatactgtgtgatgctaaggtttgggcttctaatgatcccatcgcccaagtagtgaacatagtgccccataggtagtttttaatctcttgccctcctcccatcctgcccccttttgggattcacagtgtttactattcccatctttgtgtccttgtgtacccaatgctcagctcccacttgtaagaacattcatagccactgttacctcatcaccatgtaacattccaagggtttaaaatgcacaatacaatcatagttcttttgagatcatggttgactgtcctgacaaaggagaacttttagctgcccctcctccacccagggatagaagtggacttggtgaaaggcaggtggcctgtgacagcagtggcctgcccaggcacgcagaggcttgctctcacttttagagtacttggtacatttggcactgtgcagcaactttttgcttcttgaattgtgaccaatcaaaaatgatgaaacaaggccattgaagggagtggaaagaaattaactgatgcgccaggagtcctggtctacccttgatcagtaggtgttacataacggagggcaagtcacagagcaggcagaaacctctgttttcttaccagaaaagataggtccaaaatgatcgactcctccaagaacaataagggaaaagatgagatttcagatggaaaaaaaaaaaacccaataaggggtggtctaggtgactataatctcactctgccagaagagctagacgaccaagcttgatgcacacagcaggggaagtagcaggaccaagctgctcagaactggtcagagtagtggacaatttcgtgcagatcttacaggcctcttttttgttttttgtttgttttaagatagggtcttgctctgtcccccaggctggagtgcagtggcataaccacagttcactgcaagctcgacctccctggggtcaggtgagcctcccccatcagcctcccaaatagctgggactacaggtgtgcaccaccacacccagctaatttttctaaaaaatttttgtagagagggggtctcgtcatgttggacaggctggtcttgaactcctgggctcaagtgatccacccgccttagcctcctaaagtgctgggattacaggtgtgagccaccacgcctggccttttttttttttaagacctaaatggatgcagaagaaatttggctgatgttttttggctggattgcatatcaaaatcccctgggaaactaggtcccaccccaataagcctgaggtagtgttagggatgcaaatcctagcacaagcgcttgcaaaggctctccaggtgactcatacagcttcaacatacatgcagcactgaatctgattcttcatctcaataccttcgaaatcctactcctttgaccccacagtccctcttcagggaggctgtcctatagaaataatgagatatacagacaatttttgtataaagatgttcataacaacactatttatgacaggaaaaattaaaagggaaccaatgtcaaagctagggaaattattgagcaagttataatatataaaccaaaaaagatatacaaatggccaaaaagcacatgaaaagatgcttaacatcagtctttagagaatataaatctctaagaactacttcaccatttctggtgtgtgtgagataccatttcacacacactagatggctaaaacaaaacaaacaaacgaaacccagaaaacagtgttgggaagaatgtgaagaaattggaacattgctgattggaatgtataatagtgcagctgctgtggaattttatttagctatttagcttggtagttcctcaataagttaaacatggaattaccatataattcagaaattccactgctatgtgtatatcccaaagaactgaaaataggtgttgaagcaaaaacgtgtacctaaatgtccacagcagtactattcacaacagtcaaaaggtagaaacaacccaagtgtccaccaaccggcatcaactgatgaatggataaaccaaatgtggtacagccgtagagtaaaatattactcagccatgaaaaggaacagcgtataatgatagatgctacaacatggatgaaccttggaaacattatgctaagtgcaagaagccagacacaaaaggccacaggctgtatgattccatttatatgaaatagccacacatagaaacagaaagctgattagcagttaccagggatcgggagggaacgggaagtgactgcttcatggatacagagtttcatttggggtggtgaaaatgttctggaattagtaataatggctgcacaacactgtgaatgtaccttttaaaatggttaaaatggtaaatatcatgttaggtgtattttgccacaataaaaaaaattatgatacataaaacagaatattttacttattaaaattggccttttgagggagtttaatgagatgaggaaaatgtggaaaaaaagcagtctatgaaactatatacagtttgatctcagcttcatagcatataaatatgcacagaaaaacaaggactagaagaaaatttataaaaatgctaaacagggttattggcagatacactttctttttttgtaatttccaaattttctataatattatgtttattattattgttaactatcatttttgtaaacataaaaagaaaaattttctttaaagatgggaccactgacactttgcatcacagctaggaaaagaaaatgagaataacgaagggtctggaaacatgtgacataatgattcaggtagggggctagacaagagcatagagtggtgaaggctgcaacaatctggagaatttatgtcctgtccaaagataaaattgtggctccagatcttttgagttttcaagagatgccagagctccagacgtttcagtgaaatgccctgatttttaaatgttggcaacttattcaatatttttcaaacaccacaggccaaacaaaacacatctgtggaccggatgtagcccgcaggctccagttagcaaattctagtttataagaacaggaatgtttaggctggaaaagaaaaacctttgaagggatatagtactagtaacatcaagtatctgaaaaatgactatgtggaagatggtgtaggttaattcatgtgtctctagaaggcagaacccgatctaaaggctgggtgttatcagagaagcagaatggggcacagtctataagggagaggtctctattagagcagctgtccagcaagaaacagcttcaaaatgcagcgagctgcccatccctgatgtgctccagcaaaggctacataaccaggattcctgctttgggtcagaagttggactaggtcaaaagctcccaattgtggctgcacattagaaacttgaaacaaagcatacagactcctggaccctgtcccagaaccacagagtaaggtccaggagtgtgtatttttaaaaagcatcccctttgggtatatacccagtaatagtattgctgggtcaaatgttatttctggttctagatgatttagaaccacttaatctttgactgtaacactggaattctagtattctgatccatggttttacccacctggccagtaaggaagggaaggagggattgaggaaaggaagaacaatgtaccagagctcattatggagcaggccctgtgctgctttccttatgtcatctcactgtatttttcagaacaacctggtgagttgcgaagtgatgtcctccaccccatttccctgagaaagaaactggggcttggggagtttggggatggcccaaggtgactgccagtcactgggaagatctttccagctccagatcccatgctagttcaactatgccatattgccctcttcttgcccactcaacaatcatttctccaagtgccgatggtgggccaggcaatgcattaggtggcaaggattctgcaatgatcaagatacagtcccaggctcaagaagcttcgaatctagagaggaggaagaaaagtaaacagtgacatcacggtggaagcaacagggtcatatgggagggacacccaacccagccttgtgtcatcagggaaggcttcagagaggaggtgacagctaagctggggaaaagagattcctaggtgaaggtgtaacatctacagagacccaaagatcagagggagcctaagcctaccaggtgtggggaaatgtgactagttcagaggctggagtgtgggatgcaaggagtgaaattgtaaggtggggctggccacgctgagactttgtcactaacctcagagaaacaggaagcaagtaagactgaacagaagggggtgacatatgcagatgcacattttagtagctcagactggctgcggagaggagaatggattggcggagagaacacaagggaggctgtggcagtcattcagctaagaggggatgacaagccacacaaaagtggtggcacgacagaagatgtgcagcatagagatgatgttttttcactcattctttcagtaaataatattacagagcccttcttatgtgctggccattctgcctaggctggacatacaagcatgggtgaaaacaaacatagtctctgctgccgtgaagttcacactgttagcgctctgctagggaaaagatgtttagggaagtaatttcaaaagtattaaataaggcaaggcgtagtggctcgtgcctgtaatcccagcactttgggaggtagaggtgggcggatcacctgaggtcaggagtttgagaccagcctggccaatatggcaaaacccatctctactaaaaatacaaaaatcggccaggcatggtggcacacgcctgtaatcccagctactcgggaggctgaggtaggagaatggcttgaacctgggaggcagaggtaggagaatggcttgaacctgggaggcagagattgcagtgagccgacatggcgccactacactccagcctgagcgacagagcgagactcctccgtctcaaaacaaacaaacaaaaagcattttggttgattatgttatcaataataacatagtagggaaaggatgtacaggactggctcctccatcatcaattgtcaaagagtcattaagcataggagtcacataagataaatctaaagagttattgcaaggccagtactctttagaattacgtccctcatgttcatacataacagtgtcaatcagactgtctgctctcagtgtatttcattcaaggaaagtaagaaaaatttacctacattttaattcatcattctttgaagagaagtgatggatttaaaaatcgtgataagattttaagctaataaattaggaacattctcaaaaacttactaaatgtggccgtgcactaaattaaattaaaactcttcttgtggcatttgagattgttgctaggtgctgaagaagcaagtttggatctaccccaaaattggccacagagcaagcaactggaaaatcatggcatggagggaagggggcaggtgtctgaaaactgtgctatcaatttattcaataactccattcaggttgcagtcctagttcaccaatgaggccaggacgttcttaccagagtcctcattgtttaaatcacagccacaacattcttttaattcttttagtctatcccagtgtaataatcacccatgattaaacagctgtgcctgcggatggcacattaagctgcttctcttttagaggtgatttttattttttgccacctctcagatgacccctctgatttttatcattctggcatctcaaaggccagcagagaaaaacatatattagaaaatgaaaatgttcccttccctttctgtttttctcttgaaacactactcttaacaccagctcaccactgatctcaaatcactgagaaagatcctcttctcgtttcttcctttgccatggtgctctttcatgagattatgatagacctttccccagtccaccaggaaaagggagcacacaccccagattggtagcactgagtcaaaatctgcttgcccagaaatgttatagaaaaaaggaaatcatgccccatatgggttgaataatcccaaccttaacatttggcaactcaaagaaaaacagaaatgaggaagacacatacgagttcttacaagccagcctctaacacaaccagctttttaaaaatgtactggattcctaaaagtaaaattctaaagtcttcctcccccttctataaattgtacagccaggaaagaagaggcgacaccaaatggtgacagggagttttgttgctattattgggctgttggttttatcgtagtattacatagtattgatgaacttttaaaaaatcactttcctcgaactttctaaatatgttactgtcaatgctcaaagagaggtctgagatttgttacgtattttagacatcttctaagtaactccacagaagactctcaaaacaaaagcgtgacctcaacctgcctataggtgccctagtggagaatgcttgataccaggtgacaacccccacgcgccccaatagtgcaagaacaaagtggaggccagagaaggggctggtagtttcttcttagttctcagaaggcttatatgatgatccactcacctctccttccaccttaagggaagaatggaagataataagcaaaacttctagaaagagcaattagcccttcaacttctaatatccaggtggttcagttcccagtgagagaggtaagtgggcaatggtaagctgtgccacacaccaggtatcttatttttcaagaatagctttcttggccagaagcagtgtggctcacacctgtaatcccaatcccagcactttgggaggccgaggagggcagatcacgaggtcaggagattgagaccattctggctaacatggtgaaaccccgtctctactaaaaatacaaaaaattagccgagcgtggtggtgggcgcctatagtcccagctactcgggaggctgaggcaggagaatggtgtgaacctgggaggcagagcttgcagtgagccgagattgtaccactgcactgcaggctgggcgacagagcgagactctgtctcaaaaaaataaaaaataaaaaataaaaaaaagaatagctttctctttaatgctttcacatgggttctaatggtaagcttggagaagaataacctgaaatcccatgtaagtgccccattttctccaggctatttgtctgcctctctcagaacatagtgtgattcatccattaggctatctggaaaataggcatttagaataaaggcaaaggggatataacaggcaagactattagaggtagctctaagctttgctttgtgccgctcaagtgattcatgaatgcaattcatttccttgcctacagttcacattctcatggctgttcagagatgaaaagacaagacgttctgagtagtttcttcgaatagaccaaatcctgatgctgtttatgagccttgagataaaaaaactctgacttcatagcaactcttaattatgtgaatgtacaccaagaataggataaatataaaatctatagataatcatgaaaaacaagttttagttggcatcctgcttcagccctgctaaatcatttaccagagtaaacctggcttgaaaacactttcaattccccaactgctctcaagtgggagtgcaaatgaacagagaaatggtgggatgggagtcggagaaaggcctgacaaatatgtagtcagagctgccacatccattcctgtgcctttagcagacatcactaatcaagcatgatactcttttccatcttgaataagcacaaccttagactcttcctcagcactcaagcagtccaggcaatcattaccagtcaataacagctggcccatttgccgttccagtttaggagaaatctggatgatccaccagttatgtcatcagttaacttttaatttcatcaagaattaaacattggttgattggtctttcatttaactacttcattttcctctaagaactaggatagtttatggaaattgtcatgaaaagctaaagcacattgcttctaagttctctaagatggacagataagcatgctgtatcagcacacagcacaagattgtcttgtgagtcaggggagcaaagaatcagatgagggtttagcctaacagggagtgaagatatgactgcggctagaagttgagggctgctggggactgggtacttggagacctcacttgggggaatatgggcaaagccaggaaccgcacagagaccacaggaatccactcctactacctaagagacgtcttacagaaattcctttgagttaaagtttcccctgttgaaatcacctctgagtgagtgaggagactatctttcagtcacaccttagtggagaatgtttacttaggttgttttttcttgactcctaaaaaaagaacagcagcaagaggaagttgggtgtttcgaatggagacaaagaaagaaaacaaatgtgatttgaggcctcctaagaaggactgtcttgaatccaatgctgggcttgagatgtgttgagaagcacttattgagctactactgtatggcaagcacttttcatacattatattgcttcctcttcacccctaacagtgagttacgattaacatcttccgtttacagatgagaaaaccaaggctcagtaatgtaagtaacctgactgatgttataaagctagtgaggggctgaggtcccatccagaccaagatttctctgacgccaaagcttgttctgttcccattacactgagctggttcctctgggaaagcatcaaagacacacttggtacactcagaaataaatgttccttaaggccaatgcctatctgactctaacaccttcttccagagattaggaaggaagcaaattgtcctcatgcaaggcaggccttaagagagaaggatcacccccacctgttggaacatcttgtcttggagagattagggggccacgggttgtggactggaatggcatgtgtcatcctccttcggctcagatatcattcctcccttatggagagaggcagcttcaaagggggtcagaaacagaaactgagcacagtgaatgagaggctggagaggcaaatgtcctcctgccacctttgatggggcagaggcatccatgtggggcaggatgtgctctgtttggtggtattggagagggggtgtctagaagctagtcctgtcctgctccatcagtggggtttacctggggatcacacactccctcatagtatgtagacgccactgtgcacctgcatgccgagaaaaggcagcgggccaggaggaccccctgcctcttctctaatcatatcccacccacccctatgccatgacctaggctgcagctgctctctaaggactccttggtcctgcaccctcaatattctgggagatcacaggagttgccctttgggcagatccaaggacacccaggagcagcatcaccagcacacgtgggcagggaaggcatagttcctgccacagaagcagtgacacagggagcaggatacctccagggtgagagacaacccagggatgttgtggggaaatggggagcaggaagagatggcaagtaacacacactcagtgttttctgcatatcccagtgaatcctccaactatccccattctgcagaaaatttcaataacttagccaaggagccaggatcaaccaggtacttccaccaaagtacctgtaacagaagacaagagtgaacgtctttccctacatgtctgcctgaaaaatacgtttttaacttaacattcacatgaattttacagtctagtgctgccttaagatatccatgttcatttcaatggaaaaataatgtctttagttaactaacttaaaaaaattaaccatctgtgaaatcacgctaatcccatgagtacatttctcaggggtaccacctcgaggggcacaagaatcttgggccaagtcagggccacaccatcctgctgccccaggcaccatgagatgctccttcttttcccaacttggaggttccaggtgttcattaggagatgcagcaggttataaaccataactcagagaagaggaatagtggggggcagcaagcaggagacgacgcagcacaaagaagccccaagaaaggtgatcgacagatccagaccaacagagccaaaggaacacaagcacctcgggactccaatcactttgccctcctcaggtttgtgaccaacactccggtgatgaagggctagtaatcaacagtaagctcatgcacgggaattcccttcactgagcctctctctctctctcagtctctctctctctcacacacacacacacacacacaccccacagcaccactttgggggaaggagaggagatattgcagagctagagttttggaactggaacaaggagggactttctggtggatcaaagtatgctagagatcaggcagtactagagccaagagtttgcaaccaggcagatagggatccagtgggagcacactggcaccaaacacgaaagtcatctggcctctgaaactggcttttatgagccagtaagtgtgtgagcttagatcatggataattttcaaagaaaccacttgtatcacacagtccctattcgagaacccaaaatgcttctgcactaaatatttgaacccctatgtatttaatggttatctagtcagtccattgttgcctagacaaaggcaaattctcaggaatctaccaagaccataagttttagaagggcagggattcggtcactgtggtcaccactatatccctaactgctagcacatagtaggccctcaataaatctctgctcatgattcattcacattcattcaaaataacacatttgttcaccctgcctcttccactctccttttatagggagtattaaccaaaaaggttattgcaggctctcacagaagaacttctacatgagtaaaaattctgcatcacagcaactgcagtggtgtcatgtcagacatgtttttgctcaaaagaattcagttaacacccacaaggaagggaggtggacacgtacacacacaaacacacacttcaatcaggaactcggtgatcacatgcccacggtgagagagaaaaaaggaaacacgaccccacagcttcctctgcatctcattccagaaagcttttcacagtgtgaacatctcacagagctgactgggattctagtgtttaaagaaacatatttttcatacaagttggcccctaaatgcaagccaacttcttatctggtgctcaaagaaacagcaatgcggctccaactctgcaggccaaagtggctgtgttggcctccacaagggatagtatacaggcctccatggtggcaccttccaaagagattttcaagagtaattttgactctacaagacttctacctcacacatataggggcttagccacccagcgagctatgacccctctaacacagtctggtatatcacccaaacaaggttagcctgaaggaaggagaagttctcaaaggagagcattatacatcttgttacacaagcggtctataaagtaagtctgtttaatgtagacaatgttatttttggcatatcatcttccaaccagttttctggttttcaaaataatatctacgaggtgattactccagagagcccacttggaatttttctgattttttttctaatttatttcagcacatgttatttcaagatctctatgaaacatattaaacacatttaaccttacctaaaataaaaccaactcattagatgatataaaaaacatctcattagcaaagcactgataaatattttctctcttccagctaagcattgctcattatacacttgagcactgtgcagtcttatcatgccacaattatcagcctcatacgctgagcctaagcataaaactattattgagcaaataatggaattggacctgtacactgctaagctcctgtagactggctcatacaatctggccgatttatatagccagtttgaaccaactgcacgttttcataaacaggcaattctcacacttttaatgatctgatttattagaccttctaagtaaacaagcttagaactctttctctttttaaaaaggtacatacagcaactttaagatattatatgtgtatgtatcttggcaatactacagcacctttaagagggtatatgtatctttgggaagatagactgttttctaaagcatagtctaggtttctctaatgctatgtgaattttagaatcactttaaggcaatcaagtcactttggagacaaagaaagaataagatgaaggtagcaactgaaaagcaacctcagataagctatagctattttcatattctttacccccataatttttgtgggaaattactataaggaaatgatcagagatgagcacaaagatttatgttcagggtgtatattagggtgttggttattatagaaaaaaaaccaaaagcttcttaattgtccaatctcagggacataataaaatatggcacatcaaaatgatgggatattatgcagctattaaaaatgtcatttcaaataatttttaaagacttggagaaatatttatcatatagcattaagtgacaatttaaaaaaaacagtaaacaaaactatatccaaggcctagcctagtgtctggcacctggcaaacatgcaaaaagaattttgttgcattaagtaacatatacaatgagatagcaagtctatattttaagtaaatatgtacatacatacataaagaggaagagtaagagaaaaaagaccaagtcagtagtatttatgtcttagtgattagattacaagttattttctccttttttcttttgctcatctgtatataccacatcttacagttaatacctatcactgatatagttgggaaagaaaagaaatgctataaaaactaaatgtgaaaacacacatttacatgaaattgcattttaaatggaattttaaaagagtaattagaacacagaagcctgccaatcccagcagcaacaacagaagcaaagtcttgaattggaaggtcacatatgcctgttcccaaatagatgctccaaggcaggccaaactggaattctgggactagaagaacagctggatttttttgtttttgttttgttttttttgagacagagtctcactctgtcacccaggctagaatgcagtggcacaatttccactcactacaacctctgcctccagggttcaagtgattctcatgcctcagcctcccgagtagctgggattatacgcacaccaccatacctggctagtatttgtatttttagtagagacagggttttgccatgttggccaggctggtctcgaactcctggcctcacatgatcctcccggctcagcctcccaaagtgctgggattacaggagtcagccaccatgccaggccagaacagctgtatttttaaagcaagtatatgcttcatttttcactttgcatcagaatcttctgtgttgagatgatgtataaaatctaagccaaattgaactagttttaattcatactgtttactgaacaacattagcccaatttttcaactgaagatttttcttgcttttggtagagaaaaggctattttgcatgtcattggctaggcttcagaaaccaaaggttttggccgcatgaggttctctcagtgcagggggttagaaggtaccaatgcctcagtgtaacatttgaagtgggagagtgtgaggtagtaaatccatgtgtttccaattttcccatccctgaaaccacagattagagaaaatctccgcaaataatttttgatgacctcaaatggcttcaattaaatgaaatcaaatcaaatatttctagttgaatactatgtattgttaataaggatgaaatgtgttcttgatcgaccgagtatctgaaaaaaaactatctggctctttaaatgatatatatttaagccctgtcactaagtagccatttaattaaagtaaatgtctcagcataaatcctgctggcacagggtcatgtaggtttaaaaatcaacctgcaattaggactttcggcctaattatgtggcaacaaacttagctaggagcagtgacatattgagggtctttaaaagctttacacttttgtgccaaaatttatgatgctgtttcctcctcctttccttctcaatttgtatgcaacttcacaaccttgattaacagcagcatctggcagttctcttccaagcagctgtgatgtagaggaaagaacacaaaatttaaagtcaaaccaatcggggttcaaggacttgctctgccccttgctggctccaactatgccctggatgcctgtcttagtaaaaccaagaagacatcacctacctcttctggaggcttgtgaggatcaaaagagtaactcatgtgaagatactgggtacaaagtcgtcattcaaaatgcagtctggtatagttttcaaatattagtgtcctaatgtggaagtaatatgtaagaatggtgcttccattcaacagaggaaatgagtcatttcaccctaaaggtctctcacttaggaagagcagcaatatttcctccataattcatgctatccagtaatccacaaatttctttggagtttcttctgtgaactaattaatacccaccaaaggatcaatgtcattgcagggaaaatctgtggcttcttagtctgtcctacctccctccattttaggagctgtccctcctaaatccttgtgatccagatgaaactgttcatcgagacatttccctccgctgttctcatcagcagggctgggtgcattatccaggctgaccagagtgctttttcagaaattgatttggattgtgggaggagagcaagggtggcccgtttctaagatactgagttcaaagtgcatgtcatcatttctcacttccccttctataactggaagacagtagactttccattttgcactaacatcagcccacacataactaccttttctggactttttccagcagaaaaacatttccaacctcacaagcatcagcgtccaggaagcactactttatgccatgaaatctaaggcagccagaaggcagggtctggctttgtcagcaagcacattggttaaacacacacacacacacacacacacacacacactccaaaaacaaaaacacacagaaaatcactcctctgggggaaaagaaaaaaaaaggactcagtgaccatcaaaaacgaaaaggcagagctggctgatctgcaaaagctcccagacaaaatcaccagcactctaagaggactctgaagatgaaaaaggtttgactattttctcatcactgtttgccaactgagtctggttttgctgatgaaaacagataatttcatttactttccacttttttttcatggtccaatgatctctcacattactaggttatctaaataatcacaattgtctcctatttactgatgcattgtgtttttcaatccatcaaaaccagtaaagaagcaaataaatatccagggtgtcaaatataacataaatgctaccaggatgtcattcaaaatagagccatcttttaaggctcaaaaaccatccagtgatttggattttcactaaggttggatagctcccaaaatggattttgatgggggaacatatccatattctttaatatggaaaatgttgggatcctcatagcccaccaaaattcaagtgattgaactagagaaagagcagtatttgcttgaatgacataatagactctcctgcagaggcagcaaaaatagcacattcaattgggtatctgaaaaacacttgaaattgttgtataaaacaactgagaaattaaacaacaggaaaatgtctgggcaacaagtccagaagaggtgactttcccccttttgtgcagagctataacggttctgagccactcatctgctctttctcaaggaacacccttgagatttttatcctttgaggtaataaaagtatgagagcctcatttaacaactgtgggatccaggttttctcatccgttaaatgaatgagttggaaggtatgtatttttgtaggttctttccagatctaaaaagtctgtggttcagcacagaatacacaactctcacagagtttccaaaaacattggagcaattggcccccaaggaaagaacattcagccacaaagcccttcactcctgtactgaaacatttgttccctctgcttcctattgatggatagaataagatgggcaatagtgctagtatttacataagagtttttactaatgaaaatcaagatgaaaatactagaataaaataaaagaaaagaataatggtcaagatcaggacaccaaaacagatggattctcatttgcctgggatactttaagagaggtcttcctctcctaaaatgtcagagagatgggaagactatcctgtacctgaaaggataaaaaagatattccaatagaaggaatgaaagatgtctactgagattattcttctccaacatttttccccttccaaattcccaggagcaggtgtctctgccttctttaagacagcaactactgatcctcacctacacccctccattctccagggatgtctgaaataccagtgggacttcctgctattccctgctacctttctggatcttagctgtaccactccccttcacccagtgaacatggcattctgcagccaaagtgaaccatttacctgggttttcccagcttcacatcttggctcaagctcttcttttaattgctcccaaaccaataactacagttgaagggccactttctccataaagccacccatgacacatcctacagcccactttgtacctcccgcatatttctgccatggactgatgaaaacctgtacttttggagtttaagaaagggatggtgagaaattaaatattgactgcccaagggatagagaaaaaaacacagttgcctgatgccactttagacttcctggtatgggagggtaaagtcccttttttttttttttttttttttttttgagatggagtcttgctctgtcacccaggctggagtacagtgacacaatcttggcccactacaatctccgcctcctgggttcaagcaattctcctgcctcagcctcccaagtagctggtattacaggcacccaccaccacgcccagctaatttttgtatttttagtagagacagggtttctccatgttggccaggctgatcttgaattcctgacatcagtgacccacctgccttagcctcccaaagtgctgggtgggattacaagtgtgagccaccatgcctggctaaagttccttttttttttttttttttgagatggagtcttgctctgtcgccaggctggagtgcagtggtgcgatctcagctcgctgcaacctctgcctcccaggttcaagcgattcttctgcctcagcctcccgagtatctgggactacaggcatatgccaccacatcccgctaatttttgtatttttagtagagatggggtttcaccatgttggccaggatggtcttgatctcctgacctcgtgatctgcccacctcagcctcctaaagtgctgggattacagacatgagccactgcgcctggccctaaagtcacttttttaaaaccattttcaagtggatagttctgtggcattaggcacactaacattgttatatgacatcactattgaccacttccagaacataaagtcgcttttgcttaaactagtttggtgggatttctgttacttgcgtccaaaaaaaaattcctgactaataaatgcatcatatacattagtaaaggtaagaaattcagaagggctttgagagctgttttaaaaatgataaataaagcaaaattttctggcaccatgaaagcagacgggaccccaatgaaaggttcccgaggacaatcatggtctgcaaagtgcaggaaaaataattcaccagatggatcatgtggtgtaaatcactgattttttttttaatttttatatttgtaataggagaacgcaccaggatgcaaaggaagctcaaatctcacctcccaagggaaaaagacattctacagagaaaattagaattgtgccaagagggcaaatctccaaaggcagggagaggccttagagaatacgaaggaagtaacaagagtgagtgaatgccttctaacaaaaatttccctttattttaacaagctatagaaggctgttcttcatattaaccttacatataaaaataatttattaaaagtttaattgaagaataatcaagatcaattttttcatgtcagcagaaaactctatgcaaattactttgaaagtaatctaaaaaacttacacaagaatgaaagtgtacaatatttttaaatgtagaaacaaagatagcagtcatatcctaatcctttctttgtggcaggccttaattccctcacagcttttatttcttctttaccatgtatttaaatttgaataacattatatccaattttctccaggaaagaaattcctgtcattaatatggataaatattttattataaattctacagtgttatgatccaataaggagttagactagccactatgatgttcttggtatcatagttgttagcctagaaaatgggttctccatataacggaaaggtttttcttatttctctgcttttttctccacttatcaaagtattgtcattgtgtatttcaagatgagaaatatgatgtaaagaaggaaatgcaacagagagttgtcataggtagacattggtcatttgcttggtagccagactcaatcacaaatactctttacctttgtggggaggctccacagctagacaatgaatgcttcaattaattcctatgtctggctgattatatttctgggggaaaaaaaatgggttataagcacactctcagctaaagcatttagtttgcccacagcaatcagtctcagaaggactttaaaattttaaaatgctgactttaaatcagcattaaaacctctgagacatttaacagcctttattaaaggggcattcaggaatctactttatgttgactcacaggtaggcttagaactgataatttgctatcccagtgggtttttaagatcatgttatataatgtcaaagtcatttttacaaaaacaacttggagaacatactctcctaagttaacattatttgaattattgtaaaaatagctgctagaggtcgggcacagtggctcacgcctgtaatcccagcactttgggaggccaagacgggcagatcacctgaggtcaggagttcgaggtcagcctggccaatgtggtgaaaccccgtctctactaaaaaatacaaaaactagccaagtgtggtggtgcacacctgtaatctcagctacttgggaagctgaggcaggagaatcactggaacctgggaggtggaggttgcagtgagccgagatcatggcactgcactccagcctgggtgacaaagtgagactccatctcaaaaaaaaaaaaaatagctgctagataaggtaattttttttttcagagacagagtcttactctgttgcccaggcttgagtgcagtggagtgatcatagctaactgtagcctcaaactcctggacacaagtgatcctcccacctcagcctcctgagtagctgagactacaggcacataccaccatgcccagctaattttttatttttttgaagaaatgtcatctcactatgttgcttaggctggaaatcttttttaatgtaatattttagttactctttgactagtaagcctgaccgcagacttctgtcacagcctctacaacacggaataaagtccttcctaaagcataacttagattgcctcaacttttcatctcttccagggaaaattccctaagaatatgaatgcattatcttcaccaccctcggccatctttcactcatccagaaggtcgttggtaatgggacagcatatgttatactgtgtctcttttcactggagataacctaaagaagccccagagtgtaaagtgatagacaggggaagaaattacattcgatcagccaaagctgaggactagaaagcacaaaaagtcagagaggcaacctggagtcacagaaagcacccagtgttaagggtgggaaggctgggctctgggctcttccccctcttgggtcaggctactttaacatcagaatctcacttctgccatctataaaatgttctactgcactccatggctaagatctcatcctacaccaaaatcctaacattaaaatgcttcaatgactcaaatactctcttctgtgattctgctatagctaagaacagcacctggaggaaaaggagaaataaataaaggttcaaccaagagactggtgtcctaaggcagataatgtgagactgtgataactgccctgtgtcctggggttgcccactaggatctgctttgtacttttatttttctttatcccccatggtacctgctggtgccttgtaagcagactcaagaagaggaggaggagggtagggaaggaggcttctaaacttcttgagccatagctgaaaacacaaaggcaggagacaaaacaaaactaccaagaatagtgtgtaatgggaactaaatattctctttaaagatcaaaaacttcaaagaagatggaagttttatttaagccttcagatccccatcacttgtggatcacgcagctttaaaaaacattctctgccctcattcttctggaagattgagaccttcctctcgcccaaggacacatcctctcttctctgttttccccttgttggtttttcagtgggtgtgacagtcacaaaataagggttctggagaagtttgggagaaagggcatcatcctcatcacctagggctgtgctcattctgttggagtttgctttcaacaggtttctttaggcaatccgatcacttcatgttcctccatcagatttccttctcttaatcctaattttttgtttgctgctattattttgataaaactacaacagagtttcaaggtagttgatttatttattttatttattttttatttatttattttttttttgagacggattctcactctgtcgcccaggctgaagtacagtggcatgatcttggctccctgcaacctccacctctcaggttcaagtgattctcctgcctcagcctcccaagtagctgggattataggtgtgtgccaccatgcctggctactttttgtattttcagttgagatagggtttcaccatgttggccaggctggtctcgaactcctgacctcaagtaatctacccacctcggcctcccaaagtgctgggattaaaggtgtgagccaccagacccagctgatttcttttttattattaaactatgaaatagttgaagcatacaaaacagtttagataataatgttacaggcacccatatacctactgctcagatcaagaaatgaaacattaaagatccaagcaaagccctggccccattacctacccttccacttcacagtaaaccactatcctgacatcagtagttatcaatcccatgtaggtttttaaatattttctggatgggcttatgaccataaataatgtagttttttaaaggtttacataaatggatttagagggcatatatatccttctgaaactcaccttttccattcaacattattatgttttggggatttattcatgttgatacacgcattgctagttcattcattttcaccctcatatagtattccattgcacgcaaaatactacaagttatttctccatgtcagtatgtgtgtttcctttttgtttgtttccatgacaaacaatgttatgatgagcactcttgcattaatttccttttacacagatgcaaagtttttcccaggggataaaaccagaagggaaatcacaacctagaattgtggggtgtgcacagcttcaacctatctccaaataactgcaaatagttataacaacttacactcccaggagcactgtatgagggatcctgtttaactatatcttcactacatttgtcactttcagattttaatgtttgtaatttgatggctatatctatttgttgtgtgctttcacctatcacttacataatggaaaagtttttacaagacaaaacaacttttaagatatttactggatgtgaataataaaaagacgattccacgaaggtataaacaaaccccgaaaagtagtagatacatgtccgtatgtgttatagaatgcatttttaaaaagaaatttccatctgtatttatgaaatgttggtttctgaggggctggttacatctatggaaaggatcttggtcccttaaactgttccctgaagacattctgcattctggaaggtaaatcgagtcctggacttcatcaggcagtgtgcaagaagcaccaccaccacatggcactgatggaagtggccctccatggctcaaattgtgaccatagtttgaagacactcagattaaaaaagttaaatggaagaaagagcagaaacagggaaatcagctttgatcaactgtatccacaattggctttttcctccctgtaaatataataattttaatgatacagcatttaaaattatgtaatcttttagggatcattattaagaccaaatacagcttttctgagcttatcccaatgggtaagcctgaataaggggtagaaggagatggtcttaagagatgctcttcaaaaatctaagattgtccttgtgtattttcatagcaatctctccattaaaagcagatatctagagaattgtcttttttcccctttttgtatatttaaatttctaatgcttacatgattatctgggtgatgaatttaaggtcatttttgttttattcattatgctttttggtttgttgcgcttttctatacagcataactaacacccaatatatctattttttaagccccataggatttaaaatacaaatgactcaattttctttccttttctaggaaaaaaggtgaagggttggtaatgatgataaacattggttgtttctaaagcacctcttttctaattatatctgtgtatacctgacacagcatgagatcatttattatccacatttcctagttgaattatagaattgttatagatcataggctctaaaaatcaaaacacatttgaagttcctcatggatacagatggtgacttcctgttaggaagaacacaacagttcagaatcttgtctagattcttctgacacaaaagaggattatattgccaaagcttttaatgtgtgtgatggggagggagaaaagggaagaggagggagatgaccttgagctttggatttactatgacccacttctaggtggatgacaactgcctttgtggatctgagagaccaaagatttgaaaagaaaggacttatgtggaaagctttggtaccagatttatgccacatatcccagttttcttttgctattcgagcgtaaaccaaaaaataatttagcctaattcctgtaggtttaataatttgaaactaagtaaataagaacattaaattaatcttatgtttctacattgcatgactttttctttttgttgttgttgttgttgagactgagtctcgctctgtcacccaggctggagtgcagtggcgcaatctcagcttactgcaacctccacctcccaggttcaagggattctcctgcctcagccttctaagtagctgggattacaggttccaaccaccacacccagctaatttttgtatttttagtagagaaagggtttcaccatgatggccaggctggttttgaactcctgacctcaagtgatctacccgcctcagcctgccaaagtgctgggattataggcgtgagccaccacgcctggccaatctgcactgcattacatttaaacataaatcaggttttgggaaatctgattcccaaggaagaataatttacttttagaaggactggaattttaacccagaaacagacctaataatttggcattcaacaaaatataactttttcccattggacttaaaaggtgatatggggtggaaattgctgtttaccttaaaaatagtttgcaagccaaacgttctcttctaggcctatgaacaaattctcctagcataaacttctgagagaaaacacttccaattatctaaaaacaaataattcctcttttctggctatattaaactctctatgcatctttctcccaaacttcaatgtctcactaaaaacaggcttttatggctttccctggagaattatcttacaaatcaatggcatagcttcaataactctttaataactttcctgtcttccaagacaaaaatgatcagtgctcttcattacagtaaacccatttacaagctgctgtgtcatctataaatcccttggttagagaccaactatatatattttaaaatagaatgttagaactgagtgtgtcttagagttgatcctactcaggctgcataatcaaatcccctggacaggctttgggaatactgatgccagggtgtatccacaccaattaactcagagccaattaatcaccaattacattcatttaaatcagatagggcccagtcaccaatatttcttaagagtttcccgaccaggcacggtggctcacgcctgtaatcctagtactttgagagactgaggcgggtggatcatgaggtcaggagattgagatcatcctggccaacacagtaaaaccccatctctaccaaaatacaaaaaattagccaggtgtggtggtgcacgcctgtagtcccagctactcgggaggctgaggcagatgaatcacttgaaccagggaggcagaggttgcagtgagctcagatcgaccactgcactccagcctggcgacaagagcagactccgtctcaaaaaaaaaagtttccctggtgattctgatgtatagtgagggtcaggtaccactaatccagtccaaccacctcattccacaggtaaggaagctgaggcccagaggtattaagtgacattcctgaagtcacataggtaattaggcatgttgccaggattagaacccacatcttcagattctttcttctctattacattaccttctttcataactctatttctccttctgagattacatctcagaatttgattccaaaaagggaccacaatatggacccaattccctgggagctcccagagacctgctatctaacagccagtctgactgctgcttttaccctaggagttcactgctgtcaggacaaccatatcaccctgtgggctggaacacacctccctcctgccatcctcagcagaaaacagcatcttaattctcaatctatattaatggttttctttattgcttctaccaacccctgtcctctgatacctctctttaaaggaaataataacaacctcttctaaaaaacttcattcggtggtaaactgaatttccagtgtagtgatgaactaaaagccttcatataaagaaatggcttcagggcaacttcttgaggaaggaataatttgctgacaggtggtctgaagctttgctttcagcaatagctggaccgaggactgcagaattagagcagggacctggaagcaggtgaggctcctaagtattgggtgtcccattgcatcgctggccccttcccagattctggaaagaataaacataattgacaaactagggtttagtgaacacctcctggtaaacacgactgaaggtgtgaaaactcctcaagggccatctcctttgcatattctgccctatcctatgtgcacatcccaattctactaaactattttaaaataacccaaaaagtgtttgttttaccaaaaaaaacaaaaatcctttgggggcaagaagaaaaagacagctgacttgtgagaataaggcatcagaacaacgggagagttgaatgatcactggaccaggaatctgaagacatccattccagccttgctgttgccactcatggctgtgtgtgttgggaaaagtccatgtctctgggcttcattttcctcataggtaaagctcagataatacctaacctgactgccccatgggctgggttatgaagatcaaataaagagacaattaaatgtagagataatttatataaaagcatatttataataagctgcacattaagaaagaacaaagaagatgaagtctgtatcaccagataaattaaaacattcagcactaaattccaaaacaaaagagctgattatagaatgattcagcaatataatagcatgcttaacatcccaactgtaagtcagacagacccggaatcaaatcttagctgtgtcagtttccctctctgagcctcagtcttctcatctgtacaatggaaattatggtgggatttaccttggatatttgacaaggttgacattagataattacataaagagcttagcttagtggctggcatatagtaagtgctcagcaaatgttagctgctggttattgctatcatcatagctgttattgtcattacttcccctacctcacagggtggtggtgaacagttaggaacagatttttaaagcagtgacaaatagaaatcattcaagagatggtcatcattactctacctgagtcacgagctctccctcctgacagaggcagaaatattactaaaggcacattttcaaactcttcgctttctcaccaagagatttccttttgacctggtccaattctttattgactttgagtaagatcaggtagactgtgagagttctagttaaccaccctcacatttctgtcacaggcacagcaatcatccatctctaggggccccagatgctaagtgtatttctcaaggcagaagcaggagttggtccccttggtattagctctgtgtcctacaactaaattagggtggccggcagggatccagctgattagcagaattatcagacaccacaggcaaaggaaagaaacaaaggatcgaagttatctgaagagcagttacagcctggcgcggaggctcacgcctgtaatcccagcactttgggaggccgaggcaagtggatcacctgaggtcaggagtttgagatcagcttgaccaacatggtgaaaccctgtctctactaaaaatacaaaattagctaggcatggtggtgcatgcctgtaatcccagctacttgggaggctgaggcagcagaatcacttgaacctgggaggcaaaggttacagtgagcagagattgtgccattgcactccagcctgggcaacaagagtaaaaatctatcacacacacacaaaaagagctgttacctgaaatgtggagttatgtgctgtgtctgtgcatgacaaatcactgatcctactgatgtgttcacttgaacagagaaaacacaggaggaaagaatcacaaaaagttaaggcataaaacacttgatgtgaagtttcacacaaaacacatgcaaatataatatgaataatattctctgaaagtgctagaaatgttagttgagttctttgctctgttaaagttctataagtaatgtgtatagagacttattaaatccaaatgaggaaaaaatgaaaatgaattaagatcattcataatcaaacctcccagagatgatgctgttaacattttgatatactttcatacatgttcctatctgtgtatgtgtaaaaatagaaattttccccaaaaggagttataataactctagttaattaagtcctttaaaagcacaggggaagatagaagacttaatgaattaaataacaataactagtttctcattttgattatcatgtaagtaaaatatatgaaaacatagtgtttgtcctttagcaatattgacagataatatttataagcacttatattgtgccaggcacttccctaaagtctatatacaaattaactcctttggttttcacaactgctctaggaagtaggtactgttcttgttcctgaagacaaggcacagtaagattaagtaactttccccaaagtcacacagtagatacaatgctaaactagggctagagcccatgcagtagggctccagtgtccatgtgcttaaccaccttcctatgatgcttcttgacagaggtccaacatcgatgcagaattggaaaggagtaactcccttgtgcttatccatatcttgggagtgaataatatagagtgattgctgagctaaccataaaactgtcaaacatgttgaaaatcacaacgcacccagatcatctaggaaataaatactgattaaaataaacagaacttgcatttcacaagcaaagacggaatgatggttgtcttggaaggtgggatagaggtgtgcaatgcagccaacacgagcttttttcagggatgcactgtctgtgtttaggtttatgacttaaaggttagactgccaagaatttttttaaaggttgacacatctgtggctgcatttccccagagcaccataaaccacagtcttgccaaaattaaataaaaggattgactgttcttcttcctctgccttaagaatgtcaccatttgaactgtgtggggaatacagctactatgaactcaacattcaggaatcattttctgcttgggttgtaaccagaactccttattctgtgactgtggtcctactagtcccaaagggccagatgaaaggagattcaaacactcatcccttccaataaagatttggaaaagacaaaccatgtggagctaggaaggcacataattctatcacaggaactgcctatgatggggtctacctaaggttatgccatgtgtaggtcaccagagtgaccaaagaaaagtaaaattaaaaagtatttttatggcatgttatcagtacccaatgggaaaagggagcaggagagagtatcttaatcaggaaagctaacaactacaccaaatttccccttcatctccgtagtatcccacagtaacagtttctttctttctcatgttacagtgggaagcaaactggcactggtggagggctgtgctccacgtagtcattcggggcctcgggtctcttcttccagtggctctaccatctcccgggaccccaggatcctctgctagatccggtggacaaaccagcagaggcagaggaaagaatcacatgagagatttcatgaaggcaaggccagaaaatggctgcatcacccctgcctatattccattggccagaactcagtcttctggctctacccacctgaaagaatggctgaaaaatgggcccagaagaaaagaatacaggaaagacagcattatttctgccaagaggaggggaatgaaatcaatccaaattttgacaaaacaaacagatgagcctttacctaagtcactggcagatgcggtgcttcttacggataaatcaatctgagggctgggcgtgatggcttatgtctataatcctagcactttgagaggctgaagcaggaggatcgcttaagcctaggagtttcagaccagcctgggcaacatagcaagaccccgtctctaaaaaaattaaaaatttaaaaagttagccaagtgtggtggtgtgtatctatagtgccagctaattaagaggctgaggtaagaagttcattgagcccaagaattcaaggctgcagtgagctatgatcgtgccactgtactccagcctgagcaacagagtgagtccttaactctttaaaaaaaaaaattgagctaaggctgaattatcaatcaattaagaatgtcctaccctgcatatctttccatggctctgcccaacatgatatgatggtcctatgttcctctaggccagtgcttctcgacagggcagtttgccttggcaagggacacttagcaatgtctaaagatatctttgattgttagcttaagggaggggtgcaacagccatctagtaggcagaggcccgggatgctgctaagcatcctatgatgcacagggcagcccccacagcaaagaattatctggcccataatgtcagcagtgccaaggctaggaaactctgctcaaagtcttgaatgtagggccttgttcatgcatctgtcatgacacttccattcatgggccatttttgagtacctgctatgtgccaggtgcttcacttatcacatggtcattgaatagttattttcatatttcttcttcccctcccccacaagactgcaagggacagggtaagaacaggattggtcttagcacataatacatgtcgaataagtggatggatggatggaaggatgactttgtctcctgaaccactgcatcccatgctctgaccctttgagtatatgaaggaatttggttatcaagacttgctattctgaatgcctaacagaacaagaaggtgataatctagtttgttcttaagaaacccaatgttcaaaggagcacatgacctaagaggctggtaatgaagcacaaagcttcaccttagtaagtgagctgatcacaaaacttcacgcagacccaaagatataggaagttgtatgtacctatgtggcagtggcttggtgaactccatttgatccgagccctgtataagcatctactattccagctccaataacatggcacctgaggataggcacaatcccaaaagtgcttgtcatttgaggtctgtccattcaagagaagaagagccccttaatgtcatgtctaaaatagaaatgttctatctatttggaaattttataatataacttcagtttcaactcagcaatgccaggtagaaatgggagaaataagcaccacatatttacaaggatgttgaggaaaatcaatctctgaaaaggactatgtgtcaaggatctgtgaccataattaacaattgtttttgaaaatctctttttaatcacttgtgcaagtgctggttttgtgggagatgactgtcagctaccccagctctggcctggggctacctttcagcccatccctcctagaaaaaaggttctcttaatggcagggagtccatttgatcaaaatgtaagttcacgaggctccttgcctggctttgtccccttctcgcctcatttattccactgcatctgttttcccacataagagagcagaactctcacgcacttctcacaagcataccaagaagagatggaaggcattgatacatgcatgataatcaaaacacaacctcatatttgtaaaatattttgcaagacagttctattatatttgttattttatttgatcctcatctttaggcctatagttctctcattacacctttcaatgatttgaggctttattggaataaaactggtaactgtacaaaatatggtcccaatacattctactccggggaagctctgctacgttgcacaccctcgtgctgggtaggaagagaactaaatttgaaattggagagcctggctccatccaattctgaccctgtcacttaatagttctataactctatttatgtcattaattttctctaggactgcttactcctgtgttgagcagcaattatgctgcctgtcttacttccccatcactcttaaaaggattcaatggaataaaatatgcaagagcgtttggtagtgtggtgccacaatttcttcccagaaatgatcaatgtgcctctcagatactgaatgtctctaacccgggtagacctgctagaaaatactacaaataaatttaattatataaataatattattaagcaaattaaatgctgcatttttcttcagccaatatctgaagatttcaaaattaacaaagggacaaaggagaatgaatagaaactgctatattctatttcatatcatggcttttttaagagactgtggtctcactatgttgtgtccaggctcatatcaaactcctgggctcaagcaatacttccactttggcctcacaagtagctgggactacaggcatgtaacagcacactggtcacagcttcttgttgttcagcaatagctcaagtttaacctcagtcaccttttgccaagaaaaaacaatgcaagtaagcattttaaaactacacacttcaactgttctagcagttttctctcacaagacaccacaaagctgggatgatggagggatatctatggaccatttgctgtatttttcctctttttcaaatagccaaataatacctaaatatattttcaatctataggcataaggtttcagttacacaagatgaataggctctagagctctgctgtgcagcattttgcctatagttaacaatactgcattgcacacttaaaaatatgggtgtatatctcgttaactgttcttaacaaaaaacttaaataaattttttaaagtttcaaataattcaaaattatacagagtaaaccagaaagcctccatagccccacccatctttccttccccaaagtaacccactgtttatatcctgccagacttctttctgcagattaactgtatgtgcagtcataagtcatagattttttttttttttttgagacagggacttacttagtcgcccaggctgggcagtggcgtgatctcagctcacactgcctcctcaacctcctgtgctcaattgatcctcccacctcagcctccatagtagccgggatcacaggcacatgccgccatgcctggctaatttttgtattttttgtagagatgaggttttgccatgttgcccaggctggtcttgaactcctgggctcaagcaatccacccatctcggcctcacacagtgctgggattacaggcgtgagccaccacgcccagcccagccacaggcatctcttattttgttttgttaaataattgggatcatgctttacgaattgttctacaatttgttttttaaaattttctagatttttccatgttgtacatgcccatccacctcattctttttaataacaaggttttctgttaggtaaacacccccaattttacttatccctattgataacaatttggtggttcccaatttccacgatcacagagctttgctaaacttttaaagttaggttgctaatagactccactttattacctttctcgggattctacctgataacaacttgagcaaagttctttccagtatccccttcctgccccagttgcctaatggataaggcactggcctcttaatattcccttccccactagtgataagcatgaaaacagggcgaactcaatggagccttttaagaagaggctgaagagagggttaacaggctagactcaatgctaagtctttcaaactacacccttattcagtgttaacagcaggtgttcaatcagccctatgtttcactcacagagagaacgggcctttacctacagactttccatgttaaactaagcttcaacacttctcactcccctctctcagacagtggtaagaccaaaggaagaagacaagcatgtgaaaatcctggtgtgccataaggaatcatctacacatttaagctaggtcttgggttctataaaagaactaaatagattgatattgctagagtcttctaaaagagcaaaactattttcacttgaaatttccgaattcaaacatttgttgattatctactgtgtgctgagaggggctcaaaagtagtgtaagatccagccaggcacggtggctcacgcctgtaataccagcactgtgggaggctgagggggcagatcacttgaggccaggagtttgagaccagcctggccaacatggcaaaaccccatctctactaaaaatacaaaaattagttgggcatggtggcgggcgcctgtaatcccagctacttgggaggctgaggcaggaggattgcttgaatccaggaggcagaggttgcagtgagccgagattgttgcactgcactccagcctgggtgatagagtgagactctgtctaaaaaaaaaaaaaaaaaaagtagtgtaagatccaacctctgccttctagaaactataaaaacagctggggagatatataaataatacaatacaaatattatacaatacaaataatacaatacaaatattatatacaaagatatataaataatacaataaactaacaatgcaaagtagtccatgattaggtacaaaaatgaatggtgcagacaataagtgctctagaaggaattctcagtagcagtaaattaagggaagtaatagcaaacaagtcattgtgattagggccctcagcattgcggtgagggcttgaagtgcagaattagttgatgagtgctatttgttatatagtcataaaacagtaaattctgactttaagagacacctggacaaatgaatctaagcataactgcacacttgatgggaacaggaccagaggaaatcgtgctccaagagatgaaaaccggataaatgccacataaagattcaacaaatgcccaggatccctcaaccctactccttctgcagggcaaacaggctgcaagggacttctcttcaaagccttctcagagggatcagaatttaagttgaaagcacttctcctctcctgcagcctgactgtgtgtaagatacagtcaaaaactatcacaaagcccctactatgccctagcttctagttagaagataggtaaagaagacacgacctgccccaaaatcatccacaagtatctgaaccacccactcaaactgaggctgccactcacaggtgtcctgaaccccaattagcaaatggtagagcccggactcattttaaaaaaaggagcagcaggagaacatatgcacagtgtatttctgtaggccaataaaaaagagggtgttatgaaagatttcttgtttttaacttactgctattatgttgaagcctgctctggtctatggggcctactagttgcctactagtttcttctaattctatggctggagtgttgcctatagatgcctattatagaactagtttccattttctttctccatttaatgcaaaaatagtctcaatctaagcccaaaactactcatctctccctgcaacaaactactcaaaaaaaaaaaaaaagaataaaagaaaggaaggaaggataggagaaaaagagaaatttgacagtagctactgagaaaaagagaatccccgtgccacttcagtcctgagtttgtataatgagagcacacagtgagggagaaggtctgaaggctactgtttttagcttactcccacagaagtggcaaaggcatatctgcctccagaaatattagaggaaaaatggggagaagcaagacactgaggtttgtctctcactagaagtcaagaaaataggaggaacaaagtgttctttgatgccctggcagcggggagagatggcaatggtgtagaacggagctgatgagaggcagcatagactcgtttttagagcaaactcgactcctttaagtcctttgccgtcaactgtcgatcttgtataatagccgactgtattatttctttcccttaagaatagacctttgttctatagagtattgcacccttgaatgtttcagtactagttactataattaaaagaaaggcacaaaatactatatatgttcaaaacaaagatgaatcaattattaaatcatcttttctaagaactcacccatctataaataaaacatgtttggaaaacaaatattttcctgcctctgctgtttttactttcagtagcattaacttaaaagatactacttcagcaatacttttctcaagaaataaaactcgccaaccctcttgcttttaagctacactgctgaactccttctgtgggattggactctgctcaagggaacatgtgctcattaaaaatatttcatgccattaacattttcactagaagattcggagtgtgtgatgtctgtaatgccggctccattcacacccattgtccaccccataaacgtctaaatgacagctaatatacaacatgtaaatcactacaaaagagaatcgcgcacagaaaactggcacctaattacatgtcccagagcatcactccctaaaatacaaaaggtctgattgttttatttattttgtgatagatttggaatgaaatcagctcctctaaaataattttgtcatgaaagggaatgtttaacgccttacaaaagtgacatccttgacaagtcagcttggttatttccatgactttcctttccatgcagtgcaccagtgcaacttccggatgcccttccactcctgaaaatgctgcagcccctcccttctcagagctttggtccagacaattccctctatctagaacatcctacccaccctcacctgattaaatccaattcacctttcacatctcaattcaaaagctacttgtgcaagacagctttcctgactagccctcctaccccaagtctagatgagattcttccgttgtatgtgttctggtagcttcctgtgctcatgtcacagtttgtacagtcattatataactgtgtggtcctttcattaatatccatcttctacaccaaactgtaagctgtgtcaagacacagactatgcctgtttggctcacactggattcccagagcctaacacaatggctggcctatagtaggcactcattacatttgctgaatgaataaacaaaccatatcacatcctgacactctaccgtaaaaaaaaatggtcaggtcaaataaaggcacagtgaggaagatatttaatagaaagtctgttctgaacattgcctagtcaactggctctacatactatcagcactagtaaattgattgttctcaggtgaatctggttgtatcttgatctgtgctatgatgacaaccttgacaaaaaaatcagtctaacctaagggtagcataataccatagaaggattaggttcagcatcatgttacagaaaacccaaaataacagtggcttaatcaagaaagatatatatatatttctccctcgttgtaaacaaggtctatagaagttacccaggactggtatggtgctcgatggtgataaggacccaggttccatctatctttttttttttaatttattttttagatggagtctcactctgtcacccaggctgaagtgcagtggtacgatctcagctcactgcaacctcagcctcccaggttcaagcaattctcctgcctcagcctcccgggtagctgggattataggcatgtaccaccacgcctggcaaatttttgtattttcagtagagacggggtttcgccatgttggccaggctggtcttgaactcctgacctcaggtgatctgctcgtcctggccccccaacccgcctgccctgtacccctcggctgggagtacaggcgtgaaccaccgtggctagcccaggttccatctgtcttgctgctccattctctgtagcatctgcttctacttcatgatccacaatggctgctcaagtccagcaatctcacccaattccaggcatcaggaagaaagaatgggataaacaagggtaatgatccccattttgtgaaatttccacataaatcctcttgccagaatacagtcacaaaggcataactggccaaaaggtaagctagaaaaaattgtccttttttctctttgagacatggtctcagtcacccaggctagagagcatggctcactgaagccttggccacccgggctcaagcaatcctccaacctcagccttccaagtagctgggactacaggcatgagccaccatgcccagctagtattttattttttgtagacatggggtttcactatgttacccaggatggtctcaaactcctgggctcagccatctgcccactttggcctcccaaagtgctgggactgcaggtgtgaggcactgtgcccggccaaaaaaacagtctttaatccaggagaaacataaataacttataaagaaaggaagatgatattggggaacagtcagcagtttcttccacagattactcaatgcaagataaccaactgtcactgagttctgcaacgtgtcttggttttacttttgttttctatcttgataaatttttgcaacatttacactgtcccaaaggcagacttaacatttcacattttatagacctgccagttctattgcatacctttcttgctttagtaactagtttttgggagtttcactatctcaatggatttcatactctgaaaaacataaaaatatgaccaggtgaacacctatgtaaaaactaatgcaaccaatctgcttcttctcaaatgtcttcaacgtagattttcaatcagatgaagggccttgcatttttctgcaaatctctctaatatattcccttataatatatgcatttttggtcatataatttctacatttcctaaaataagaatagttgaattaatgtttatagaagaaaatctagatataaatatatatatattcaagaggtaaaccaggcatgatggctcacgcctgtaatcttagcattttgggagccagaggcaggtgaatcgcctgaggtcaggagttggagagcagcctagccaacacggtgaaaccctgtctctactaaaaatacgaaaatgagctgggcgtggtggtgtgtgcctgtaatcccagctactcaggaggctgaggcacgagaatcacttgagcccaggaggcagaggttgcagtgagccaagatcgcaccactgcactctagtctgggtgacagagcaaggctccagctcaaaaaaaaaaaaaaaaaagagccaagccaagaccttcttttaaaaaaaacaaaaagttgttcagacttctaccactaagctcttggcatttcaaaaattaagagaaagagctgggtaggaagcaagatggaaatccctaaaactgttctaaaaacagcaatctagtgacactagcaacagttgctagaagcttaaagaaaacctccacaaaattgctagagatgcttcctcacttgtttctagcaagtctctctctgtgggtgacaatgttggtgcccagtttagattcagtgtctctacagcagtcttgaagcaagttttttttttattagccacaacatgtaagattttactgtgaacaaaagtcatctcagaaagccagatccaaggacatggcatactagataataaccaaatctcacagttcgatagctacctccccacttccccacacccccaacaccctctcttaaaagtaattgtctgctctttgcaatcaggaagttctacaacaacccagcctatgatcaaaggcctctccatcagctttccccaaatgcataatccacagctggcaaagtctcagaagcatcttactgaacatgaataaatttgatttttggactgggggtatgcaaaatcttgtaatgcagcccacagtaatcatgcattttaagtctattcctcctttccagggcacatcttctctctttttggctctgcatcctctttctgaggcctaccaagagatcggccctgaaaaattaaaggggaatgtcctataaccagaatagactcccagaaaagctaacatcttaaaagaagaaaaggaaaatagaattaaatttgtcaaagtatgaggatgctaataaattctacacacacatacatacacagaggacttagtcgtcaaataagcttaggaaacactgattaaataatgcaaagggtttctttcttgcagaccttctcagagcctttaatactgccactatgcatcatggatctccaagaggggcacagtaaatagattttctacttgaactcttgttcaccagaacatcttatattaggcaagcactctgtagaatactcatggaaaaatgctggactggtaagaaatatatcaaaattaaatagcaactatcttgggtccagaagtttatggtaattttaattattctatttccaagttctctataatgaacttgtattgcttttgcaatctggaaaaagttatgtaaaatttaaaaaaaacatttgaatctatattaacatttttaaaaataagaagtttcagaaggtaagatttttcttttttctaagaagtagaggtacttattgttctttaagatttattatatgcctccattgtgccaggttttgatagtaacatgagaataaaaaggaagaatcatttcaatgattcactacatagtgctggtggcctgaaagaggaaaagaaactctttaaagagttcctcctctgctaataaataagccaaaaaccttcaaacataataaaaatacttgtacaatattaatcttaaaaatacatattactgtgcttttcttcccaaaccatttaaaaaaatctccctttaggtttaatgtcttgattaatcttttttaaaatagtctatatataaaaacttgctagggtgcattataagtaaaactttatcagtagatccttgttaaactttattacttattatttcatcaatttattgaatgccttttatgtgccaggaaatgcactattattgaaaaattcaatgaaaacaggtccttcctcatgactagtttattttagtagctgattatctaaataaatttaataccatttactaattgataaacagtacagaaaagttataacagatctatgtagcaaatattttataatataatggtattttataatataatggtacttcatttcagtttgataatcacagcaacttggacaatctagaaaagcaaaatcaaattttaattctggccaaaggaaaaccacgttcaatatgcttgatcctaaggctccccacatttccagttataccaggtttctcaaaagagacaggaggagccagacatcaaagtccatctccagccaacctacaaaccactttcttgctaaaacatttctatccccaattataaccacaatgactagattaaactggtatggccacctctctaggttcaccttaaaaaaagggctcatcttctaaccttaccaggctgttccccctatggaatattcttaggcaatgctggaatggtccccgtctttccagctgagacgaaagtcaagaatggttaacaggacactctagtctaggagagttgggacttgactcacctatcaagagaggcaaaggacatgcttttatttacctgggcctcaacactcaagatgagaccagaaagcctcagagtcatctctctacagcccaaaggggagaaacaggggaattaagtcaggaaaagctcaactgtcagacctgtcagtccgccaggctaaccacaaccagatgtaagggccacaaataggcacaagttcctttgcttccagacctggataaagagatcacattctgtgactagcaacttaatcgcttaggaaaattatgttgccctgcctaattacagctctgctggaactcagtttctagaaagtgttgagatttcctccaatttcactgagcaagtgctctaatgattgcagtagatacacagaataatattagaaaagctctttatttagaggagtttccatgaatcaaatcaaaacaaaacaaagtccaccattttgaagcatttactatacatatatggtgactgcatatgtaatatgtttctagttcatactgctgaatgtcttaagaagtcactattccagccaacagcaggaagaaagactttaaaaaaataaaataaataaaacccttaaagaacctaagaaacaaggaatccaatgtcacaggaatacagctttaggacaaaaaaaaaaatgtcttaaagagaaacttgggcctgaactctacattttgtatgtgttaactgaatccatgctaataaattcaagtgagttgggccttcctaaaactaacataattaaaatataactgaaaactcagaaaacctgtagaggactatcttagtccacttgagttgctataacaaaataccttagactggatataaggttaacttataaacaacagagatttattgctcacagttctggagactggcaagtccaagatcaaggtgccagcagatttgatatctggtgaaggcctgttcctcacggatggcaccttcttgctgtgccctcatgtggcagagggggcaaacaagctcccttgggcctctttcataagggcacaaatcccattcatgaggcctgagccttcatgacctaatcactcccaaaggctccacctcctaacatgatcacactggggattaagtttcaacatatgaattttggtggggacacaaacattcaaacattcaaaccatagcaaggaaggacataggacatatgtgtgggctccaatcaggggagttaagaaatcgtatagtattatgaatagacattgaactattattcttccacccaggaatgcaaacataagatgacatatggataaaagttagcgaacactcatcgctgtcatccaaaacaaaagtatcaaaaccaaatactcctcacaactgggagacccatctcaaagcacaaagaaattcaacccaacttaggtagctataactggcagaggaagcagctgctactaaagtttcaactttcttaatagctcatgtcagcagcaacacaaaaggtacagtgattttttaaatgcttggacaagactctattaagcaactacgtatagtgtaatgggaaaattgagttaaatttgtgcatcacagaatacaatggcaatagaagaaagccacttcccaccttcttattaatttagcaaagaagaatgtgtcatcagcctccagactggtcagtatataagcagcaggcagtattttttgtttaccttcctgtctttctgaatgatcacccaaacatccatttacagtgttcctaatattatttgctaatatcatgtctatttatggtcaccaaccacatgttgggatagaattggtacaaaataccatgtgtttcatgtgtcagaactcatctaccagttgaaactgttgcaggggagatagaaaaatggaagatgggaaaaatcacaacatttacaaagacagctcagcttacgattattcaccttctaccctatcaaatctaactaatgccaggctgtggtttgacaatcttttaaagagagctgactctacatctcaagcagtgatgctaattttctgtttagctatgtatctccgtgttctagcaaaatgacctatcatattccatacatagtaaaagcatgtgtataagtgggtgaccctgtgggtagccaattttgaatttacagttggccctccatatgatgggttctgcatctgccattggtttaattcaaccaaccgcaaatctaaaatatttagggaaaaaaataaaaaataataatacaataataaaggccgggtgtggtagctcatgcctgtaaatccagcactttgggaggccaaggtgggtccggattttgagaccaacctggccaacatggtaagacccatctctactaaaaatacaaaaattagccaggaatggtggtgcagtcctgtaatcccagctcctggggaggctgagagaggagaatcacttgaacccaggaggtgaacattgcagtgagccgagattgtgccactgcactccagcctgggcaacagagcaagactccatctcaataataataataatacaaataaaaagatatagtataacaacggtttacatagcatttacattgtattaggtattataagcaatctagagatgatttacagtatatgggagaaagtacataggttatgtgcaaatacgacaccattttatgtcagggacttgagcatccctggatttggatatctacaatagtcctggaaccaataccccatggataccaagggacagcagtatacatactcaacttagtttaagaaaacatatgaatattctgatttacaaagcagataaaattgagggtactcatttaccttacataataaaaaggccatttgctatagtcttttcccacctaaaggggaagggagaaacttaacagcaaagctgtttgtagggttatttttcctaacagtggtacaaactgcctgtcccacggaattaccatgaggccacattccttatctctatgtattactctattactctaaaacctctcgcatttagggaaaattagaaggccaggaaagtgaatcaagactgatcaaataaaagctcaacctaaattctttcagaaacattccaaaaactaagaaggaagagaaataaaatatattccctaatacagttctcagctatcatgtaaacccttttaccaaattgagagtagaaaacagataacaggaaaagggaggggtgaataagcagttgaactctatcccagtgcttcatccctaatgacctgctgtgtccccaaaccagaaaatgacatcagagacatgagcacaacatggccacatgagtcctgatgaagaccaggctttgaagaatgaaatgtaaggaagacatggggtgacagaggagagtcctcctataatcccatgaatgactgtgccctgcctacctaactcctagatttttatttttatttattttatttatttatttagacagtgatctcactctgtcacccaggctggagtacaatggcagcaacatagctcactgcagcctggaattcctgggctcaagtgatactcccgtctcagcctcccatgtagctaggactacaagtatgcaccactacatctggctttttttttttttttttttttttttagagatggggtatcgctgtgttgcccaggctggtcttgaactcctgacctcaagcaaatcatcctgcctcagcctcccaaagcactgggattacaggcatgagccacctcacccagccccataacccctggattcttaaatcattctgcccagccatccctacaatgggaccttgaattcccaggtccctgatgctgccaaccatctcgcttacactcaacagtcttcccaaccccctatgcaatcttttcccattgtagccaccttaccctgtgttgctgctagatttatcttcctgacacacattttctacacttaaaacacctacagtcattccccaggatcagtcactactcggagtgacgttcatgcattccctcatttcatcctcactataacactatgaggtacgtacaatattattgttctttccattttagagatgaggaaactgaggtacagcatggttggcaacttatccaagatgacacagcaaggaagcagcagagccagaattggaacccaggtgacccaacttcaagcccaatattcacactccccatgttctaatgtcaacaaaataaaatccaaacattcgagcctggcaaccaggtatctctgtatctttccagtctcgtttctctttcttcccctttgttccttccttactacctagggtgatgctgtccatgtggttaatatgggttgactgaatgaatgtccaggctaatgaacgagcagtcagtttttatttcattcaagcatggtccttatttgcaatgtcatagaaaaaaattgtttcagcttctgctcaggaagtctcatctctgaacatgacgccaggcagcaaagagatcgcacgagaacttattaggttaattattcatctgctcactgtcagtaagggcttccaagcaaggcagcgctaacagatctgcatcccagatgtgtaacaagtcacattgggtggggtagctgggcataggttgctgaaatatggcttcccagtccaggaaacagattccttacaatgtacccttttgttccctgaaagaaaatttagcaaccctgtcatagggaaatcacattgacagaagtcctgggtacttagagagcaaaaccaattcttctatataaattaggctttgtccagtggcaagaagtgggataaaatcaaaacccaaacttaatttgtatcgtgcatgagaggacacaaaccatttacacaaaacttctcacataattcccatagcaatggactgaggccatattattcccatttggctgatgaggaaactgaggtttaaagatgatgggaacacccaaaaccacacaatggaggcaagacaagaacccaaggctctctccaaatcaggcccaagggtcccagctgtgaagagtggtcactttctacagtctcttccccacacatacagactctgtcatgatagaggaaagttctgctcagttcagaccaagagtccaaactaggctggctgaggaatggaggagcccaaggtgaagcgggaaatggctggggacagggctccccgttggacttaaagacactcactccaacaagtgtgtgcagcaactaatcactagggacacggcctccctcctcatcattccccttcccacctccaccctccatcccaaaaaactacccaagcagcacagaagcagagaaaaagaaagtagcaatatccacacttgtccctcctggctgcctgcctactgctgctgcagggacagagtgcaaaacgcaattatctttaacctggttcgctttatgtgtcaaattggagaggggttctggataagattaaatttaaatgaatgaactttgggtgaaacaggttgccctttataaggtcggtgagactcatccaatcagttaaaaacctgaatagaaaaaaaaagactggccatcccaagcaagacggacttctccagcagactgccttgggagtggaacagcatcatcagctctctggggactagagcctgctggcccacactacagatttgagatttcctagcctccatgatcatgtaagccagttccttacaattaaaaaaattatatatatatattccttatagttcctccgtgatcatgtaagttgattccttataatttaaatacatacttatatatattatacatatatgtatatgtgtgtgtgtgtgtgtgtgtgtgtatatatatatataaagagagagattgagagagagaggagaaagacatagagacatagatatagctcctattggttctgtatctgtggagaactctgtctaatgcagggaccaacttgctatggaggactgctgtgggaactaatccttgctgcaaacataggaggctctctggggagacgagggggaggaagtcaaagcaggggtagcatgcggtgtccatgtggcaggagatactgaagtatgtgtagttcaggaagtggtgatggtgggggtgctggaattgagtaaaagttttgtttagggagaactaatagttttagctatgcatgaagaaagactcttgaaaattctgtaatatataagaaaagtgtggtatacagctgatcttggttatgaaaatcccactagctggccgagtgaggtggctcatacctgtaatcccacactttgaaggctgagatgggaagatggcttgaggccaggagtttgtgaccagcctgggaaacacagtgagaccccatctctacaaaaaaaatacagtaattagctgagcatggtggtgcacacctgaagacccaactacttgagaggctgaggctggaggatcgcttgagcccaggaattccaggccagagcaagctatgattgtgccactgcactccagcctgggcaacagagtgagaccttgtctcaaaaaatgtacagaaataaaaaaagaaatttttaaaagaaaatcccactagaaaacacatttgacaagtaatttttatcaagtcactaaaccttcttgaaatagggcaagatcggtattattaaagaggaagagcttcccagttttgctctacatgtgggagaatgtggtggccaccaacatacttttattcaaacagtacactgggaagcaaaaagtttttgtaacacagacaagaaaatacacaacatcttatttattttagagatgtaatttcagcaaacacactcaataaaacacataatctcctcatcagctgcactaaagtttatttttaaacagaaattcaaaatatttaagccataatcctatcacagctgcaggaggatcgtcaatgtagagttataggtttacattcactctcaccaaaatgtctttcattacagcatttattttgagaatatttatcatgttgataattaaagcaaaaaagtccatctacattttactttcattatcaaagtagttttcaaagaagcgtctaggtttaaaatacataagacagttattaagattaaaatttaaaagcatgtaatgaaaatcttaacatggaaagtgaaaggctaatagaagagtgctgacttattccagaaatcataatctactcatgaaattctttgtggtggcataattttaaaattgcattagacaatgacagtcttatcaggcagggtgttttcaactgcaaataacagaatagccaactaaaatttgcttaagcaatttggacatttgatttatctctcttaacaaaatctctagaggtaggtggtcctaggctcagtaggtcagtgaccaggtagttcagtggcttggtgatgtcatcgtaggtccaggctctgaccatcttctcgctctgccagccttggttgttggcagccatctccttgtgattgcaagatagctgcagtaacaacacatcatcacacaaggatgtccaaagcaggaaagctggggccagggagaggtaatgggtacatatctccctgcacctgtttcttataagggaggaatatctttcccagaagaccccagttgacttccatgaagtctcatagaccagaacaaaggcacacgctcacttccaaccaacttgtggcaaatgggaataggactgccactagcagagaagccttcattcattcatcccgaggctggccacaccgcagctgaatgcctgaataaaactgtggtctgttagcaaggaagaaagtgtgatgggcagttaagagtgcctcccaaatgtaggtgaggaataatagtttatattgttgagcacatctagtaccaggcaccttactatacaccttatgtgcattctctcatttaattctcactagctagaggccattattatctctatttctcagatgaggaaactgaggcacagagtagtgatacagtttctccaaggtctacacccagataagtggtagaaataggatttaaatccagacagtctgaccccagagccagctaagaatttacatgggtaactgcaaaaatgtagaagcagaaaagacaggtgacaaaggctacagaattcattttgggtggtaagttagttaaaggatggtaagttagttaaaggagaagagttgtaaagcccttcaaatttcagatgaaacacatctctcttcacccatcttcactgcattatgctaagaaagaagaaaaactcttgttaacaagctttatactttttcttttaaaatgtattttatttattaacaatatatttttaaatgttttttaaattcacatatattgctaaaaccataacaaagatgtttatttcttgataggtcttttatgtattttattataatacacgtatttacattttactatgcttttttccaaacctttttattggtttacactgtctttctgaatatgtttctgagtagcttaaaaacattccatattttgtctgttgttgtctatccaaattctttctcatttatcatcatcgaaataacagcacaataaatatctttgttcttacagcttttttttcctttagaataaattccagggagtgggttactaggtcaaagagtctggacaattgtgtgacttcttacatccactgctaatgtgttctccaaaagaactgaactaattaacattgctgccagaaatgtaagaatatactcgttttctgatatcacatcagctttgttttatttatatttatattagtttaatagccataaaatggtttctcattattttcttccttccatttctttgatttggagtggagtgtttttctataggcatgcttgcaagtatttcctcctttgaaaaatctgttcttactctttgcccattaatctttctggatcttggtgctgttgtgattcacatatttcaaaacaaagttggcttaattttatttctgcaaactgaatgcagactgaatgactggttcgtctagacttacacttgggcggacccaaattccagcttgtttcctcaacctcctaaatttcaacaactgaggcataaatgtcaatcttagctataaaaatatgaaaacgaaggtttccactacttattttttttcttcaaaagacatactaggactgctatatttgaaaattctaagagtaatattaacgtttatgcatcagtccttgttttcataagcaactacactctctaaatgaagaattattctttcagtatgggaacaatagccatgataaaatatcttttgtgtctttatcctaaaattgctaagtacaaaatcagagggggaataaagcagtatcttcagattttgttttgcttaaataggaaaaaaactccttaaaataacacatacactaaaactatttaatctttcagcaaaaaaaagaacaggcattggtatacaaacacttttggactccaccactctgcctgttatctatttctgttacctaaatattttttcccaaaccagaatccctaagagaaacttaaaatacagattcctgctccccgctacccgccccgccccgccccgccaaaggtctaacaaatcaaaatccttagggttgcatcctgaatatatatatatgtaattttttttttctttttttagacggagtcggagtctctgtcgcccaggctggagcgcagtagcgcgatctcggctcactgcaagctccgcctcccgggttcacgccactctcctgcctcagcctcccgagtagctgggactacaggcgcccgccaccacgcccggctaattttttgcgtttttagtagagacggggtttcaccgtgtataaccaggatagtcttgatctcctgacctcatgatccgcccacctcagcctgtctcacgccaggcataagccactatattttttaaatattcccccaagtgttcaaatattttagctgcaaaattctctttttaaactaaatctttataagaaccataagactaatatttatattgatttttaaatgctgctaggcaaaagacctgtatttactcttgcagtgctttgaaaagagtttctgaaagataatttacacccttaattaatcctttacctaaaaaagagtagaggccagaaacaaatatttttgactttttatagtacctgactgctttaaaagctctttgtaagctgaccgtaggcacagatcacgtggcatccactatcaatactcataagtctaatttatcctcaggatgttccctgaagtattcaggaattcttagtcctattacaaagattttgttgctgtgatagtggttttgtttgtttattcagaaaaataaaagtcaaaaaaacagctcctgtataacgatggtacaaccatgagtaattttattttttcaagcttttctttaacgtcttgaggaaatgatttttatacttcagggaaaattaaaagggggtcattaaaaaacctggtggcattcccaatttatctactgatggcttttgaattcttctcactgtcagttaggagactgacattatctcagtcattaagattattagaatcttattctaggatatcaataaacatagtggatagtttattaatgtattcaataatgtcaatgtccacattatcctactgctatatattatctacacacacacgtacatattccacatacgtcaataaaaatagtaggtggtttaataatgtcttcaataatgttgatttctgcattattctactaatatgaattatgctatatatatttattgcatatatatgtagaatatacatataaaaagaaacctgtaagaacttgagaccagaaagatattaatgtagacatctccatatgtcaattctttcctaactctccaagatattcccatgtaggtgtttaaatcacagaaaagtacttctgctggaatctcacctaggtaaagagaaagctctgcagttagttttgtcttctttctgtggcccagaaaaacaaagtcatactatgtgaagtgggctatgaggagatacagacaggcgactctatgtgggctgcaagtgaaagagttaactatttacaagcccactgatgcctccaacactggctaaatctcattattctgccttattccagaaacacactcataatccgcacagggttcttgaaagattacactaacgtttcttagcccagccacccacaatgggagtattctgtacacaattctgtaatacacaagcagtgaatcttctggcctcacgtaactaaaacaagaaaaatactcaataactcaacatggtatcatgctaaacttccaactccaagacgaggcacggtggctcacgcctataatcccagcactttgggaggccaaggcgggcagatcacctgaggtcaggagtttgagaccagcccgaccaacatggcgaaaccctatctctactaaaaatacaaaaattagccgggcgtggcggtgggtgcctgtaatcccagctgctcgggaggctgaggcaggagaacctgggaggcggaggctgcagtgagctgagaaagcgccactacactccagcctgagcaatagagcaaggctccatcttaaaaaacaacaacaacaaaaaaaacttccaactccagcctgtaattggccagaaatgtcagtactttctgaactatcctaccaaagtgtcctaacagcggaggagcatctcttaaatacaaaattaattattctcccttatggttatctttaaaattcttgcaaatgttctaccttagtgtgtgtgtatatgtgtatagacacacatacatgcatacacacacacacacacacacacacacacacacatatatatatttgctttaatattaaaatcatgtttcctctaaaagtaggggggaaattgatactgtaggagtatgttccaccttactgtgtgtgtatatgtgtgtatagacacacatacatacacacacacacacatatatatatatttgctttaacatcaaaatcatgtttcttctaaaactaaaggggaaattgatactctaggcgtatgtactagttgtactgtggcacttcatcatgtccccagaggggtgcacacctatcagattaactgccttttccaaaatgctctccttccatccgtgaaacacatctacaaatcaagttcctaagagttatttgtccaaggtgctgccctgaggcccaaggcaatagttaactgaaccagagaagtattcagctcagggcagccaaggagattccctgtccagagaatgtgagaaggagatgaagagtgagggtcagtctctctttggctgaacctgtagccatatgttccacaactatggtccaagaagttggaaaggcggtctttagaaaaggaaggaatgaagaagacactcagagagaagcagacaccagaggtaggatgggaatgctgcctgttcctcacagagccctgtctatggggttacgcttcctggggctgggctcccatcatttggaagctcagcttcctgagtagtcacctcagcatacacagaacactcatgtgagaaacacaagctaagtgacaaaaaaaggcaggcacaatagagcagcctggggccttattcaccaagagataaatcacttgctgtgggcacaccccaactctgaaagaaaaaccaaattaacaaccgtgcaagctcctatttggatataagctaggtatcccttcttttctagcaagaaggaataaacctaacatgacttgcattaaacatcatagttttggaattgagaatctgtaaattgtaagttatggccccaaaacaaaagaagaactacaggcctgcctgtgaacttccttttttctaggctgttacatgctttgctgttgccactgacagtgtggtaagaggcggccccctgggtttccccagccaggctgccccatcgaaggcagctacacagcggccaggacaagccagccagagccagtagggctggagccctgacaaaggcaacgacgctcctggagtcagataatgaaagccagagcaggaaggaccctgcgcttcatgtaagacgttcaccaaataaagaaatgtttaatcacgcatctgtgctgtacattgcaggagcctttgaaaagcgtaatgcctgggtgcagtttaaaaataaggaatcttaatctatctggtctaactttagaaaattgtttggaggggattcttaagatactctgaatttatactttcttaacaggggctgtcttttgtatatgtggtttgtgagaaaatgtgtgattgatctgtaatttgagcctcttttcaaagcttatagtatcattggattcaaaccattttcatttaatgctctagatggcagaacactaagacctaagcaattaaaaagggaaagatttcagataatgaactagtttctagtgactgtccaacagtggaccaggctcatttctaaatcactaggtgtctaaacttgacaacagttaaaactagatccctaactgtcaggagcatgagtacaaaagattcctgctgttctatgatgtgtttctgactatgtgtctttgaaaggcctttcaactttaatgctccaaaatttagatgttctccatataccaacggctttataaaaagtaaatgtaagcacacagagccaaaagacaacttgaacacaagttatctacatcaaagtaacaaaaccaaagtgcatttgtctttacaccaggaaataaatcaaattgagacagatgaacaggaaaaaaaatatgtcatgaacctgaagttaaacatctacttttcaggcttgaatttttaaaaaatacacttctaagattctttcccaagaaggcttcatgtatatacaaatacattaatcccccttagaatagatttaaaacaaaggccttggtgtttcagaaaatggcatacaaaaggggaggatgtaaggccctgtgtataaacaagtcaagaggctcgtatcctaagctaatcgctcctgtgcaatgggaggcagccacatcaccctagtccaggacttccatgtactcccagtaaattgtaaactgtcctgtaagggggcttcagccttctcatagatcacagatcaaagaccaagtctataaagagagaggaagaagaaaaaaactgtattcatgctttgggtgcctcaggaggtacagaaaagagagaagtcagttgatgtctccaaacctctacaagcagctcatcttcaaaaaaaaaatggaagaataggtgaaaacaccaatccaatccccaagaagaaagcactctccttgcacaggtttagtgtttaaaatttcaggtgcctgagcttaagcagattccaggactctcttggaggtggcagctatcactgtgtaggatttctttatagtaaaggtgattagctctctttcagatcattttgcaaaggaagtcagttggacaaatgtgagtaccatgtagacccacctgggaaagctaaatatttaccagttcagtttggtatgacagtagtttttaagaggtattctttaaaaaacaaattaaaagcacacagaaacacagaagttttttttttttttacttgattaaaagaatcaacaggcagtaacagtcagctttttagtgattattataaaacttcggggaaaaaaacaatcatgactttcttcagttcctttttcttttatttagtatcttaaaacaattcaatatttttggacaaattttttattgtgtaaagtatacataaaatttaccattttataactaaaagagtataattggattatttgtaacacaaaggataaatgcttgaggggatggatgccccattctccatgatgtacttatttcacattgcatgcatgtatcaaaacatttcatgtaccccacaaatatatacacctactatgtacccacaaaaagtaaaaattttttaatttaccattttaaccatctttaagtgtacagttcactgggattaagtacattcacattattatacaaccattaccatcattcatctccagaaatttttccctagcccatactgaaactccgtgccaattaaacaataacttcccattgcctcccccctttatccctggtaaccactattctacttcctgtctctctgaatttgactactctaggtaccttatataaatgaaaatcatacaatagttgttcttgcatctggcttatttcacttagcataatatcttcaagttcagctatgttgcagcatgtgtcagaattcccttcctttttattttttctttttatttatttatttattcatttatttatttttgagatggagtcttgctctgtcacccaggctggagtacagtggtgtgatcttggcttcctgcaaccactgccccaggttcaagcagttctcttgcctcagcctcccaagtagctgtgattacaggcatgtgccgccacacttggctaatcctttttttttttttttttttttttttgtatttttagtagagacaggtttcaccatgctggccaggctggtctcgaactcctgacctcaagtgatccacccaccttggcctcctgaagtgctgggattactttgggaattctttactaggccagaatttccttcctttttaaggctgaataatattcacatatatcacattttgtttatcaattcatacgtcattggacgtttgagttgtttccatcttttggttattgtggataatgctgctatgaacatgaatgtactaatatctgttcacctctctgctttcaattcttttggatatatacccagacgtaggattgctagatcaaatggtatttctatatataactttttgagaaaccaccacacggtttttcatggcagctgcaccattttacattcccaacagcaaagcacaaggtcttcaatttccccacatcctcaccaagatttgctatttctggttttcagatagtcacactgatgagtatgaagtggtatctcatttgtggttttgactggcatttccctaatgatcagtgattgctccattttcttctaaatggtgttgcaaaatgtgtcttcttgttttgtttcagtatctctttctgtaggatagaaatgtaatgcttgctctgagtagatattcatgaagtgctctgggagttctgaagaacttccaacacactaaaactaagaagccagggattccgttattcaggtctcaaccacctaccaaatcttgcagcctagacagaaagacattgccaagtttccttctaggctcttaaagactaggtaaagcagccttaagcacagtcctcctacaaaggcaataatgtaagtttttattgtctaggaagattaatgaactgggtgagtaaacatgaaaagcaggatggtcccaggactctagacccagggatgcaaatttgggccattgagtccagcattgcagctcctaccagaggcctcccctgagtagctcctgcttacttatatacatctgtgtccccctcccagagctaaacactaagaacacaacatagcaacagactcaaccttaagaataactttgtaaacctaagaaacaaaaacaaagttacttggaagatatgggagttaaaaatccagttttgagacaggtccttgttaaattcccccgatctaggttcctcttgtctagcccaccatgatttcccagacttctgcagataatctctttcccttctgcatctaagctgatccaacactccttaggctgcctgagaaaacttcactttcaaatcttttctcctttttgttaaactgtcgtcctccaactcatagtcattaattcaacagccaacaagcatatgccgcagactccaacgtgccaggtgctgagcttggcactagagacaccatgatgaataagaccaggccccagcaggaaggacttgctgtagagggagcctgccttctctaggttcttactttatctaaaatgctaatgtatctcctggggcatataaccaccttttggtcatctatagagtcacttgctataactcattgaaaagaatatggttgaggagtttcacatttgtgtgggattcccatgagtgtgactgttaatttgaggggggaaaaaaaaagaaagaaagaaaagaatgtggtccaataaagaacacaggctatactatcttatatgaccttgagcaaaatcactcatcagtggccttgcctgaaaaacggtaagactacttttcctagaaacagagacctaaaccaaacaatatttttaaaattttattattattatactttaagttttagggtacatgtgcacaacgtgcaggtttgttacatatgtatacgtgtgccatgttggtgtgctgcacccattaactcgtcatttagcattaggtatatctcctaatgctatcctccccactccccccactccacaacagtccccggtgtgtgatgttccccttcctgtgtccatgtgttctcattgttcaattcccacctatgagtgagaacatgtggtgtttggttttttgtccttgtgatattttgctgagaaggatggtttccagtttcatccatgtccctacaaaggacatgaatcatcattttttatggctgcatagtattccatggtgtatatgtgccacattttctgaatccagtctatcgttgttggacatttaggttggttccaagtctttgctattgtgaatagtgccgctataaacatacgtgtgcatgtgtctttatagcagcatgatttataatcctttgggtatatgcccagtaatgggatggctgggtgaaatggtatttctagttctagatccctgaggaatctccacactgacttccacaacggttgaactagtttacagtcccaccaacaatgtaaaagtgttcctatttctccacatcctctccagcacctactgtttcctgactttttaatgatcgccattttaactggtgtgagatggtatctcattgtggttttgatttgcatttctctgatggccagtgatgatgagcattttttcatgtgttttttggctgcataaatgtctgagaagtgtctgttcatgtcctttgcccactttttgatggggttgtttgtttttttcttgtaaatttgtttgagttcattgtagattctggatattagccctttgtcagatcagtaggttgcaaaaattttctcccattctgtaggttgcctgttcactctgatggtagtttcttttgctgtgcagaagctctttagtttaattagattccatttgtcaactttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaacagggaatcctttccccattgcttgtttttgtcaggtttgtcaaagaccagatagttgtagatatgtggaattatttctgagggctctgttctgttccattggtctatatatctgttttggtaccagtaccatgctgtaaccaaacaatttttaaagggaagttcatcaaatgcttttttgccaaccaaaaaaaaaaaaagaagtaaaaaagatagacaatcttttcttaaaaaaaaaaaatgtttcttttctaattgttttcttttctaaaaacataagtctatatgccaaagataaagctttgatgactgtacacaccctgtcttcttccatagtagctgttattactgctgagccttctgaaaagtgtttaaggagtgataacaagggaccctagagaatctgagacttttcgttgctaaacaaaaaatcagaaccacgcttgagatgttatactactaagacaacaggaacatttgtcacatatcaaacaagagacagggtctgctaactgcagcgatggccagaagagacagcctgcaagtctagttcatccttatgaagaaaacaggatctgaaaaaaactcacacctcgaaatcatctcttctgtgtgacgggacaagagaaaaaccgagggcaaaatgcaaattcacatgcaactagaaatcacaactaaaaatctgtaatgtatgatatgtgctaggctttacaataagagtctatgagaaacagcttacttcctaccagccaggacaaaatattcgcacactgttatacaaacaaatcttcctagccatacggtagttccctctgatacagcactctgggcagagagcaataaacaaaatccagacaggaagtagccagaaagaataaatggcagagctttctggcagtatcttcctgtagagaaacaagagacagctttttattttaataaaattatcttagaacccaggccctaaaattacttattaatatgattccccacagaggtggggaagttataaatgaggttgtagtgttttggctccactcctagagtcaacatcatgaagtgaactctatttactggccactgacaactccagaatcaaattcccatccagaatgaacaattttgacctaccccctagtgggtgccctttctgaagccttttctcattttaaggcatatggatttgtgctaacggaaattccacgtaaaaatttcaacctaccaaaatgagtgcattctttccacagaagaatgtttgaagaaactacagttgcttttaagttaagattgacaggtcaggcatggtggctcatgcctgtaatcccagcactttggaagaccgaggcgggtggatcacttgaggccaggagttcaagactaatctgcccaatatggtgaaaccctgtctctaataaaaatattaaaaattagccaggcatggtggagcacacctgtaattccagttacttgggaggctgagacaggagaatcgctttaacccaggaggcagaggttgcagtaagccgagatcacgccactgcactccagcctgggaaacacagtgagattcttttaaaaaaacaaaaacaaaaacaaaaaacgttagcaatacattcaaaatttactttcctaacatggatatctaaacaatacattaagcaagatatcatattgcatgatatgctctggtgctgtctgtgaataataatgcctctttaaaaggtgttgtgtcttccctgcactgggcccagctctcctgccacagcccctcaccccctgaaaatgtacacctgctccaagttcgtctccactccctccttggtcaagagcgcctcacagctgctaagccatctgctacctgcagtggtgctgaaatgaccagagacactgacaggtgagaacctcagcagcttggtagtctcacgtccccttacctcacttgtccctggccgcagcttggaaagcagcgccatttcaagggacatcgacacaacagccaagttcattggggctggggcgccacagttggggtggcgggctctggggctgggattgcgactgtgtttgggagcctcatcattgattatgccaggaacccttctctgaaacaacagctcttctcctacaccattctaggctttaccctctaggaaaccatggggctcttttgcctgatggtggcctttctcatcctcttccccatgtgaagcagctgtctccacctcccatatttctttctcccatgtcttgtcagccctgtatgtttcttttcctgcacctccccagatggcctggggaacatggttggctcagggtttgatagaggaaagacaaatactgtattaataagaaaaagaaaaaaaaaggtgtcaagtttgaatttgcctgaaagccacagcagtacaggaacactgaagggcaaatgtcactattccggtgtagcagaggctcctagctgtctccccaggatccatcttctctctcctctatagtaacagaagccttagctaggcacatggctgcctccctaaagattacatttcccagcctgccttgtagaaaattaattatgtgattgattctggctaacggaataagatgttttcaacttccaggtcatgttcttaaaagaaaggaggccagaagcccggtacagtggtatgcatctgtagtcccagctacacctgaggctgaggcaggaggatcactcgagcctaggagcttgagaccagcctgggcaacatagtgagatcatgtttcttattttaaaaagaaaagaaaaaggaaaaggaaaagaaaggagcctgccctcctctttcctacttccttttcccatagtgatagaagatggagcaactatcttagctgaaagatagaagctatgtggtagagatggcatagtaataaaagaaaactttatccccaacatcatggagtcatcttctcagtcttggtttgtttatgctcagaccattatagatgagagtaaaataaacttctgtgttctaattttgaccaaataagtatcccgactaatacctctcttgaagcactttgaattcaaccgctatcttttgttttgatagccattccttacgcagaaagcatcctggatttcttgaaaggaatttcccagcatgttttcagcaggcactgtcagagtttgatgatagcatcaacgtttttgagtttttagtatcatttttcacaatccttgaagtcagagctgcaacaaatagttcataacatggggtggatttcctccctttccctcagggcatcctcacagaaggagaaagtcttcggctctagcacccatccagtaaagggctagtcttgtcttccccatctctgtctctagccagagatggcaggatgctcctgggcactagaatccttcacatcatttataatatgggaacctttctttaaccttttccagactcctgagggtgattagaaaataacatttcccaagttcaagaaatcaaaacccatgactctatatccctgacaaaatggacaaaatacttaggtcaaagttaccaggtcagcttttataggctccttaaaaattatatggttttcttttaaaagacactaaaagttctcaattttttaatggtcattgccatttacaaaataaaaacgatagttggctcaatgacaaggacagtaaaagagtcagcagcatcttgggcacactgagaaaacccagtaaacctcccacagaattccgtcctcatagaaatattctgtccaacatcaaccctgaatcccactctagccaaaaattcaaataagtgcaaagacatcatgagcccattccacatgccaggtagctttttcttattttagacagagaaatgctaacgtacttccttaagtaacagcactttttttctttttttttttttttggtggggagggggtggggagacagagtcttcctctgtcagccaggctgaagtgcagtggcatgatctcagctcactgcaacctctgcctcctgggttcaagtgattctcctgcctcagcctcccgaatagctgggactataggggtgcgtcacagcaccagctaattttttgaatttttagtagagacagggtttcaccatgttggccaggctggtctcgaactcttgacctcaagtgatctgcctgtctcagcctcccaaagtgctgggattacaggtgtgagccaccatgcccggccagtaacagctttttaaaaatgaagttgtgggctacctcttttttttctttactgtctctgccttgtctaataaaaatgacagaacattttgtttcatgattctctatctcctaagtgtagagtttctcatatgcagagatcattataattgagaccatttatgaacaaagcatattaaatgttaccatgaaaatactgcaaaccaatgggtatcactttcctttaacacttgaaaaagcacataattccatgatgttaaaaagagagacaaaaaggaacgtttttaataatatttcaaccctttggctttattagcagtatgacataagagttctaatccgaaaaacctatgttttcacaaattgaaatcgagtagtaaaagccttttgtcacatcctccaagggctaaaatgtaaagcatatgacatagccctatataaaaatgaccttcagtaaaaataataaatcaaatgctcactctccaagcagaacgtcacaaactgaataccaggtaaaaggaaagctgtacatgaaggcgttgtgctttcgtgggaaaatgattgctcatgcaagcagaacctattggaggagaggtagccgcctggccaggctggaactcatagtctttcaggggttcagctggaggtgaagactatctaaagaattcgccaccaagaaccatcattttcagtcctttctgattaaggaccaaaataaaagctcagtagctacttcattttgataatttttagaaagcctcaaataacagctaagaactttctataaggatgccagaggaaagggggaaaaatggaaaattacagttgaaattacatccttaagagagccagttaagccactaatatacaaacagatctcaagtctgctgtctgacccagaaaaccacagatgaggaattcattttaggactaattacacaaacattaaatcactcaatttttcaccctttatatttaaaattttggcattttcctccctttttctttacacgaactgaatgacagtccctaaccaaaagacttgaccttggaaatgagaaatcatctagtatgggcatgcaagagtgtcactaaactctgtataacctcaggcaagtcattgcacctttctattctgccatttccccaccagcaaaaaacaaaccgcacttcctactacctgttgcgatgaaaaatgaaatactctaagtaagtcaagcacctcagaggctttcaatgtgttttatgacattcatagagtcagttttgagcatctgagaaataatctcttccatttaatcttctattcacaatatagaaaaatgtcctatacggtctgttaaaaataataaaggcaaaaagcttgaccgtctcaggtcatggagaattactttctctgaaaagcccagtcttctagattaatatccaaaaggacagggattttgtctgttttgctctgtaacatattctcagcacctagaacaatgccacatcaaggcattcattaaatattagatgaatgaatgaataaagggaataaaggtttagcctgaataaacatggaaatctttttattctagctattttaggtagacatcttaaaatgtatagtagcattcttccttaccatcttgagaaaattataaggacattttgcagatgactaagggtcgccatcatgcacattctgtatttcaaggatgctctcagtgtcttttaaaatgctaaaatcactccagaatctttaatgtaatttttcagctcctttatgcatttatcatttttcccatcctcctccacctttctaataggttgtcatttctccctattgtgaacaattggctgttgctaatttattgtgcacgtaaaagccaattagccatgtgtctaaagtaagagtacctgcctctgagggcctaaggccttctcctaagaggaaaaaatatgatccttagactttgccacatctatgtttggctccattttttaatgtttcttgattctccaccacgttctagataggtaaaaggccagatagccaagttccaaataagtgtacccaatcaattcatgctgaaatgacatgctgtggtactaagaggcacttgctccatgagacagggtatctgaaaacaatggctccagataatgctggttatctaagtaagcagctgtttcaatgctagagtagggttgtccaagacaaagcaccaggagtggagggaagactgtctctccgtgctgactgtccaagggaagaagccattccagaggagctggggtcggggtaagacaccaaggcaggaactgagaaagtcaccagaatcagggtcaaggtagaaatcacaacttgggaacaaagccaaagcccagtctcccaacaagggacacaaaggcaaggccagacctgacttgacacagagtttcagggtcaggctggagctccttaaatccttggatccagaatgggatctccaggaaggagccaaatgtcttagattgtggcaaggctgaggaactcagcacaggttttacaatagaaaaagaagggcacagcatggccaactacctccttcaccatggcccaagggcatcacaatgggaaggataaggtgagggataccccagaagctgtggagctgatctatgaagcccttctatgcccagcttcagcacatgtgccatgaaaatctatcagtcttgttaatagcaaaggtagaaagagtggttcaggaagataaatctggagaaagaagcatctgagatgcactggggcacgggaaataggaggcaaagagatgacaagttatccaagaacaatgtgatgaaggctctgacaatttccaactttgggtaagaaaagagagaaactatcattttttgtgactttctgtgaaccaagcacaatgctggcattcttcacattcgttatctcatttattcctcactttaagtctgcaagagaagtatactgttcccattttataggtgaggaaattaaaatccagagaggaaaggaattgtagtcacatggcgtggatgacagagatgcgattcactctggaatgatctgattccaaaagctgattccacttgcaccagccgatacccaggtgacttttttaaaatggaagaatgcggtgaatgggataaggagggggtctgtatgtctgcatgcatctgcttttcatgggcttaaggaatcagcctggactgagaccttcctcatatgccctgccttcactccgcagaactgggaatccatcagactggaggctttcatccctaagatgcctccctaacactggggaaatcatgttttaaaatgtttttttaaattgtaatgatctaaagctacctatctaatctgtgtgttgattgctcagcgttcttaaatcaggatgtatctcgtggaaccttagattacagctggtttggggaaaaatatgactcagataaaataagaaatgcatactcaaaaaaagtccaacatttccatgaaaagccattaagctttggggtgctggtaatgtgtttttgtttttgtttttgatctggttgctactcatagagtgtattcatgaagatatatacttattaaatgtgctctcttccacatgtatagtatgcttcaaaaaagttttttaactgccagagcagagtaacattttatccctgccctgttccagtgtaaactggccttttataaataagcaataaagcagggaaagtttgaatatggagataggagcagtaaggctcctctctcctaatggagatccactaagagaagcactctactcataaccagaaggctgttgccttggaaacgggagctgtaactactgcaatcacacctcaggagcaaagatggccaagatctatttcaattcttagatatctcgaggaaccgcagatgactgtaactatggaagatagccaatctgtagtaatgaagaagcgcatgctggagttagaaaggctgcaattgagaaaggaaaagagggggcaggggaagaaggagaagatagaattgaagtataacaaggaaagcctaatccaagaactgcagagctgaggggctcttggtggcatttctttaagccatgccaccctctagtttattgcccacctactacctgccaaaccatgctaggtactgggaggacaaagccaggaaaatacacactcaaagtggcccatgggaggtataagtaccctgggaccaattaacctcagtgtgcaaaatgggtacaggaggcttcggagagacagtggcatttttaagctggaactcaaagaacatgtaggaatttcccaggcagagaagactgaggagagacatctcagacaaagggaggtgcaaagggcagaggcatgaaacagcatgttctgtttttcagcagggtggctacctgcaattctggataggacacttccatgtctggtagattgtcccacacactgcaggacatttgctgtctcagaccccacccactcattgctggcagcaactcccagtcatgacaacagctaaagtaatgcccctcccacatttccaaatgtcctcaaggatggggggatgctattgttcccagttaagaagcctgagaacctaggggaacagatgtgtggctggagcagggattgggggacaggggtgggaggtgaggatgagagtgcaggtaaagatcagagttaaggccttgcacatgccactcgggagtcagactctgtgccagatgtggaggagagagaacagactctaaagcaattatggaggaggtcaaacttataagacttggcaactcatgagatctgaggaggtggggaagaagaaagaatgaaagaataaagaataatccccacagtttccagcttgaacaactgagtaaacattcatggcaccaagcaaagtgacaaatataggagtaagagcagctttggacggggatggaaaggtaaggtggaaaatgagtctgaagcccttcagggacatccaggtggaatttctaagaagtaataaacagcagactaaacgcagaggagagacatctgggtcaaaggtaaaagaaaccttagcatttaattgtaggcagtgtctgagccatttcccaagggcctccagtctcactaggaaagtcagggaaagggagagctggagacgaggaagctgtagcactggagctgggcataacaaacaggagccaatatggcagaaagtgggtaccggcaggcaggaatggagggagcggagccagctggcaaggtgcagatgagcagaccaaggaagagtggctgaaagctcatggtaccccacactggtgtccacaaccagcctttctgtggatcttggcacacatcactacagtggctttagaaaataatcttccatctcaacccaggtcatacacatatatacacacaccagggctggctccatgagcaagcagaccgtgcagctgcccagggacctgtgctgggaagagccgcattcttggttaaatgctctgctactgccatcttgaaattcttaaagattttttaacaaggagtcttgcattttcatgttgcactagatcccacaaattgaggctggtctggacacacaaaaacatagccttaacaaaagtttcatgaaaccatatctatctgctatggtctgaatgtttgtgtgcaccctcaaaatccatatgttaaaaccgaattcccaataatattaagaggtgaggcctttaggatgggattagtgcccttataaaacaggcctgagggagcttgttccttctaccatgtgaggactgtgcaagaaggcaccatctacaatgcagagagtgggccctcagcagacactgaatctgctggtgccatgatcttgaactttccaacttacagaactgtgagcaataaatttctgttgtttataaattacccagtctaagctattgtgctatagaatccttaacagactgacattatcttactaaatgtgatataaaattatattctctgttctattttttaatgtagccatagcccattaaattcacaatccactaatgcattgcaaatcaggtttttttgttgtttgttggttgctttgtttttgagacagggtctcgctctgttgcccaggctggagtgcagcctcaacctcctgggctcaagtgatccttctacctcaacctccctagtagctgagactacaggtgcataccaccattttttaaattttttgtagagatggagtttcaccatgttgcccaggctggtcatgaactcctgggctcaagcgatctgcctgccttggcctcccaaagtgctgggattacaggcatgagccagcacgcccagcccaaggttttaaaactgtcttagagggctgctattgcctgaatgtttgtccccaacaaaattcatatgttgaaattatatcgccaaagtgatagtattagaagttggagcctttgggagggaattagagattacgacccttataaaagaaactgcagagagctggctagctccttccatcatgtgagatcgagatcacaacaagaagtctgcagcctgcaactagaagagcacccttatcagaaccttactaggctggcaccccgatctgggaattcctagcctcctgaactgggagaaataaatttctattgttttatttgtttgtttggtattttgtttttgtttttgttttttgagatggagtctcactctgtcacccaggctggagtgcagtgacacgatctcagctcactgcaacctccgcctcccgggttcaagcaatttcctgcctcagcctcctaagtagctgggactacaggcacgtgccaccacgcccagctaatttttgtacttttagtagagatagggtttcaccatgttggtcaggctggtcttgaactcctgaccttgtgatccgcccgccttggcctcccaaagtgctgggattacaggcgtgagccaatgcgcctggccaatttctatcgtttataagccacccagttgatattttgttttagcagcccaaatggactaatacaatggggtaagccaagactaaaaagtttgttttgttttgtttggagagtggagcccttaaagtggaattgctgccattatgaaatagacccagagagctccctcaccccttccatcatgtgaggacgcagcaggaagacagacatctatgaaccaggaattggaccctcaccagacaccaaatctggtcagcgccttgacagcagcctccagaactgtgagaaataaattcctgttgtttatgggccacccagtccacggtattctgttggaagcaccaaagcagactaagacaccctcctcccacacaaaaaataaactaactttaatttgggttataaataactatatattaagttgacttataaatgattagttgacatcaagttaggtcttataggtatttgattgattaaatacacattaacttagattttgctattttctttcagtattcaaagaagccaatacaaacttttttttctaatttcagacatattttggggccattgaaaagctcaaaggcccgaggcccaaggttcctaattcctcagtattcaccaggcctgcatcctctgggactgaaggaaagaagtcgcagagtgaaagagactgaagaaagatgaggagaaatttgtcaggacatttaagaagccatggattctgatagacaacaagctcctacaaactggtcagaagaggatagttaacccgatttttttaacatcaaattaaatgaataagcaattcaaagaaaagaaagatgcaaaaggtcaatgagcatattaaaaaggtgtctgggaaatatccattttcacatagcagattggcaaaaacagtcattcccatttgatgtgctaaaaagccaaaattattctaacacacagtcgccaaaatgctttgcctttgattaaagatagcacttcccagtgggggatctagaaatggtttgaaccctttttcaataggccactgagagcctaagctgaagctgcccaggaaaaagagaggaagagggcgcagggcctaggagccaggccagcacctgcggcctgggcttcctggagtacatatcagattcccgaggcagctgccagctggctggttcacccacaaacaccagttggctggagcctgggaagtgataccttgaaggcctaaggccctaaatcaaatgtccttgtctatgctaggaacaacctataaggaaaatcttatcacaaaacaagcagctctcaggcatgtcaaggattttaaaaattaattccttaagctgatccagtgataaaagctgtgaataaaaggattcagatgtttccacctcatcatgctaatctacctgtaagctagtcaaccaaccacaaaaaaaaaaaaaaaaaaaaatatatatatatatatatatatatatatatatatatatatatatatatgaatcagacaggcttttgagcagctcagttgccccactgcagcatggagtatgtcacttcacaccaaccaaccaaatgactgaatgaatgaatgagaactgtcaagtccatgtggacatcactaaggggacctggcacttagaagtcatgttcctgttctcactgagacactaactagttaggtaattaaatcagggaagttagtgaaaattctctcagcctcagtttcctcatctataaaatgggaatgataactatacccacctcttagggttgctctgaggcacagtgagggtctctatgaaagcctatggcagactgaaatgacctctcttcagataaaggcttgccgcccagctgtgcagagtgtggtcagcacatggcctccagctgccagctccttcagggtctgcccctgctgcagagagccacctcacctgagatcacaccattcctgtgacaacctgcctgtaactgagaggtaaggatataaaggcccacgatggcccaaagcaggacacggtgactgcactcactcactccagggcttcctgccaggtgtgctgaggccttttcaacttttccctcggcccagtcctgcgtccttcccttcctacatgttggtccctaacgagcatctcacaccccagattccatcttagcatcttcttctagagaacccaacctgcaccaaagccctttttcagttttaagtactttagggtttctttaatgggacaaagaacagaggccaattctggtttagaaaaaaaatcacactcagtctggcatggtggcttacaccttgtaatcctagcactttgggaggccaaggtgtgaggattgcttaaggccaggagttcaggatcagcctgggcaatatagagaaaccccatctctatgaaaaaaaaacaaaaacaaaaattagccaggtgtggtggcatgcacctgtagtcccagctacttgggaggctgtggtaggaggactgcttgaatctgacattttgaattttgaggctacagtgagctgtgattgtaccatgacactccagcctgggtgacagactgggactttgtctcttttctcttttttttttggagacagactctcgctctgtcacccaggctggagtgcagtggtagtggtgtaatcacagctcattgcagcctcaacctcgcgggctcaagcagtcctcccacctcagcctcctaagtatctgagactacaggcacatgccactacacccaactaatatgtggattttttgttgagacaaggtctcactatgttgcccaggctggtcttgaactcctgggctcaagagatcctcccacttcagcctcccaaagtgctgcgattacaggcataagccactgtgcccaggtgacccagtctcttcaaaaaaaaaaaaaaaaaaaaaatacaacacgcactcataaaattttagaaggggggatccatgccatttacttcaagtattcaaagactggtagttcattcatttacttatttaacaaatatgtacagagcaccatgttgggggggtgggcaacctgctgggaccacaagggctctgtactgatgatcatttagggctattgcactttctatgtccacagcagtggttctcagcggggtagcactgcccctacaggctttggaaccgggttgggggcttttggtcgttacaatgattacagggctctgctggcatatggggggtgggagcaggaacgctacagtcctacagtgctctagaaaatttcttttcatggtggattggcccacatcccacatgattttcataaaagagggggaaagagtttatataattatctaagtctagatcttaactatgcatttcataaaatattgtttagttttaaatacactaaattctctaggaatttgattaccctataaattgagggaaggatgtaatgtattttgttcagaactttactagccgggcgcagtggctcacgcctgtaatcccagcactttgggaggccaaggtgggcaaatcacctgaggtcaggagttcgagaccagcctggccaacatggtgaaaccctgtctctagtaaaaataaaaaattagccaggcatggtggcacgcacctgtaatcccagctacttgggaggctgaagcaggagaatcacttgaacctgggaggtagaagttgcagggggctgaaatcatgccaccgcactccagcatgagcaaaaagagcgaaacttggtctcaaaaaaaaaaaaaaaaaaaggaaaattaaaaaaagaactttgctaagagttttttacaccatctctaaaaatgatgactcttacagaaatgacattcatgattaatgagacatctctataacacacctgtattgctctatatttatagttgtcatattcttagtgataaacaagaaaagacttttttgcccttatttctagggttatatataagagtactaatatataactaaaactattcagctgaatatttcttaaatacaaactgatttatgagcaaaaatgtaactatttcattaggtcttcaatatagctgtccccatattgaaatacatgctactttattataaattattttcatgttgtttctcctttatattataattagagtattacattgatttatttttaaatattgtgtgtgagttctattatctgtgagtttccatttcaggaagaggatgttacaaaatatataaaagaggatgctgggtttgataaggttggaaaccactgccttatagaactgattctaaaactggggtctgaggcccacccacagcacaaatacctgtggcattcataaaaaatccaggtgcctaggctccagcctgtctcataaggatgctctctggggctagaacccaggaatttttttttttttttttttgagatggagtctcgctctgttgcccaggctggagtacagcggcgcaatctcggctcactgcaagctctgcctcccacgttcacgccattctcctgcctcagcctcccaagtagctgggactacaggtgcctgccaccaaggccagctaattttttgtatttttagtagagacggggttttactgcattagccaggatggtctcaatctcctgaccttgtgattggcccacctcggcctcccaaaggaatctatttttcaaagctcctcaagtgatattgatcctcttctcggtttggtacccacaagtatagaggacacggagtgcaccaagcccttccctagcctagaggtgctcagagtctcaaagggaaggtaaaattttaaccatcatgtcaggcacataactgttaagtgctagaaagaaataccagtgaagtgctatgggaattcaagaaaggaacagctgggctggaggaggtgtcttgcaaagggtgcattccagtgaggatctggaagacagggagtaagagcctcatctctggagaccgtgactgcagaggcctttacatacattatctccatccaaattcaaagctactgtctgggataaataccactcctatccagtctttcagaataatgaggcctaaagaagcagaataatttcactcaaggttttaaacttaggccctgcagtcccagatgatagagcttaaccacgcagctaatactcaagccttgaccagagggaaacaggtaggggtggtatggaagaggtcccaaggagtttcaagacatagaatttctatccaaagcttcacttccatcttgctattagcgctgtcaccagcattcaggaggacaagaggaaattatcataattagaagggactctgagcatgtatcattcacatatggctggaaagactcaaggatgagaataggcagttaggagtcactgacgctaatgagccacaaatcatagaaaagtaacttaattgagacaacagcaaaatgagaggaggctcagaattaggagctctcacactgcttcgacagttctagtaacagcgtaaagcagtttctgcttaatcaattcccacctaatcagagagccatcttaacgcagcatctcccaaggcagcaaattagctaatagtgagtgactgcagcaatcaggacagtatcagtggggacgggagggatggaaatatgctaggaagaaaggcaattggctggtgctaaggggttaaggggtgtttaactggctgttaaattgcaaagtgctaagcttctgtgttctaatgcagaaagagttaacaatgaatagaaataaagatgaaatccatctttttttctgttttttttattctgcatcctaaatgtgcatccaggtagttacaaaacttactttttgtttgttttgttttgacagagtcttgctctgtcgcccaggctggagtgcagtggtgtgatctcggctcactgcaacctccacctcccgggttcaagcaattctcctgcctcagcctcccgagtagctgggactacaggcacgcaccaccacgcccggttaatttttgtatttttagtagagacggggtttcaccatgctggtctcaaactgctggcctcaacctcagcctcccaaagttctgggatttcaggcatgggccactgcgcccatccacaaaactcacttttatccctacaaaggtaaagatggaggctctttacacccatgttacaggccacaaggtcttattggacagtaagaccaaaagacctccctacccactttctcttccccaccacccctttcctttctctcattgcgacacgtaggtcgccagcaagcaagtgcctcaaatctctgaggcagagacttttcgctttggaaacatttggagcagaaacaggcggtgtggtctggagcaaacatgcaagagaagaaaataccaagaagtcagagaagaatccctccacgtggaattctcatttgcattttgtgcagtcagcagttctccagtttttccacatcctttcaaaggttgggctctcatgtgttgtgagaaggtcagactaagcgggtttttcttatggtttcaggctggataatatttcataaccacatgattgcagggctaagcttagcagtgctgtatttaagagtggatcgcatatccatcattcagtccacatttcaaagactgataaaatattgcccctgaagatttaagagatgctggtgatagaacatttccctctcctaactaataaaactgtgagggtcagttcctaatacaataccagggagcctacctgtatacaataaaacgtcatttgtccttggaagatggcctgagaaacagcatcacgcagtccaggcagtaaacaagccattgagtctctatatacatcatggttagattattcatcctaaaacaccacttggcacacatcacaacctctgatcaaaagtcgtcatggctccccacggtcacaagataaaccccaaactccttagcgggttttcacaaactggaactccacaaactggcactgtccattctctcccatccaatctcccactgttgcccatacacaccctctgctccagccaagctgctcgcttcactgttcctggaagccctttgcaaggcttcctttttctctcttcccttgctgacctctgctcccaaatgcacccttcctccttcttcctagtttgtcctactacgagacatttaaaaaccaactcaaatcccatgtcctccataaagccacctttcagaaagcttcctgcctggatgtgctcactctcctgcactccaatgagagccatcagctggcaccctaaacacagaccgccctgcattgggattgatttatttccatgcttcccaccccacccagttggaccataaagttcctgggtacagtgtcttgtcctggcttcccagaatctcacctcttcgcctcacagcagatgctctgcaaagctttgttgtcatcatttttgagccaccactactataagaatttcgtcctccctagtattaatggtttatgagacacttctgcctttaaaccaccttatctctctctttctgtccaatctctctttgagctcggcgtgtgacaggactgccagttcattctgtccctactgctgtcacatacacctaagagtgtttaacagaaaaatcctaagaggtgattgcaaggtcggaaaatcaccttaagccccccggggccatgtgcagtctacagacaggaaataggcaacaggagaatgaaattagcataaagaaaaaaggggctatggctcctctccacccaagtcagcaacacctaccagaaacaacaaagaaagcatctggataaagcattggcaagcattgctgaggtcgggaaactgctcgtaacaaaagcacaaagggtttgcaaaaggcagctccccttcccttcccaaattaccaaaagctcaacaagaaaacgagcagagtttttgctctaaaaacatctgttttcagttacctgtgcctgaaccacaaacttaacagagaaacacagagatcccaagctgactccgtggtctaagatctgtcaggacaaattatgtggagatggaggagccaagtgtgggatgcttgagcaaccgctgtacaatagccacggtcttgataagcctcgcggatgagattttggcggactagggattgtactactgaacttgattgctgaaaatgtaaaagcccatcaaagagtattattaccccttgataaaccagctacccacagtggtcaattactaatgaacagacctctttcaccaattaaagtcacatgttaccactcaattcccaacatatttagtctttttctcccagtagtccatctcactactgtctagctaaacctctccaactaagatgttgtttgtctttacttaaaaaacagtctttctggagtctggtcagtggggcccaaaaaagaaaataaaataaaaataatttttaaaataaacagtctttcactagaatgttctttatattaaaatcttaagctctgctttttttttttgagatatgtcttgctctgttaacctgccagagtcctgactgaccttcatttgttcattctccttgtgcagttcttcaatgttctttgcaaatggatttcactaaagtgagttctgtctattaatgtcagtaggtataaatgcctgtccatctttggagggactttgggagatgatcttataccaaatgaacatgttacatgcctgttgataggaggcctgatgctttattttctctagaaaaaatagatatttcaatattgtaaattccattaaggcatcctgctccccacctcctgatcctccatcccccaccccccatcaccaacaagctttagtttccctaacctctcaatctggcaaagaaacaacatcccagacctttttggtaggtagttgtccaactctctgtccattttcttcttggcaaaatgggagtaacttagcttaaactgaaaaaacatcgtcagtccttgtataaggcataagtccctgagtaatttacatcatatctcctttttgggcctggtaatttacaaaatcagcaacagggagtaaagtacctcttttgatgaatctatcagcagatgtgtttggaaaatgaggaaatgatgttgctaacttgccaactgtattttggcagataatgtaataaggtgacgtttactgcatttcctctattaaaggaatacaggcaaattttttccttggaattaaaaatctatatattaccctaaaatcctcccagaaatttaaaactgctcctttcttgcttataactttccctcattttcttcccagcagtggaagagaagtttaaatcttgtttaaatccacagtgaactttttatattgtgaggctggttggtaggtgttaatgtaaaattagtgttctgtctgaagccacgtaagatgattctggtataaatatggtaactgcaggacagccgtggtggctcacacctgtaatcccagcactttgggaggccgaggcgggcagatcacgaggtcaggagatagagaccatcctggctaacaaggtgaaaccccgtctctactaaaaatacagaaaattaaccaggcatggtggtgggcacctgtagtcccagctactcgggaggctgaggcaagagaatggcgtgaacctgggaggcagagcctgcagtgagcggagatcatgccactacactccagcctgggtgacacagcaagactctgtctcaaaaaaatatatatatatagtaactacagtgtctactgtgttttgccattatgttttctttttttttttcttggagtctttggagaaagattaaaaggcttggtggcgtatgtatgtcttgaatgccagactgagaagtttatagtaacaggctggtctgagaggcggtgtgtgtttaagtgtttgaagatgagcctggcatttggatataaggtactttagagagctccagttggggctgttggaatggttttgatgtggtgtgatgaggacttaggagtctatggcagatctgagggccaccctgggatgttgagaggtgaaacagagaagatgcttgaagttggggattttattttatttttttgagacagggtctttccatactacagtgttctttatactaaaaactttaatccctccaggccgggtgtggtggctcacacttgtaatcccagaactttgggaggccaagacgagcagatcacctgaggccaggagttcgggaccagcctggccaacatggcgaaaccccatctctactaaaaatacaaaaattggccagcataatgacatgtgcctgtaatcccgggtactcaggaggctgaggcaggaggatcatttgaatccgggaggtgtcctctctaccttagtaggcacagagtacactgttatgaatttaaaatataccagcctgtggattattacttggccagtgaactaatggtattctatatctgttcagaaacttgtattttaaattcctttagaagagtctctggaagagtttttaagagaagagaacatcataggaatgcttttatagatatgtatgtttgtataagcttctaagcctcacttagattctcactgacccacaggataggttagtttctctcaccaggatgtggaggctggagagagaagttgatgtctctgagtttggttacccttgtccagcacaagacaagtgacaccatactgtactggttatattttattatagcaaaacctattaaattttttaaagcccattatgataaaatcccctagggacaaacaaaatggaatgtaattcatttttcaaccaataaatatttattgagttctattaaccttcatgccagtctctcggcagagcccctggatacatcttttaatacctgctctactgaaatctcagtatgaatctccatataaagcaatttccatataaagcaattccataagtttctatataaagcaattcaagtaaaaaatagtgaaacaaatgccagcatgtctctttaattatggtaaatatttaatgtttccttataaaataattacagccttaatagaaacaaaactgttgaaagtgtacctggatgacaataatggttaaatatacacttcaataatttaaagtgatgagttgtttttttttcacaaaagtttaaggtggtaatgaaatcattggaatcccttttaccaaagtgaattttaaaaattacattttccctcttgcaatcatgtttgtagcataaagaagcaataaatgggggcagggagtaaagcttgggaactattctatgttaggcttgagtagtctagcgcaatgtctgataaaggaggggtttgaattttggtatggaaggctttctaacactgcattattttaaagaatagctcagtgatatcagtattcagttacttaactaggcacgaggtaccagatacagagagattgtgtagaagaatgaacactgttaactactgtctcctctccccgtttgctggatctatctatgaatagggtgctgacctctaatttactgaaataaaaggaacattgttcctggaaatatttatgaggcatattgcatcttctccacgttatggataagatggaaagacatctatacctattgacattaatagacagaactcactttagtgaaatccacttgcaaagaacattgaagaactgcacaaggagatgaagaaatgagggtcactcccgcctctggcaggctaacaggatttctctgggtattcgctgcattccctatcatccctcaggacattcatgttctatgaccaggtccaagttgcctcaccatgaaaatcaaacaatggaggccttttcccaattcttagaaggaaaaaaactacttaaatgtgacatatactctttttcccattaatttctccaaaccctagcacataccaccacatggtcaaacaagaactcacggcaacagagagtcaaacacacacacacacacacacacacacacacacacacacataatttgtgtgtttaaacaaaattctagaaatatgactcattaaaatttttacattattagagccaggcgtggtggctcatgcctataatcccaaaactctggaaggcctaggtgggtggatcacttgaggccaggagttcgagaccagcctggccaacatggtgaaaccccgtctctactaaaaatacaaaaattagccaggtgtggtggtgtgcacctgtaatcctagctactggggaggctgaggcacaagaattgccttaacccgggaggcagaggttacagtgggccgagattacaccactgtaccccagcctgggcaacagagcaagactccatctcaaaaaaaaaaaaattaaatttttttttacattattcaatgttaagatacgaagagcttcactacttacaatagaaatatatcttctgcttgttaagataatagaaagagtgatagccctctctcagatggcagaaacagtcatagcccaattttgtggcactctagaaggctccctaaaagatgttccctttgagcaagtttaagtatcacccactagtctctacttgaatccctcagcccacccacatcacattctgcaggaagtgatgaaaagtcagggagtttaggttatgtaaggcctgtggacccattgagccaaactgcaaaatgtgcatcagtgagctccacaacctccccagccccaacccactgcaggaaagtgtctggggatggggcagccaagagttagtcactggaacatgtctgatgctataaaatgctacctgtgatacccagatcccaggttcttttcttctgggttctgatcaaaacacagtagcctgcctgcgatggagcaactagaggaaacaggttccaggtgtgggaagccatgggttaaaaggcaacttgccaaactatgggaaatattctagttgacgctgaagccttaatgcttgactctaatggaggagtcactccattttctcataaaaatgctaagtagatttctgctttctcaagaagctaaatccttttgtggctttatgacttactcctacaaccaagagcttcttaagctattaacagccaagtgtcacagccttaaagatttgcaccgtttgctcatctcaggcatgcccccagtcacaaattcctgcaaaataaaccttggttggacagattgcagaaaaacaaaaaggaaagaaaacataaaacctcattatggttgacaaagaacctgtacaaagcttaaagagatcaataaaatgatatagggtcagattctgaaaaaaaagaacagatttcactatatggtcacctctgggaaccctctgacaaaatcagaatcaggccttccagtttgattgctaagtgcccagtggcagtaattcaaccattccatctctcacacaaaatgcctgagccccagagctaactctgggtgagtctgacaatggtaccacccaatttataaagtaaagagacaagctggccaatttggcacaaggaagaaagcctttccatttgaccattgcagctggtgggccagtgtagtcatttgctgctctataagggtcccccatgacactattaaggcatattaccctttccaaacatcttttgcttcaaaagattccagtcccactctgcaataaaactgagcatatttctatttaaattaactgtctcaatttgaaagcaatttggttttatttaattcaaagatttccctaaatgctatcaaaatagcaaccaaaattggctttcaaattctttaaagagtatctaaggacagaaagaattttttacctacttcttctacttttttttttcttttttttttaagagacagggctttgccctgtcacccaggctgaagtgcagtagcaagatcatatctcactgcagcctcaatctcctgggcccaattgatcctcctgtctcagcctccccagtagctaggactacaaggacgccacaatgtctggctaattttttttttaattttttgtagagatgggggtctcgctatgttgtccaggctggtcctgaactcatgacctcaagtgatcctctcacctgggcctcccaaatacctttttaaatgcttctctttacttctcccaggaatattaacttaatttttaatgtaatttttttttgcttatgaaactgtacgaattggtttctattcaaactgtcgaaaaatatgtacctttggtaagcatgaaaaaaggccacagaatgaaaaatctctaagatcccttacagtttcaaaattcctttatcctgctagatccctttttaaaagaatttatccaacggtataacattctggaaaagataaaactacggagatagaaaaaggatcagtggttgccaggggttagggggtaagcaggcatgagcaggcagagcatgcaggattttcagggcagtgaaactactccgtatggccctataatggtggatacatgtcattatacatttgtcaaaacccacagaacgtacaacaccaagagtgaaccctgtcaactatggactttgggtgatgatgtgtcaatgcaggttcatcgatggtaacaaatgtaccactctagtggggatggtgacagtgggagaggctggttgtggggacaggggtatatggaactctctgtactttctgctcaattttgctgtgaacataaaattgccctaaaaattaaagtctattttttaaaaaagtataccttctagatgttctaaataatatcatgtatcctccaactgattaaaaaaaatgggtaaaagtatgaaggaagagattaattctcctgcagccagaaaagaaaagtgtaagaaaaagctgctgcactgtaggagctgccttgtgacgtcacagaatacttggcagagaggacgtgtgtttctgtttgttctagagatgagcaagagaggaacaagcaacactagtcatcagactagtattctctccaaagaaccgtttttaatgctgttgaacactacacagaaaagccaaacaaatccattcaacacacagacaaccacacatcattgtgaagtttatatctagatcttttaccctgttttttgtaaagtaactgctgagatataatacctattttctatttaggagatctggggacttcttagctaattcaggaattagcaaaccaaagtagacacgcgctgggtacggtagctcacgcctgtaatcctagcactttgggaggccgaggcgggcatatcacttgaggtcaggagttcaagaccagcctggccaacatggtgaaaccctgtccctcctaaaaatacaaaaattagcccggtgtggtggcacacacctgtagtcccagccacttgggaggctgaggccagagaaccacttgaacccgggaggcagaggttgcagtgggccgagatcacatcattgcactccagcctgggtgacagagtgagactcagtctcaaaaaaaaaaaaaaaaagaaaaagaaagaaaagaaaaaaagatatctgatgtactccctcaagaccaaaaatttagggtttgcccaaaaatcagttataaaaggaggatctgggtctttagatatgagaaattagctttcaaataccatgatattctaagcaaatgttcaaatccaatgagaaacactgttacttacatccagctattcaaccagttgcacagagtggaatataaggaaaagcacatagaaacttcattcactacatctgagaggaaacttcatgggcggtatataaagtttcacagatgctggtgaggatgcagagaaaaggaaactcttatatgctgttgttgggaatgtatacaacctccatacaaccactatggagaacagcatggcaatctctcaaagaaaaaaacacatataaataacttctatatgacctagcaatcccactgttgggcatcagtccaaaggaaaagaaaccactatgtaaaagggatagctgcacatgcaagtttatcacagcactattcacaagagcaaagttatggaatctaagtgtccatcaacagatgaatggataaagaaaatgtgatatatatatatacacatacacacgtgatatatatatatacacatatacacacacatatacacatacacacacacacaccatggaatactattcagccgtaaaaaacaatgaaatcatgtcacttgcagcaacatggataaaactggaggtcataatgttaagtaaaataagccaggcacagaaagacaaataccatatgttctcattcacatatgggagctaaaaaacttgaaatcatggacccagaggatagaataacagataccagaggctgagaaggataagtgggtgggaggaggatatgaagagaggttggttaatgggtactaacatacagtttaggtagaagaaataaattgtaagtctggtagcagactagggtaattatacctagcaacaatattttgtatatttcaaagtaactagaagagaggctctaagtgataccaacgtatagaaatgataaatactcaaagtgatgaatacccccaaatacactggtttggtcattacacatcctatgtatgtctcactcatatagactccataaatatgtaaaatattatgtatcagtaaagaaaaaataccaaaaaactcacaaacattactacataaatattagtatagctaaaatttaaaagactgctaattccaagtgttgacaaggatgtggagaaactaacccatatgtattgttgggggagtgtgaaatggtacgaccactttgaaaaacagtttgtcagtttcttataaacatgcacttatcaggtattatacaagagaaatttctttatgtttaaagaaaagacttgcacataattattcataatagataaatgtgggtacaacccaaatttccatcaacagatgaatggatgaaaaattatggtatagccagacattggaacactatttagcaataagaaagattttatctccttatacacaaaacatgaacgaatctcaaaatccttatgctgagcaaaagaagccagaaactaaagaggacaaactgtatgattccatttgtgtgaaattcatctgtagtaacagacagcagatcagtatttgcctaggatgtaaagtagggaagacaaagaagcagaatagaactctttgggggtgatagaatcattccatatcttgattatgggggtgattacacaggtaacttttgtcaaaacacatctacatgtcattaaagtggatgcatgccatttcatgtaaactatccacaatatggtcaatttttctcttttttttttttttgagacggagtctctatcacccaggctgagtgcagtggcgtgatctcggctcactgcaacctcctgggttcaagcaattctcctaacctcagcctcccaagtagctgagattacaggtgcccgccaccacgcctggctaatatttgtattttaggagagacggggtttcactatgttggccaggctggtctcgaactcctgacttcaagtgatctgcccgcctcagcctcccaatagtctatttttcaaaaagaaaaaataaaatgaataggtggggcactgtggctcatgcctataatcccaggttgtactaatttacattcccaccaacagtgtaaaagtgtttccttttcaccacatccacaccaacatctattgtgttgcaactttttaattacggctattcttgcaggagtaaggtggtatctcattgtggttttaatttgcatttccctgatggttagtgatgttgagcattttttcatatgtttgtgggctgtttgtatatcttcttttgagaaatgtctattcacttcttgatgggattatttttttttattgctgattcacttgagtttcctggtgtcaaagaaaagaccagttgaaaaccaggagattcgaagtcagaacttttaactccctctgtatcatcccagcaataagccatgttcttcacaaatacacaaactcattttaaaaagaaagagcctcatcaacagatcaagaaattcattccaaataagcatgctttactttgcatgtattattactaatttatcaaattttatatttgttttgatacattgttaataatcattggaaactcaatccagaaatttatttaactcttagcatctcaggatcacatttctattacaaagcattgtaagataatcagtttttttgtttgtttgttttttgttttttgtttttgtttttgtttttgagatggagtctcagtccagcccaggctggagtgcagtggtgagatctcagctcactgcaacctctgcagtttttttttaatgtagtacatttgtgccaggcacagcagctcgcacctgtaatcccaacactttgggaggccaaggagggaggatcccttgaggccaggagtttcagactagcgtgggcaacatagggagaccctgtctgtacaaaaaaaacaaagatttgccaggcatgctggtgtgtacctgtaaccctagctacttaggaggctgatgtgacaggatcacttgagcccaggagttccaggctgctgtaagctataatcacaccactgcactctaggctgggtaacagagtgagaccctgtccctaaaaaataaataagatgtggccaggcgcggtggctcatgcctgtaatccgagcactttgggaggccaaggcaggtggatcacctgaggtcagcagttcaagaccagcctggccaacatggtgaaatcccgtctctgttaaaaacacaaaaattagctgggcatggtggtgggcccctgtaattccagctacttgggaggctgaggcaggaggatcacttgaacccaggaggcggaggctgcagtgagctgggatcatgccattgcactccagcctgggcaacagagcaagactccatctcaaaaaaataaataatgtataatatttggataaaagtgcggtaatttacaggcatgagccaccacacccagccaaattctgcatgagaaagtggaatagaagtataagctcaaggagaaaaaggaacaatgtaaaatttccaactatcgaataatgcttgctcatgtattttttttaaattatactttaagttctagggtacatgtgcacaatgtgcaggtttgatacatatgtatacatgtgccatgttggcttgctgcacccattaactcgtcatttacattaggtatttctccaaatgctatccctcccccatcccaccaccccacgacaggccccagtgtgtgatgttccctgctctgtgtccaagtgatctcattgttcaattcccacctatgagtgagaacatgcagtgtttgctcttctgtccctgtgatagtttgctgaggatgatggtttccacctccatccatgtccctgcaaaggacatgaactcatcccttttttatggctgcatagtattctactgtgtatatgtgccacattttcttaatccagtctatcagtgatggacatttgaattggttccaagtctttgctattgtgaatagtgccacaataaacatatgtgtgcatgtgtctttatagtagaatgattcataatcctttggatatatacccagtaatgggattgctgggtcaaatagtatttctagttctagattcttgagagatcgccacactgtcttccacaatggttgaactaacttacactcccaccaacagtgtaaaagcattcctatttatccacatcctctccagcacctgcggtttcctgactttttaatgatcgccattctaactggcatgagatggtgtctcattgtggttttgatttgcatttatctgatgaccagtgatgatgttgctcatgtattttttaagtgaaggtgggacactcaaatcacaatagtgtttaaattccattcaacacattttaaacagtgatataatgtttccattttaaaagtcaacatttgtattatgccaggaattacatcctttgtatctttccaactttgtgatgaaaaactttagatgtcaaccccccaaaaaatgtgcaagggaatacatagcgtataaaaatcttttggtggtaggggttggggataaaaaatgttgccatgagctacttgtaagcatcagtagatggcccagcatggccatcctctcagtccacccaggatcggtgatggaaatcacactctgcctcctttgggccctacttagcaagatgctttaaaccaagagtgcacattaacagtgacttcctgtgcaagtctttaaagagctgtcccagttaaagcctgtccaaaatctccacagtacaaaaaaatggtgagtaaaacatttcttcccatactgtttccttgactggagaagttgtcccagatctgttcatgtcatgacacactaagccatcagccacacattcttgactatacatatttatcaagacaccaagaagaaaaaatccaccaaacaaatattagcaatattttatatcaccaatctttttactagggttatttacataaccaaaaattaatcacttcctgtccttcctctgttcatggtaaagatcccaagaggagaaaaagaaggtagataaagtagataaaagaagggaaggatggtgaaggaaaaaacacagcagcagagactggcactacatcattcacttattcaatagtcactgctaatctactactactgagttaaccagagtcttagatactaaaaagttggggtacaaacattttcccccagaagtgaagagaaattcagtggcttagctccaaccttcccaagacacacactaatcaaggggctaaaaatggactgaaaccagaagtgagagcctcaatgaagaaactttccccactccatgtaagcaggaaaatgaaagagttcattaaacatatctgcatttacacacatctaaagattaggcagtgctgtgacaaatgttcccttcagatggccaatcttaaatacatctcacaaaattctaaaaaaagaaaacaaagcatattagagaggaattttggggatgagggcatgggaaagccttagtatttcaggattattaccagtcacaagtgttttcaaataagaatgaagttccacggtcttctgtgtatcacaaagatctttacccacaggggaacgatgaggcaatatccttatggccttgcacacaatgggctccttcttctagaccagcttagaagtgggtgatacattctaatctggataatgcagatgatacgatactagaaccacatgataattacccaggcggcagccttcagcattctatcacagggtgtttatacagcattttaggctgtatcctaaatataactgcagaaatgacacgtgattttataagtgctgtttaagaacaggataggcaaatgaaatgcacctcagactgagccagaaaaaataagagctctacctccactaacaatcaacaagcaaagtaacagccactggcctcggtttctccctatgaaaaatggggattctaatgctcatctcctgtcttcaccagacaatttataatattgttcagaaaatgctggaggtcccagacagcttaggtactcggtcactgtccatgttttctaaagttgtacactacattaatttctttacaaatcttttaaacaagtttctttagtcttaattctctctgaaggatagagaaaaggaggtcagtcaacacgtgtcatctttcatatagaagttagtttcacttctgagaaaagtgaacctttatatgaaagatgacatgttgactgacctcctttctggcctcgctaaccagttcaaggtgcccatcttcatccaagatcaaacagaactccaggcctaggaggagtttcataataactcaaatgactctggaagtacaagagcaagagtcagatgctctttataattctaatgaaatgaacactggaaaccacacacacacatattttcattctctctctgtctctctgcaccacccctccgccccaacacacacacaaacttataacccacacagaaattaccagacttagcttcagagagaaccttctagaataatgagcaacattagattagtagacagctttaagatttatttttaattgtataatttccatttgtaatacttgacctttaaactgtgtttgcttaaaattagcctcctacaaaattaaggctatttccatccccatattaatctagagtctctacttggggaatagaaaatattaagatttctgttttgctctcatatataagaagtaaagatctctcttcccccatcttggctctttgagtgcatcaaaagtacatattaactgtttctgagtccacatctggagtttaaaaatcctatagaaaaggcaagtgatttaaaatataaacatatggcttccttctctacagtgattcctaggcagagggaaaaaaaagttgagtacaaacaaaactattgttttaaggaggattgtttctaattgaaagcataccaaaaaagctaactaagcttctactttctcctggagaaaataataaaagcaagaattcccacctcaatctaattaaatctagatcaaagtgcaacttaggtaacactaggactgtaagagtgtagcactcgatttctgaagaggatggccccaagtctgcccttgagttagagcaagaggttggcaaattttttcctgtaaaaggccagataataaatattttcagctttgctgaccctatagtctttgccacaactactcaactctgctgttgtagcgcccatagacaagacgtaaacaaataatacaactttatttatggacaaagaaattagaattttgtttaatttttatgtgttgcaaagtattatccttttgatccttttcaatcacttaatataaaaactatccttggctcacgggccatttaaagcaggcagcaggccatatgtgtcctgtggatagtagtctgcaacccctgggttaaaactatagaagactggagcagctgcaagaataaactctaaaacaatgtcctcatttcttaaagaaaactgaggcccaaggaggtataatgactggccaggatctcacagccaattcatggcaggaatggagttaagaaaaatactattcagcctctggaagagctggttgaaaaggtaaaagcaaggctgggcacggtggtttgctctttcctataatcccagcactttgggaggctgaggtgggcagatcccttgagttcaggagttcaagaccagactgggcaacatggtgaaaccctgtccctacaaaaagtgagccaggtggcatggaggtacatgcctgtagtcccagctactcaggaggctgaagcgggaggatcacctgagcccaggaggtcgagctatgatggcaccactgcactccagcctaggtggcagattgagaccctgtctcaaaaaaataaaaaagaaaagaagaagaaataaaaagaaaaggtaaagcagtaatgaagaaatgtcctgcttgagttcaactcaccaggacaggcagtggggtgcttaaaaccagagttgttgcaggaacctagtcactagtcatagaagctcctaatacctgacttcccactgtgtaaaataatttgttacctgcctgtcacctacactcattctgaaggtcctatatcagccactaggaccttttgaggggccaaattacctgtcagcctgattcttttcagccttctgagtgacacagctctggttgtttcttttgcagtgtaagtaacaacctccacttttgttagtccaatcctagaactcccaagatataagtgtcaatgtggctgaacagcaaggatcaatgtcaattatttcaaagaacaaaggacagcaggtgaccaattaagcttaaagttcaacagcatctccaacactcacctaagaaactaacagtcaatctccttcccgctcctaattccttccctctaaaagaataaataaataagtttcttaatggttttctcttatttttccttattccaccttttcttataccaattctcattttcatttcctgtgaccctttttactttgccctacatctcaaccaagaatcacctcaaattgaaatgctttgttagaattaagatacatacacatatccaatgatgtttaaattatctgctctttaagtagcattctatagttttaaaagggaaaaaaccccaaattaaagtaactttttacaatgtatctttcatctaactttttaagtcacattttatcagagaagtttgttttctaccgttataaattaattcgagacttgaaattttacaccaatgttttttagacattctgctgtgatgattttttatgaagattactctatcaacttttgtttttacacacttcctcaaaaagacacagttttatatttctgtgaagaggaagtggcattcttataagtaattttcaaagttctttttgacaacttaaataaaaaatgactgcaaactcctgagaatcttttcaacacaaattgatcctcctagatctatctaaacataagattctttggtcaaataaactaagtcaattgatttgataaaaccaaaatgaaagaaaaatgtaattcctaaagctgtaggaaccaaacactacaattcataccgaagtatggaaattccatacaaaaataaaacaaacaaactctttctaccaatgttgtttaagtgagagagagaaagaagactagttaaaaggtcataaatataaaacaaaaacaaactcaaatcatattttcatagagctgaaattgacctgagaaaactggtctctttaatgtgacaaatgaggaaccagcccaagattcagagactatttattatagagtgccaaccaaggaccacctgctatacaaagacttttcccacttgattatcacaacttccccgtaaagcaagtattattttacccatcttacagtcaaggaaagttgtgtcacaggaagatggacacagcttgttaggagtagcgctgtgcacatagcccaggtctccagacatcaactttagtattctaaatatacaactcacacggagcatttttggaaattgttcggttagatgccacaatattttaaaatattatacataaaatacagtaccctgaaaccttgatagaagactccttgctacaaagcagagctacttaaaaagattgtttcttcttggctgctacgaaaaggagcattagcaactaaacattgcactcatctcatgagccccaagacctaattatactaaggctccaaagtacaaaacccttagtcacatggcttctaaattactcatgacagtatcatttactcaagtcacagctggccacttcttatgcttatggtctattcttaaatctggactccgttaagaaggatatagaaagatttttacacttgtagaaataaaggaagatatttcagcatgtctgaagcaatggtgaaaccactcaaggcaacaacaaacacctacttcctgttcaggtaagaagagaggcatggcagccaggcccattagaattgagaccttgtaactgtttgctgcctttaagaactacacggtataattaaaagcatagtttaaaagtcaatgtaagaaagcgatttttggcaactctagtatctaaattcccttccaaatatcttacactggacaagccaaatccaggtcttcctaaaagcacacaagatgggattctaagaccaatgctcaagtatttgactcaagttatggagccacttaaactaagtcaatagatgtgtggaccacacaactagctcagaagcatatttccttgggcagcaaaaccagaaaaatcatgtgcttttatggacaaacagaaaggattctaacaactttactgaaggcattctatcaagcgagagtggaggccttaagaggggcacaaaggtggcaggaagaagtaaaaagaaaaatagtttccaaaaagaatgtatcacttaaataggtgccctgagaaaatgctaaagtaggccaagcatggtggctcatgcctgtaatctcagcactttggaaagccaagcagatcacttgattccaggagttcgagaccagcctgggcaacatggtgaaactcatctctactaaaaatacaaaaactagccaggtgtagtggcacgcacctgtagtcccaggtactcaggaggctgaggtgggagactcaactgagccccggaagtcaaggctgcagtgagctgtgatcgcaccattacactctagcatgggtgacagagtgagatcctgtttcaaaaaaaaaaaagaaagagagagaaaatgctagagttttatagtttctagttttgtaaaaggactctctttttaaacataaccacaatatcctattcacactttaaatcatcaaatatccagtcagtattcaaatttccccaattatctcaaagaagtgtgcttttttaagtttgtttaaatcagaatccaaatctattcactgcaactagtctgaatgtatcttaattctcttttaatttatggatttatatttcctctccatcttttttttttcctcttacaattgattttttaaataaatgaggtctgttttttctgtaggcatcccatagtctggattttgtaatttcttatttaacaaatatgtataagattaaaaacaagtcatctctagatccggcaatcccactcctgggtatctacccagaggaaaagaagtcataagaaaaaggtacttgcacatgcatgtttacagcagcacaattcacaattgcaaaaatatggaaccagctcaaatgcccatcaatcaatgagtggataaagaaagtgtggtagatacataccatggaatactactcagccataaaaaggaatgaaataatggcatttgcagcaacctggatggaattggagacgattattctaactgaaataactcagaaatggaaaaacaaacatcatatgttctcactcattagtaggagctaagctatgaagacacgaaggcataagaatgatataatgagctttggggaatcagggaaatggtgagaaaggagtgagggataaaagactacacattgggtacagttctttagtggtgacaggtgcaccaaaatctcagaaatcaccactaaagaacttattcatgtaatcaaacaccacccattccccaaaaacctatggaaataattttttaagaaggaaaaaaaagtcatctttaaacatactacattattccatcaatggcctacatcaccaaaccatctagatcctttcaatgaagtccttgctactccaaaatacatgtttgttcacaaaatgttgccatggtacctcatgcaacattctatccaagccaggggtatcatggacacagaagggcccataaggcaacaccttactttaatgcttcaatactttttggaacaaagtaaatacaaattaatttgtaaaaagtcatgtgcaacaaatggaaacaatgagttttgcttaggcacaaattcatcaattcaagttttcaggcagagggcatgtagtacctatcaaagaactcaactgagaaaaatgtgttaatatgcaaacacctctcctatccagtttgcaaattggatatttccttacctcttcttcctacctaacatgaaccctatgactcagtaaatttagtcaccaggttacctgaaagggacacaacacgtcactcacctgggttctacccacatctgctgcctgaatcattcccttcctcaagtaccgcttagactccctccagctcccttcttaatgactttgcccatctctggactcctgaagtccctaatcaatacccctaagcatagtctaaacctgcactatatgtggattgataactgtttcatatgccacatgaactcaataaactttaaagagggcctttcatgtgcaaggcattcagtatcatctaactagactgtgagctccatggggaaaaaggcctcttgtgatactgcacctatttcaagaatcctaatgtgtgatggctaagaatgtgcaccttggagttgagcttgcccagatgtgactcccagagtcatgcgaccctgaaaaaaattactcgacctctcagttttcattttccttttttttttttttttttttttgagacagagtttcactcttgtcgcccaggctggagtgcaatggcacaatctcggctcactgcaacctcgtcctcccaggttcaagcaattctcctgcctcagcctcccaagtagctgggattacaagtgcttgccaccacacctgactaatttttgtatttttagtagaaatggggtttcaccatctctagccatctctggccatctctctggccaggctggtctcgaactcctgacctcaggtgagccatcttcctcggccttccaaagtgctgggattacaggcatgagccaccgcacccggcttcattttcctcatctttaaaatgaaatgatgatagccatcctctcataaaaatattaggattaaatcacgtaaagcatgattcttgtcttgtctccttgttcccaattctttctgtctggtttctattttattgtgcctgttcttacctgtccttcccttttgtggagaaggggagagcagagagccccagcagagctatgctgtatcattgctatgtagatggagctcattaaacacccctcgattgcttgaatacatgggagatccactcttagaacatttagggacaatatttcctgtcccctcatgtcaccttgatacttcccctgaaaagaaatggaactgagaattacctacgactgagaattacctacagtgctaaccatcctcacaaccaaaagcacagtttaaaaagagggaaaatataaccagaaaataggacaatatgtgatcttttatcttttcatagggcagaaaactttctcttaattttgtttgaatggaaatttgacatcccagtgtaaaatgaaagctgtttatagaagtgtttctcttttctttgtttgagtacttcatgagtaaaaaacatttgaacatgtacatatacagatacatatacatatttatattcaatcacttaacaaatatttattgagcatttactatgcaccttaccctgttttaagtgctaaagacacagcagtgaatgaaccaaactaacaaaataatctttgtcctgttatctatatcttagccacatgtaagttttggtttttaaaatggggggagtcaaatatatggtatgagggatttacactgtggaggaaaataaagaaaggcagacaggaaatgtggagtgggcattttaaatagtgtggtcagaaagggactcactgagaaggtaacatctgaggaaagacccgaaagaggtaaaggtgagccatgcagatatctagggaggagctgcacagggagcaggaacagcaagggtcccgaggcaggagcgcagctggtgtgttcactaaataggaggaggccagtggggctggagccaaggagccaggaagaggtggacagcagacaaggctggacagttgagtggatgagctgagtgcagaggtcactctaatgaccttagctttcacctgggtgaaactggaagtttttgagcaggagtgacaagttctgagttccatcactctgagagctacgttgagagtagagtgcaggggccaaggtcagacggaaggagaccagtcagaggctgctgttataacccaagtggtgatttggccaggtggcagccagtgaaaaatacagccaaaaagatgacacagtactagcaaataagatgtactaaaactacataaaaattaaaagtttaaaagaatgatttaaagaaatatgaattccaatattctctttcccaaactccaactcaataaagtattgtgttcatccttggggtgtaggccacacctacttttggaggccattgtttcacaataattggttggttgatttgtcccggctgacctgaatgtctgcctggctttctgtctttagacttctcttatgctcactttcctttttcctgatcttgccagtcttagacaccaaaacaagtctcctccacagagactaaccatacagaggctggtgattacatgtaggaattttcttcctttcttgagaaagtctgtggtcaccatgtcaactgcacccaactctgggccaacccttcagaaataaacttgttagatgcacatgttatttgggttcaataaaataggattttgcctgggaggacccaaggtatttgctaaagcaacacctctgaagaaggctaaggtgggccccagctcacaagagacaagcatggcctttgtaaggattgctccctttatcctgtaagaagttcaagaggattctcaaagaaccacactgagaacagccccaggggttctgtgtccccacagccaggctcctggagatgccagaagacaaacttcttggagaaaggactcctcacccttagacaaaactcaggatgtgtttaccaaacctgggaaactttaaagctgccacaaacacacttgggagaaaatcagaagttcataaaaggcagatactttttgaactgagattccacaagatgagaaaagactgacattgaaatatgtgaggagctatcttagaatgttagagcttggaagaatttagagaattttctacctgttcccattttgacagacaaagaaacgaaggccaggacttaccccaaaccatacaacagttagaagaaccatgagtagaatccacgtcttctgattcccaatctagtgttatttttaaaacaaactaaagcaaaacaaaattttttaaataaaaaaagcaaaacttttagagacaggttagaattgtaattaatttccatgtctaggctcaaacagatgtttccacaagtctccctaattttactaaaagctctgaaagctttcttaggggaaaatggtcttctggtataaaagatatcctagaaagctatgcttggatgcttaagactccccaggatgggagcaaggggactctaagcaaacaaaaaccaagaaatgcaaacaattatcgacttagtaatccctgaaacagcccaaagtggactatatatttatttgcttagctcactttatagaatataaattttaagttttcaaaagaggaggcaagtgaaaagatccttaaaaattatgaatatcataattacaagctggattcatgaatcattaatttcaacctcttaggctaccaacatatttacaaacataaacactgataagggcaaatacctgcattcccgacctctgaaagcagccaaagccaaataatatattggttaaaaggttaaaaaggagtaatctataaagagggcaatcttaggccaggtgtggtggcttacccctgtaatcccagcactttgggaggctgaggcaggcagatcacatgaggccaggagtttgagaccagcctggccgacatggtgaaacctcatctctactaaaaatacaaaaattagctgggcgtagtggtgcaagcctgtaatcccagctacccgggagtctgaggctcaagaatcacttgaaccccaggagggggtcggcgggggttgcaatgagccaagattgcaccactatactccagcctgggaaacagagcgagactctgtcccaaaaaaataaaaatacagaataaataaaatgggtaatcttagattatctatgaattgaagtagggtggagaataggaattagtcctaagtcattgacatgggttaaaatccttctctggaacttgaagctgtttgactttgttacctggaaagccttattagagctcatctgcaaatacacccttcataggcacatttgtaagaaatgctataacacaaaccatgtgaagagcatcggtctccattacaggcaccaagtcacagaagggagagggcagagctgaggcaccataaaggcatccagtccaacctcttcattttacaaagagaaacctgaagcctacagaggttaacatgtcttgccaagggttggctaatgtacaacatatgtcacttctcccttcccgtgtacccatagcaaacactggtaatcaatcacactttctcggatccttgactgcaagagtcagaatgtttctatcacattacacctgcaagtcctggaccgatcagaactcatgtgtgacatggaagctgtttcccaactctgcacaaggtcataaaacaatctttgtaatacctgcaccactgtagacctgactcaaaagagacagagtagtctgctagtcaaactagtttactgtcactgtcaagcctgtggtgagcaaacatggagtctatgtgaatatatgatgaccacatatccaggtttacccaggacagtcctggctcacgtctatttgtggcttcatattgagtagtatcacctatgattctcaaacggataaaaatgatatagtcatcctagttctgtgtagttcctaatcattcacaaacatttataaatgttgtttcatacatgatgtgtcaggaaaaaaaacaaaaacaacaacaaaaaacacttaaccaatcaccaggagttttctcatacaaaggggctttcaaataatactaaacccaaccagttttcaagagggactcagggaccactgtccaagccaatcttttttatatattgagcttcaatatgaaatttcttcgggggaaaaaaggagtgtcatagcttaaacaaatttggaaatcacaaaattatcagatctctgtagctctgcctgtttttaaattatttcgtgctatactttagcctataaaaattcacattatcttgtagaaatacaaatctttttaaagaatctttcatttctgtttctggtacaaacaatttgtgcctttttgagttcgtatttgctctctgtttacagcaaaagaggaagtaaaaagttgaaatcttaaaaaagaaagaaagaaagaaaagaaaaagaaaaaagttagttccattaatccagagctagagcttatgtgctggcgttggctaaagagccaatcatatatgtaagagaagaataagtttatttggaaaagtcattggtgtagagaacacagatatcagctatgtgcacaagtgaaaggtaatgatattatcacacgaaaagtttaaaaattttaactggctacccagacagaagactagaaggaaacatatcaaaatgtcaagaatagttatctcttgagtatacaggcttcagatggttttaaaattttttggtttgctcatctagctttctgcttttcctataatgaccgcagttcgttttatatatatatatatatatatatatgaaaaaaatcactgaactaccaacacatcattcaccggggtgaggaaatggagaggctaatgggaaaagccaggtataagccaggcaggggcagaggcctcagagcagctccttactatgtacagaaatgggtctggcccaagaggcagaaggagttcagggaacgctgttcatccaatggcttctctgtaaacaagatcagacacccattaatcccatggctgcactgccctttcaactatgaaaagtatagccttgtggtcagagccccacctgtgcaatcagactgccagggtaggacagtgtgctagatcacttactgggcgtatgaccctaaaccggtcaattagcctctctattcctgttttctcatccataaaatagaaatcacaccaccacctacctcctagtgtggctatgaggattaagacatgattcactgcaaaggcccagtatacaataagagcacaataaatgtgtgacattattaggtctctgccatgaaacaccagcctcaagtgcactctcaaaaccatgtgattgggtcctgaaacaaccagaaaaggttctaaataaagcctttcttttcccttcttctatgctgaagacaggactacagcatactgtttgctttaacaccagtgctctagggagccatggaagaacaagggcagcccagtaaaatatgtaacacgtcccaaggccccacactatgggctagaaatcctgctcccaaagttacacaggatttctagtctcttgccactgccaccgctgccagccactgcctttggcaagaaggtaggtgactcaagtgtgaactaggacttggcaagggaacaccaaaccagaaggcctccaggcaggaagctccaaaaaggccacctgctgaaacagtttgtctgcaggcagcctccgagatgaaagtagtgttctgccatcattaacaaatgcaggtaagaatagtggacactttaaacatgcaacagaacttaccatcctagcttcataactctgaaaataaatttcgggtagagatccaggctgaagatacgaccacacacttaaaatgactacagtgcctttaactatatgacataaagaacaccctaaaacagtcaatatcaaatcaattttcaaaaaggtttcatggctatctttgagtcaaatgccttagatctgtatttaacaaaattttctttcccaaacttaaaattatctcactttaccaaaaaatataaaactcctaatgtccacatacaaggaactaattacattattatattaatgacatagttgaggatgttctatgttacacagggtaaccagttcctcccagtttgcctggaattttcccggttttagccccatatgctgggacaccagtcaatctgcacaaaccaggatggttagtgccccctaaggctgcaataaaaattatgtgtgccctgtgaagaggaaaacagaagggacactgttacaaaagttacaaatgcagaagtgctaaatgccaagtttgtttgtttgtagtgatagctcccagttccttttttacagtgaaaaaaaaaaaaaaaagactaaaaattacactggtctctccctttttctttttactctcctgaaaaaaaaagagttaggaaaaaacattttccttctcttacaagattgagaggtcactacaggactgactgctgaagtagtgtctgcttcacctagcaagctcctgcacccagctttagctggagagaaaatgtcatcatctgtcacccctgacttttgccacatttaaagacaaatccagacaatttgtgtttcaggttatcaacagtaaaaaatccaagaggcctagcaaaaatcaagattcacttcacaaatagggcattcaacagatgaggtgccaggcacagtggctcatgcctgtaatcccagcactttgggaggctgaggcaggtggactgtttgagcccaagagtttgagaccagcctgggcaacatggcgaaactctgtgtctacaaaaaatacaaaaattagccaggtgtggtggcacacgcgcccatagtcccagctactggggaggctgaagtgggaggatgtttgagcctggcaggccaaggctgtagtgagccatgatcatactatcgagtcagagtgagaccctgacacacacacacacacacacaaaaaaaaaaaaggagggagaaattaagaagtggttgttttactagaagctgaatggagagcaaggtactcctgtacaaactctaaggcagggattccaagcaggcgggcggctccctgcccacaatgatggagcaaaactcttctagtagtggtctaagcaaatggttttaaaagttaatctgtgaggttaagaactgacttctaagaattgagtctcaaacagaaaaggtaagactatataaggcaagaaagaccacacacttacttcctggacctaaagctacacagaaaccatcgttgttcaccaccccaccccacccaggccacttccccaccccatctccttctgactttgtcccaagatagactggacattttcagaagttcttgaatcttaaaacgccttaggttctttttacgtatctggagatggaaccaaataaacgttgtgtgactcttcctttctctccatactcatactagtttattgggggaaggaaggaaatatacttggaaacatcttaaaaggcaacatctttgaaattcctgctctgataagccctgaagaataacttcctctctttgtaagaccaagtaatacacttctcactagggttgatcttgatctaggaagagatgttttcttgtaacccttacaacacatccaatgagatgatggagctatcctataccaactgtagcagaaagtacaagcacctggaaggcagaagacaagagctagtcccagtcctgcaggcctatagctggcattctttgaggaagacttgcttcacttctccagatctgttttgtcatttagaaaatgaagggtttgggctagatcatccttagagtccttacaactctaaacttctatgtgatgttctttcttatatgtgataacaatacctattagaaccattctttgtactttgaagatctagggattaacagacaagtacagcaacgtgtactagcaaagatgacaggcccaagacacgctaaaactgtaggatttaaaatacgcaaatgtctaacagttggcaaagtatgtgaccaaaaggtgaaggaaatcctgatatcaacttacacttttaaatgctctggaaccaatgagaacaaatacattcatcacaagtaccagctgctcttcttactaaatttaacaataacatgaattttaactcagtgatttccccatcaccaaccccgccaaacacctgtaaatatttaggaaaaacaagctaaaaaaattgaatctaaaaggcaggagaacaaatcattgcaaatcattgtggtgacggactgcacttcagttgcaagatgttctggctggatactaactggagaacgcaaggcagcagatgcaacccatggacaagtttgaggtatttaataccaagggctggcaagtctgaccctgtagtcaaagtcaagattgcctctctgcctaccaggaccccaaaacaaagttcctttcactacccacgaataaacgggggtgggggtagcaagccgtttccttttttcgtggaaagagctgcaaagagttttgtcatgcaacttggtttggtgcctgttagtgtcaatgtaagagcagcagagtccgcgaaggtggctgttaccattccacagacctgcggcgaggactgtcaatccgattcagcaaataaccccacctctccaagccaggactccagagctgccctgtgtggtgtctcagcaaggaaagccaacaaagctggtagacacaggcagaccgtagcccaccgcctgtgagtggaggctccgagccgacttcacctcctcctcagagggaccggcccgatccgaaagggcggtctccaggggtccccatcccgcaccacgcacacagcctggcgcaactaaagaggaagtcggatgtcacatccaacggataaataaagacagcccggccacacaagagccgcattctgggcaggactcctgctaggtttggggaggggtcccagtctgcgatcctttctccctcttcgtgcagcgtcctcctccccggggcccgggccggcggcgcccacgcaacgcggcgcggtgcgagtcccgagagcacctcgagcccccggccccctccccagccccgccgggcccgcggccgccgcactcccgcacgccggctgcccagcgcccacgggccctgccccagactcgggcgcgcagttccgacggcccagggcggggacggcgcggcggaggggagctgccgccgcgggctctcggaggcaccggcggccgcacacagtcctccccttcgccgcgagtaaacagctcgcgggcgcgctccagccgcgcccccatccccccgccgggctccgcgccgccccgcgcccgcgcgtcccgcccgccggcgccgccgcccgctacctggtcggtgagtttgagcactgccattcttccgctccttcgcgcgcacacacatgcaggtccccggcccgcagatgtcacgccgggagccggggaagcggaagggattgccaggagaagggaaaaaatctggctcccgaatttgacagccctccccctgctcctcctccgccgccgcctcctcccgccgagaggctgacactggctagtggggtttgca

SEQ ID NO: 1114 - DNA, 3589 bp, Homo sapiens
gacaacttgctcttttaatgtggaatggatgaccctccaatatttccccagagcaccccatgctcttctatcagggaacttattaaaatcatgtaacatgtttcttggtgacaagatttaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatgattaccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcagcgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaacggggttatttgtttttcattgttcaattgttaaattccttatggattctggatattagacccttttcagatgctagttgcaaatttttttagattctagaggttgtctgtttactctgttgatagtttcttttgctgtgcaaaactctttagtttaaataaatccgacttgtctctttttgtttttgttgcaattgcttttgaggatttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgataggaatagtgttgaatctgtagattactttgggcagtatggccattttaatgatattgattcttccaatccatgagcatggaatgtttttccatttgtttgtgtcatttatgatttcttttagcagtgtttcatagttctccttgtagagatctttcacctccttggttagatgtattccagggtattttttttttagcggctattgtaaatgggattgcattcttgatttggctctcagcttgaatgttattggtgtgtagaaatgctactgatttatttattttttttttttgagacggagtctgcctctgtcgcccaggctggagtgcagtgatatgatctcggctcactgcaagctccgcctctcgggttcacgccattttcctgcctcagcctcccaagtagctgggactacaggcgactgccaccacacccggctaattttttttttttgtatttttagtagagacggggttcaccgtgttagccaggatggtctcgatctcctgacctcgtgatccacccacctcggcctcccaaagtgctgggattacaggcgtgagccaccgtgcctggtgaaatgctactgatttttgtacattaatttttgtattctgaaactttattgaagtctgaaaatatttttaataattttagtaatacttgtcatttaacactaagcttttaaaaaactgtaaattacaaaagtaaccattttagcaatataaatatatataaagaaaaatatcaagtcttatccctatcatggactgtgatctcactcttcctcaatatactataattatcactcagcaacttttcccccttactttaatcaaggaattcccactaggacaataatatagagctaacttattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctagggattgtttgatcaaaggaaatcctccttttttactataataggtagcatcacatactaaaaatgttgtcacaatttacactcactggtagtgtatgagagtgcccattttccccaaacgttatctcagctcttgatgttattataggctgactgatactttttgataaagcttatttgcatttgtctctactaaaagtggaaacattcactgtttcaatttagttgattgctgactaataggaagtttgcaatcttaggtctggtggatttaccaacttatgacaaggtccatctgacctagtaatagagagagagcccaagggaaacacagcatatgaaaatctattgtttcagttcctgaatcagacacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcagtgttctgaaaaacacacaggcattaatcgttattaactgccacagacactctttcctgga

SEQ ID NO: 1115 - DNA, 221453 bp, Homo sapiens
  misc_feature (101229)..(151228): n is a, c, g, or t
ttaaagatacataaaaagggttttatttatttaacaaacagacaattgaacaaacaaacaatggaagcaagtcatttgccaaaaggaacacagagggtcatgatgatctactcctccaaggatttcagggttcccagacgcctagttttctgtctagttctggaagatgttattcttggggagcaataggtcctcgagtttggggctctttcaggttctctctccatttccccattctgctacaatagataaacaaacaaaaacaattctcacttccagaagatcccgcctgtacgtctgcacgagcccttcaggaggtctggatgtctggttcacaactcccctgcttcttttccagcttttgctttcccttcccccgctcccgccctaccgccccacgacccgaccaccgcccagctgagccccagaggctccacagcgcagaaggtgcaccggaggtcgtgtcagttgcccgccccgcggggtgccaagaaatcaacgctttgtaaaaagaacttccccgtggaaaaaaatctcttgatttccactctcacctctcttcaaaggactaaaagctaaaggcgacaagggattcattcgacaagtcctagtcgtgcgcccttgtgagtgccagaccctgctccctgccaggggacccacgagcgaccctcaccaccatccctgccctggtggagccccgggcggaacacaggatccgaagatggcagcggaagctccgcagcagcccaacagcgactgggcagggtggatacaggctccttcactgggtgaaggcggcacaaagaaccggaagaaccatcccgggagcccaccgggcgttcagcttcccttgggaccccaggcgtctcgggctgggtcgccgaccggggcgtttctggggtctctccctctggctccagaatctcctaacgcgcaggtgtccaacgtgaccagcgcgattcaccgctctaatatctctggttttccaagaacttgctcagtcgtcctgccaggcgggccctgggaatagaagggacagaggaagtttagtgagtgcgcccttcctatatggcccagtggagttagcagtgcttgtctctgtggtgcaatcggttagcgcgttccgctgttaaccgaaagcttggtggttcgagcccacccagggatgcttattggaacttttaaagcatgcacgtattgtcaatcactacataaatggggaagaattagccactaatttatgactgatccatgtcaagggccagccagctccccgaccagattcttaatcgggtatctcctgaaacggcgggtttacacctgtgtaactcaggaatcctgaaacagagacctaggaacccacttctggtgtgataaaattctaattcagtcgattatacgcttaaatgagtaacttacttgtctccgttttttcatattttagtaataggagtccagtagtatctccaggatgtgcctggatttactgattggtctatcaataatgtgaccagtggaatcattcatcatcatagtgatcctctccatcatttttgaaaacagtatttttcctcagtttgtgcattatttatttaacccttttcaaaatgtttttgttagccaggcatggtggcatgtgcctgtaatcccaggtacttgggattctgaggcaggagaatcatttgaacctgggaggtggaggctgcagtggaggctgcaccagtggaggctgcaccgctacactcccgcctgggcaacagagcgagactccatctcaaaaaaaataaaaataaaaaaataaagtttttgagatgaggtaggtttcattgttttaggattacaaagaatgctgcagccacctttcttgtacacatatctttggtcattgtggaaatgtctacaccgcagatatttctatagtgtagggaagttgatgcactattgctacattatagggtttacatgatgcttctaatttgagtacattccgcaaatgtatctttcacgggagccgtaccaaataatattccagtagcaatatttataggaggaaaaatgtgcagaagtgcaattgagcttcgtgcctctccatggggcccatgttcataaaatggtggcattagcaatcatctgagagtggaggagtttgtggccctctgacatcaaaagctgaagcagaggacatgaaaaccctcactgtacatcctctgtagtctggccagaatcattcctaggtcagtggtctcttatcaggagggaatgctgcttgcttgttttgtcaaaaccacaaaagggagggaaagtttcaggccattggttgataacagtggagaggcaagtctttccaaagggctggtttgttaacccttaggaaaaaaaatcctaattcttaccagatggttccatgaagttccaggcttttggtgtcccaaacaaagaactgtacatgacacacataaagcagcaaagcaaagcaaaagtttattaagcacagtaacactctcagagtggggagagtctgggagatgagatcagtattagtttggtgtactttgggtctttttatgtgtgtttttttcttctcttcacagggatgcctaatctttagccagtgtttgtcttttgattgacaggtgcttagttactttggcccttgtgtgcttgcacgttgcctccatcccataattttaagtacatgcatgatatgtagtccatatgcatgagttttaatgagctgattatcatatgaagtcatgttaagcatactttttctctctaatgcacatgcctgtctctgaggagctgctcctttactggtttggatcttgcaggccatggggtccttgcttgctgttttttgtttttttgttggttttgttttgttttgttttgagacagagtctgtctctgttgcccagtctggagtgcagtggcacaatctcggctacctacaaccttctcctcccgggttcaagtgattctcccacttcagcctcccaagtagttgggaccacatgcgcacaccaccaaccccggctaatttttttgtattttaagtagagatggggttttaccatattggccaggctggtctcaaactcctgacctcaggtggtccacccactttggcctcccaaagtcctgggattacaggtttgagccaccaagcctgatcaaaaaaagattttttaaaattattcttttaggccagtcgaggtggctcatgcctgtaatcccagcactttgggaggccgaggtgggctgatcacgaggtcaggagtttgagactagcctggccaacatggtgaaaccccatctctactaaaaatacaaaaattacccgggcatggtgtctggtgcctgtaatcccagctactcgggatgctgaggcaggagaatcacttgaaaccaaaaggtgaaggttgcagtgagcagagattgcaccattgcagttcagcccgggcaaaagagcaaaactctgtctcaaaaaataaaataaataaaataaaataaaaaataaaataaaataaaataaaaataaaataaaataaataaaataaaataaacaataaaataaaaattattcttttagccgggcgtggtggctcacgcctgtaatgccggcactttgggaggcccaggagggcggatcacgaggtcaagagatagagaccatcctggacaacttggtgaaaccccttctctactaaaaatacaaaaattagccgggcgtggtggcaggcgcatgtaatcccagctactcaggaggctgaggcaggagaatcgctggaatccgggaggcggaggctgcagtgagccgagatgacgccactgtactccagcctggcaaaagagcgagactcgtctgaaacaaacaaacaaaaatattcttttaaacttgtgtcatggccgggcgcggtggctcacgcctgtaatcccagcactttgggaggccgaggcaggcagatcatgaggtcaggagatccagatcatcctggctaacacggtgaaaccccgtctctactaaaaatacaaaaaattagccgggcgtggtggcgggtgcctgtagtcccagctactagggaggctgaggcaggacaatggctaaaccagggaagcagagcttgtagtgagccgagatgtcgccactgcactccagcctgggcgacagagcaagactccgtctcagaaagaaaaaaagaaagaaagaaagaaagaaaaatgaggaagctactgatagtccagtatggtatactgtgacagattgaaaaaaaaagtggttatattttgcagcttctctcatcaagagagtctatttctcctctctttgaatcttggattggctatatgacttgctttgggcaaatgttggtgccttcgcaaacctggcagaagagaggcttgcacatgggaggattacctgcttttttcttcacttgaaatcctgaggccatgatctgaagatcccccaaagctagcctgctagagagatcacatgaagaaaaagatccatgcatcccactttttccaaccaatccacctataccccagatgtgtgaggccatcctagaccatccagccccaaatgaaccagcttggactagaagaatttccaagccaactcacagaatcactaaaaataataaattattgttattctttttttattttttaagagacgagatctcagtctgtagcccaggctggagtgcagtggcatgatctcggctcactgcaacctcggcctcccgggttcatgccattctcctgcctcagcctccctagtagctgggactacaggcacctgccaccacgcctggctaatttttgtatttttagtagagacggggtttcaccgtgttagccaggatcgtctcaaactcctgacctcgtgacctgcccgccttggcctcccaaagtgctgggattacaggtgttagccaccacgcccagccaattattgttattctaagtcaataagcttgggatggtttattatacagcagaagtgtatcaaaagggtgatggtagttgcaggaaataaatatatacctttaattgtatatgcataaacatctttggaatgatacctccaaaatacaaattcccatattgaaagagcacactcagtacccagcatggtggatggaaatatatcatgaagtttcaaactaataggaagaggtagaagattctataggcttttgggaggggagatgggagaagagtttaaggcaaataacaaagaatcagagcggcatccatcttctctatggtgctgatgtgctccagtgtataaccatcaggaacaaacctatagtcaaacctgagtatattggctcattgcaacacaggagacagcaaacactatggggaaattgtggggcaattcttcctttgggaatctcggtatttttatctagaaagtgggagaagtggttgcaagactaaacacataattggtaaagaatcaacagtcaatacaaaagttagccaagtatggttgggcatgcctgtaatcccagctacttgagaggctgagggaagagaatcacttgaacgcaggaggtggaggttgcagtgagctgagatgacgcccctgcactccagcctgggcaacagagactgtctcaaaaaaaaaaaaaaaaaaaaaactggcctggtgcagtggctcacgcctataatcccaacactttgggaagctgagcggggcgggggtggatcacaaggtcaggagttccagaccagcctggccaatatggtgaaacccagtctctactaaaaatacaaaaattagctgggtgtggtggcaggtgcctgtagtctcagctactcggaaggttgaggcaggagaattgcttgaacccaggaggcagaggttgcagtgagctgagattgtgccactgcactccagcctggtgacagagcaagactccatcacaaaaaaataaaaaataaaatcattaaccgtcactattagtagctgggatgtttgatcatattatggtttgaacagtgttctttttatgttcaaatatgattgtgaaatagtatttctttcagtttagtgagagggtaactttgtctgatattggtgttgtgaaatttttcgttttaaccatagaacaccatggcctaggtgtttgtcagaccagctctagctcagagcagaaaaggcttacctttttctttctcagaaatgactatggaaaacagtaaacaacaagggccgggagccatggctcaggcctgtaatcccagcactttgcaaagccaagggaggcggatcacttgaggtcaggagtttgaaactgtagcaggagtcatagacaaaatccctcagacacccgattgtggaatgtaagagcttttttcagctgggaccatcggtagactcacatcctagaaaccgagctccccaaataagtaattcttgtcccttttaagggcccacaactctaaaggggctgtgttgggggggtcatgatcaactgagcaagcaaggggtacgtgactgggggctgcatgtactggtaatcagaatgaaacaggacagaaaagggaatttcataatgcttttttatacaatgtctggaatttatagacagcacaatcggtgaggtcagcggttgaattttaacaaccaggcccgaaatgtggcacccagttgtctgagcgtgattttcacttctgcccattctttcaacctccactttttcagcaaacaagaaattaagtgtaagacaatatgaggagtggtcgctctcaaaaccagcttggccaacatggtgaaaccccatctctactaaaaataaaaaaattagccggacatggtggcaggcacctgtagtcccagctactggggaggctgaggcaggagaatcgcttgaacctgggaggtggagattgaaagtgagccaagatcccaccaccgcactccagcctgggcgacagagcgaggcgagactctgtcacacacaaaaaaagcagtgccttcaaaaatctcagagagaaattatttccacctatctttttgtatctctatctagtaaaatatcaattaattttatgggtataaaagacattttcagacatgcagtgtctcaaaaagtttatttctaaggtaaccactttataggaggttttggaggatatgcatcatcaaaaggaagaagtgagtgaggaatgaacccccttgagatccatgaagcaggggatctaacaagagagaggcgatggaaatcccaagatggtgcagtaaagagagatattatgataacagctgtgggataagcctgaagagcaagtcatccagaatggaacatatagaaatgtgccaggaaaaatttctttctttctttcttttttattttttatttatttttattttttgagaaggagtctcgttcttttgcccaggctggagtgcaatggcgtgatctcggctcactgcaacctctgcctcccgggttcaagtgattctcctgcctcagcttcccaagtagctgggagtacaggcgcccgccaccatgcctgactaatttttatatttttattaaagacggagtttcaccacgctggccaggctggtctcgaactcctgacctcaggtgatccacctgcctgggcctctcaaagtgctgggattacaggcgtgagccaccgtgcccggctgctcttttttatagacgaagaaattgaggtacagaaaatccagtaacgttttaaaagtcacgtcatgaatgaaccaagatttcaacccagaaattgaggcttcactacaagtgaagactggggttttcttgttttcaattattgggagttttggatttccaggaatgtgcaattgtaaaaacccagcttcaagaggtgatgaaataggtgcagtggctctggcgtaagctctgaagccccaggctcaggctctattgaaaaattacttttgctgaaatattcctgtttttaggaacttccatggaacttgagccttcacgcagcatattttggcatctgattcaaagctaatagaggtccggaggattcccaggattaaagtctttaaacagaaactgtgaatcttgcctaagcaaaaggtgccatccctggatgggcttgcaccaccaacctttcagttaacagtcaaacgcgctaaccgattgcgccacagagactctaatggcttgtgtcttaaactcatttgctgataccagaaatggctttttaacctctggctgcagataatctcatatatttgatgcctgtccaatcccgcgcactccagaaacccagaatacgggagacaatgaagccaagagtcgagtctttgggcactttggacgttctacccgggcagagtcagctgggggactccaacggccaaagggccacctgctcctcaccgtctgctcttcactgcttcccccgcctgctcttcaccctctcaaaagtcgctggcccctctacaggtgacaactgcagcttctccggcgaaagccactcgctttcccattcttagccccgctcacaccttgcgctcacagtcatttccgccaggcctgggccagcggacgcgcgcgtgggaaggaccagaacccgtggtgtcctcactgcgtccccctcgggccctcagaggtgggatccacaggaaagggacctggagtttgcacaggctgcagcccttcgcccagagccaccctagcacctagtaggtgcccaataaatgctcagtgaaggaaggcattccaccgcagggttttaggagaaccatgaattcctggatgaacattaagcgtttagtcctactaggaagtctggaatatagagacttgaactgtttctcaaaggcagctgttcttgtatccccagagccggtttagaatccagcaaaggcccctgcccggtgtatcccacctctggagacccgaggatagtgcggtggggagcaccgcgggttctggtctttcccacgctcacgtccactggcccaggcccaaaggaaatggctgtgagagcaagatgtgaagatagttacaaataccagctagggccagtgacagttgcagaaatgaggacttgtaatagttaggagtatttcttcattattttgagatgaatacatttggttatatattaaccaatacttttcttgagaattctcatcttccatcatcctcgctatcatattcattaatagttaacttttagaaatctcaatatttaggttacaggatagcaaatatggaatgtgatctagctaaaaaaggagtgaacatcattcaaagacaaataaaagactttatcctgttggggaaagggttggcatattttcactgaatgagaaaaagtatgattttcctattgtctttatttgaaccttaagtatggctttacaaggaggaaaaaggaggaagaagaagagaaagaagaggatgaggaagaggaggaaaagagaaggaggaggaggaaggtgcacattgatgccactttgagaagaagtggactgtggtggatttgtaatgtatcagttttgccaagctgaatgcacatttcccagatttgccatctttagatagctctaggttagcctgggcaacaggagacacttggaagatagaattcaagtggctgttacacgcttttgtatactgggaagggcgttgttacagctcaggcatgatcttcatcttccctgacccttggactggtgggtgttttgcttcttgatctaacattaaggttagaagttgcaggatcccagctgggttttgttacatccaatctggtttaagttcccatattattaggaaagctttagggtgcttcaggaaaacgctttttaaaaaatcagatttggaaaatatcaaatggaattacaggcaataagcataacccagtggaaacatgaatcaaaccctctagagcagggttgtctaaattttgggttccttgggccacactgggaaaaaaaaaaaaagacatttgtcttgggcccagcataatatacactaactgcaactgaaccgtgcgtgtaaagcttgtaaacaaaatctgtctgtaaagtctgtaaacaggccaggcgcggtggctcaggcctgtaatcccaacattttgggtggccgaggcgggcggataacttgaggtcaggagtttaagaccagcctggccaacatggtaaaaccctgtctctaccaaaaattcaaaaaattagccgggcctaattttttagtggcctgcgcttgtaatctcagttacttaggagatcgagtattctctggctgaggcaggagaatagcttgaaggcaggaggcagaggttgcagtaagccgggatcccgccatgcactccagtggactgtttgctgttaataaatgtttacaatgggctcccgtagggaaaagaaaagcttagttttatttctatagaacaaaaaaaaaagttaagagattagtagagacgggtccaccatatttgaccacactgacatcaaactccagagctcgagcggtattaacataaagttatcaatgcatctcacagactactgagattacaagcgtgagaaccaaccactacctggcaaaatctttactttgaaagtaagttacagatgggaacaaagacctgtttattagtttatactaacgccttgtatatgcttccacagcaaacaaaatccacttttaaaacgacaacaacccagggaaaaacacagacacagttccccactgccacaaattatgtaatcaagattcccacattcggggaaatcacaggggtcagcacatccacagtaaaactgctaagccttgctctggaaaaaccaccttcgtgatcataacatttcttctgccagataaacataagtataagctcacgcccctccgccccgccgcagcctcatatgcctcaccctttacacgcaaggtcacttgcgtcacgcgcatccaggagccatcctagccctaacacacagctgcgactctccggtccgaccagaggtcccagacttactcccacggcacgggaactctttcgtggcgaagcagcaggtggcgaagcagcagcccctgcgctgcctcatctacatagaaatcgccctctccgtgatgtcaccgacaacgccttctggatccccgtctgctcttccgcctcacccaacgcccctcagcggagcaaccagctgtcggagccggcgggagaagtgacttatgcctgtcccttctttctctcctgtccccgcccctcgtctcccgcaatgaagcgagtatttaatctgtgtcctgtggaagtcccatttggcggccagctggaagcccgtgcacccttcttcaaataatggctttcaatgagcagactagaacgtttaggattacaaaggaaaccgattcctttcaaacttggttatctttgtgatgtggcactgtgtgcatatcttcgttaaaacgcattgaaggccactgcactccaccctgggcgacaggaggtgactgtgtctcgaaaaaaccaaaaacactcccccctcaccccaaagcattagacgtcaaggctggcagggatgtctgttctcttgaaagttcaatatcaaaatacttggaaattaaactaaaatagtagaagcaagaacaaaaattaagttgaagataatatcaagaatatttcccacaaaccaaaataagaatgtaaaaacaggagagaaaagttcaggaagatagacgtccaaggtccatatgattagcatgcgtatcagaaagaggatagaaaaaaatcagtacaataattcaaaacactttccataccaatggattgaaactacagtgaatttaaagtattgaattgatattgaactttcaagagaacagacttccctgccagccttgatgtctaatgctttggggtgaggggggagtgtttttggtttttttgagacacagtcacctcttgtcgcccagggtggagtgcagtggccttcaatgcgttttaacgaagatatgcacacagtgccacatcacaaagataaccaggtttgaaaggaatcggtttcctttgcaatcctaaatgttctagtctgctcattgaaagccattatttgaaggagggtgcacgggcttccagctggctgccaaaggggacctccacaggacacagattaagtacccgcttcattgcgggagatgaggggcggggacaggagggaaagaagagagaggcataagtcacttccccgctggctctggcagaggtttggtcccctgagtgctcctttcttgtaagcagttcttgtttcatattttcactatctctgacactattaactgtacaattttttttcttctgtacacaaaaaaagtttgtttcaatagtgaagtatgagtcagggtggtggctcatgcctataatcccagcactttgggaggccaaggcgggcagttcacctgaggttaggagttcaagatcagcctggccaacatggtgaaaccctgtctctactaaaaatacaaaaattagccaggtgtggtggtgggcacctgtaatcccagctatttgggaggctgaggcagcagaattgcttgaacgcaggaggcggtggttgcagtgagccgagattgcaccactgcactccagcctgggcaacagagcaagactccatctcaaaaaaaaaaaaaaaaaaaaagtgatgtatcttctacagtatactcttccaacttatcagattctgtcattgacatacgatgttgcatcaatacttgtgtaaggggtttaacactactactatatataatatatgtaatatattttatatatatatgtatatatatatataacactaaggtttattaaaacaactctcagtaaacagatgcccctgatgttccaacaaaataacctactattattagaaaccaaataaactcctcctcctatgaggaagaaagtaaacaacttctggcttggcgcggtggctcacgcctgtaatcccagcactttgggaggctgaagcgggtgctcatgatcacctgagtttaggagttcaagaccagcctggccaacatggtgaaaccccgtctctattaaaaatacaaaaattacagcgcgcctataatcccagctactcgggaggctgaggcaggagaatcacttgaacctggggggcagaggttgcagtgagccgagatcaccccactgcactgcagcctgggcaacagagcaaaactccgtctaaaaaaaaaaaaagtaaacaattctggaacagtttgaaaaagcaatttaagtgaaaatgaaaccaaaaagggtaaaaagaaaaaggagggaattgtaggaaataacctatatgtgattatctattttcaattctaagtggcttggtataggtttaggcaggctacctggaaagaaagaaataaagaagcagaatgtactgagccaccccctccaccttccttctttccctttcacccagtggccaggcatctatcggtgggggctccctcatctaccccttccccactccacaaagaaatttagtttaagctagcttgcaacatagataattgtaccctttcttatcagctaagtgcagccactagagctgtaagtcaaatgtttgaaaaatcctgagagtcataatgcatcgtgtgctgcaataaaatgcagcagaaagaccctaaagaatgtacttgaagaacaatcaataggtgatgtctaggaagattgtggaaggctagtactcagcctatgaggaactgagggagggacctgtgcactagggcgtaaattgcttgttgaaactgtgctgggtgtgcctgcatgccagacacccgatcttgcaagaccgtcattaaaagtctcactttcgctgttctctgggtctctgagttcattgtttgggtttagatgggtgaatttgtttctcacaaatttgattggattgaaggatgagagtattgatcctgggcgtatctgtgagggtgttgccaaaggagattaacatttgagtcaatgggctggggaaagcagacccaccctaaatctggtgggcacaatataatccactgcccatgaatataaagcaggcagaaaaacatgaaaaggcaagactggcctatcctgccagcctacatctttctcctgtgctggatgcttcctgccctggaacatcagactccaagttcttcagttttgagacttgaactgactttcctgctccttaagcttgcaggcagcctattgcgggacattgtgattgtgtaagttaatacttaataaactcctggctgggtgtgatggttcacacctgtaatcccagctctcagagatgcagaggcgggaggatagcttgagcccaggagttggagacctgcctgggcaatatagcaagaccctgttttccacaaaaagtaagaaaaaaaagtaagtgtaatacttaataaactcctttgtatatctatcctattaattctgtctctctagagaaccctgactaatacagagtcacataaaaatatgagcctcaggccaggcacagtgggtcacgcctgtaatcccagcactttgggaggccaaagcgggtggatcctgatcacctgaggttaggagttcgagaccagcctgaccaacatggagaaaccccgtctctactaaaaatacacaattaaccaggtatggtggcacatgcctgtaatcccagctactccgaagactgaggcaggagaatcacttgaacctggcaggcagaggttgcggtgagctgagatcacgccattgcactccagcctgggcaacaaaagcaaaactctgtctcaaaaaaaaaaaaaaagcctcaaagaaggccgtatggttgaagtttatatgcagcacataaaggactaactaggcttggagttcttagggggtggtggccacaggttatgggaggttgaggggaggaaagacatggtgagcaaaggctgtgttgtgatgcagatgtgatgcagatgaagtctctcaagaagcagccctccaccagatgtggtggctcatgcctgtaatcccagcactttgggaggctgaggtgggcagattatttgaggtcaggagttcaagaccagcctggccaacatggcaaaccccatctctactaaaaatacaggccgggctcggtggctcatgcctgtaatcccagcactttgggaggccaaggcaggtggatcatgaggtcaagagatcaagaccatcctggctaacacagtgaaaccccgtctctactaaaaatacaaaaaaattagccaggcgtggtggcgggcacctgtagtcccagctactagggaggctgaggcaggagaatggcatgaacctgggaggcagagtttgcagtgagctgagatggcaccactgcactccagcctgggcgaaagagcaagactctgtctaaaataaataaataaataaataagtaataaattaattaattaacctggtgtggtggtgggcacctgtaatcccagctgctcgggaggctgaggcatgagaatggcttgaacctgggaggcagaggttgcagtgagccaagattgcaccactgcacactccagcctgggtgtcagagtaagaccccgtttcaaaaaaaaaaagtttcctgtcagacctttaaaagcatgagatcttttgtttccttttcctgtgagttaatcttacctggatccagataaagcagataagaaggtctcagagaaagccatttgcagttgatgtttacttcctctacacatgctaatctccctgacaaaaggacagcttttcataggtatttctgtgactgtgttgcctattgcactgcctacatgacttacctggacccctacccagatgttgttggccattgcagtgcctatgtgacatggctgaattcttactcacctttaactctgcttatttttaagaaacaggatgtctgtggtcagaagtttcttcttgggactaaaccagctgaagctggtgaaatccatgatggcagcttacgcaacctctgaaaaacatctagctttattataatccaatttccatgctaaatagcactcccatcagtgcatgacagttgacaatcactgtgacaatgaacggaagagaccaagaaaggacagaaatgaggtgactccttgattctaggaaaatctccatcccttactaagaaaagcatgaatattcctcaccttgctcattcccttcattaaagatcctctatatttgtaacttcctggttctcagtagctgagaaggtgatttgcaagctatactacttctccaattccatgctatgctcctacttctccaatgccattgaatagagcctgcactgcttgacgctcactcttggtttcatacattggctttgcaataataaacaggaaagagtccctttttggggtgagacccctcagtaacatctgcagcccctctaaatagccatctcaaattataccaaaggagtgtattttggggtggcatattttgggcttcccacatggctaagccaacatatagcattcttgctgaacgcagggtgatcagacatcacctagcagatggtgaaggatgaggagccctattagatattatgagtgatcagctattgaagatggggaattctggctaaattgactgagaaggattcttgctgagattgaacaatgcagagaggaacacagaagctcaatagttgaggcctagtgagaagaggactcagaagagcctgattagtttggccaaggagatgtcaacctgaaataaatgaaaggttcagaattcagcgttaaaatgtttattcattctgcttgtgggaactaatggtaaaaattaaaaaagagtttattcaaacaaaaatctgggaatagccaatcagggcacacagactccagagaaatggggtcagtgctgcaaagtcaaaagtgaagttcttgcttacatagaaagaaaaaaaattaataggatcacaacattttctatataaggctgctttaagagttacaacaaattaattagttgcagaatttttttttttttttttgttattgttgttgttctgagatggagtctcactctgttgctaaggctggagtgcaatggcatgatcttggctcactgcaacctctgcctcttggtttcaagtgattctcctgtctcaacctcctgaatatctgggattacaggtgcccaccaccatgcccaggtaattttttgtatttttactagagatgggatttcaccatgtgaaccaggctggtctcaaactcctgacctcaagtgatccacccacctcagcctcccaaagtgctgggattacaggcatgagccccactgtgcccaacctttttctctttccatactacttgttttctttctttatagctggctcacatttcctttccaatttaaaggagtgtatttaacattgcatcttaagacaatgcaatagccatgaagtctttatgagagcaaggtaagaaggaagttaatctataatgaaagtcagcagtgcagagggaagcaatcttccctggcacccttcaataatttgtataacatgttagaaaacaatgcgtgtggctgggtgcagtggctcatgcctgtaatcccagcactttgggaggctgaggcaggtggatcatgaggtcaggagatggagaccatcctggctaacatggtgaaaccccatctctactaaaatacaaaaaattacctgggcgtgatggtgtgcgcctatagtcccagctactcgggaggctgaggcaggagaatggcatgaacccaggaggccaaggttgcagtgagccgagatcatgccactgcactccagcctggcccacagagcaagactccatctcaaaaaaaaacaaacaaacaaacaaaaaaaaaaccaacaatgtatgtaaggaagaaggccaatctataatcagagaaacaaaggttacaactgcctagtttacaggtgcctctcatgtgacttaggctccatactcacattttcttcttttttttttttttgagacagagttttactcttgttgcccaggctggagtgcaatggtgcaatctcagctcactgcaacctctgcctcccaggttcaagtgattctcctgcctcagcctcccaagtagctgggattacaggcatgcgccaccacacctggttaattttgtatttttagtagggatgggctttttccatgttagtcaggctggtctcgaactcctgatctcaggtgatctgcctgcctagggcctcccaaagtactgggattacaggtgtgagccatggtgcctggcccatactcacatttttttaaggctcacagtaatttggaattccaacaacttacattttaaattacttattttcacagaaagaatctttgtcagttgtaactcgcttatttctccaaagaccatagtcctgtccagtgatcctccccaagacaatagctctctctagtaactatagctttcctttcccatttcaatttccactccaattgactgaattgtgaacaccaactcccacacttaaatgttgaagccctaacccccagtgtgatggtttatgcagctggggcctttgagaggtaatcaggtttaaaagaggttatgagagtggggtcctcatgctgagattaatgccattataagaagagacactagaaagcttgctcatccgccttccccatggtgcacaaagaaatggtcacatgggcacacagtgaaactacagccacttacaggccgtaggaagagatcttagaaagaaatccgctttgctagcacctttatcttggacttcccaacttctagaagtgtgagaaacacatttctatagtttaagccacttggtatatggtattttgttatggcaacctgaacagacttatacaacaattaagtcctagaggcaatacaacttctctgctgattccagattctgagcgcctctcagtcctttgttgggttattttgatcctgtccatatatttagaaatattctcttcataaaactctctgtaggctgggtgcagtggctcatgcctgcaatcccagcactttgggaggccgaggcgggcagatcatgaggtcaagagatcgagaccatcctggtcaacacagtgaaaccccgtctctactaaaaatacaaaaaattagccaggtgtggtggcgggtgcctgtagtcccagctactccagaggctgaggcaggagaatggcgtgaacccaggagtcggagcttgcagtgagccgagatcatgccactgcactccagcctgggggacagagcgagactccatctcaaaaaagaaaaaaacctctctttaaatcacacattcgagtgtgccctttgtttctcatcaaagccaagactgatttgagatgatttcttaaggtcaggttaatgtcctaatccagttgtgctgctataacaaaataccacagagtgagtaacttataaacaacaaaaatttattgctcacagttatggaggatggtcagtctaagatcaagttgccagcaggttcagtgtctagtgaaggcccattcctctgtcatccaggctgaagtgcagtgttgcaagcttgggtcactgcaaccttcacctcccaggctcaagtaatcctcccacctcagcctcctgagtagctgggccacaggtgctcaccaccatgcctggctaattttttttttttttttttttttttttggtagaaatggggtttcaccatgtttcccaggctggtctcaaactcttggactcaggcaatctgtcagcctcctaaaggagtgctgggattacaggcatgagccaccgtgcccaccccccaaattctactaatatatgtgcataattaaatagttaccagccatcattttctgatactttggcaattggttgaaagagtttatctaaagacctggaatccatagaaggcagtctctgtgttaaggggttgttcttattatgcagatgaagcctccaggtagcaggcttcagagagaattgattgtaaatgtttcttatcagacttaaaaaggtgcctagattagggaaaagacctggaaagggattccctgtagcatgtagactttccccacaagagacaactttgtagggacatttcaaaatatgataacaaatatattttagggtaaaatatttttatttctttcagggcctgctatctgtcatgtaatgctacactagagtcaggctggaatttggtgtcttattgctacaaaaagtcttaagatctctgttgtaatgccagttgtgcctggtcggatgtgctggtcagttgtgcctgaattccaaaggaaggagggtataatgaggcctatctgacccctacttcccatcatggtctgaaccagtttttcaggttaactttggaatgaccctggctgagaggaggggtgcattcaaatagttgaggggcttggaattttatttgtggtttacactatagaaagtatttttccagtattacctggacaatgtgtctccctgtcagtatccagggaatggcacctggatcaagcatttagtgttcagttgctacactctcacctaatccctcattttcaatattttgccatgttttccagtgacccaactggccaccatgtcacagactttatggtctccaagggagacccctccgttttatgttttgtgatttgagcaacagactggaatctacttgaaatttgcaaatggtctttgacttgggctttccaattttgctctacttcacagtgttttctgggttatatacaagggagatgatccagtcatttgttaagcgcctcaaataagacatgccctagatgtttttttgtttgtttgtttgttttgggatgggacatggaatttacacctaaaataatcagcgtctgaaaggacgtcccctctctggatatggaaaaggaagaactgcaggagttgtatgcagctgccttgcaatcccatgggaaacaatgctagctcacaggaaggcaaaagctgactgttgaaaagaaaccaagtcctcgaagacattgttaggccccaaaccaatcaacccagaaacccatttaccactgaatctagagttaaataagcaagaaaatccccttttatttaatccagtctgagttgggtattctgtcattagcaaatgaaggcatcctgacatgtgggaatatcaagacacacaagctcttgtgcagttttccatgcatggggacagtgccctggcattccagaaatcctggcttacttatcaccactctctaatcaactgcaaataacattttaaaactaagtgcaaagagaatgatcaggaatatcataaaatctgcatttatttaaaaaaaaaaaaggagcttacagtgaagtagtctcaagcaattgctttcttttttttttcttttttttcttttattattatactttaagttttagggtacatgtgcacattgtgcaggttagttacatatgtatacatgtgccatgctggtgcgttgcacccactaactcgtcatctagcattaggtatatctcccaatgctatccctccctcctccccccaacccacaacagtcctcagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggggtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacttcgcaaaagaagacatttatgcagccaaaaaacacatgaaaaaatgctcatcatcactggccatcagagaaatgcaaatcataaccacaatgagataccatctcacaccggttggaatggcaatcattaaaaagtcaggaaacaacaggttctggagaggatgtggagaaataggaacacttttacactgttggtgggactgtaaactagttcaaccattgtggaagtcagtgtggcgattcctcagggatctagaactagaaataccatttgagccagccatcccattactgggtatatacccaaaggactataaagcaactgctttctaagtgggatggctgaagcaagagaccttaaatcacttgactgtcttcacaaaacagaactgaagcagaaccagaagtcccctgatagcctttcagggacaccacctacaaatacaccgtaatccctcatactccacacgccacttcagggaaagggacatgaggcaggaatacaaatatataccatctgtgacacttcctaagctcctggcttcagagtagccatcctgataattattttttaaagtccacattataaatgtgcaagttaagtgagttatggaaatcattccagatactggttcaccagtaacatcagtttagccctaaatattgtcataagttctctgataggctcatgtgatttaagctggtgctctgtcaagactagacttaggcgttttatcctttttatgacattatgtatgttgaagagaatatatgaatatatataaaaccttcattatcacattattctcaatccagcattttctcagcccctgattttcatgttagttcagcattcttacatctttacagattttcatctaagactacatttctattgttttatataatcagcccccctaagatcaacatgtccacattttttggcaaagacaaagcctactgatttcaggatcattattttcctttttcaaaagcacaaacccaaactgagaaataaatcaagagaaattctccttttttctatgctaatttagaagtagagtctttatttcttttcaaacccaaagagaatcagacatacaatatgaatttatctactttcgcttgctcagactgagaggaaagattaatattttcaggctgttagtcaaaactgttcattcaaatattatttaataaaatccaagaaccagctaaaaagtcgcttaagctaagaaaccttcaccagcctcatgggaaattgtgtacagttttccactagaatagcctataaatgcttactgaaaatgtctaagttcatatcttggtaactaacattttaattcaatctgcagaataatatatgcttctttagtgctaagatatgaatattagaggcattctttcttaaaatttctatttagttatactttcacaaataactatataatattaaaattctgcatgtggcataaaacatattttaatggagaaggtaatgtgtagggagtttatttctgtttgctattagaacttgtgtttattcttggttaaaaaaactgcagattacaacatagaaaaaaacaaaagtatgttgtatatctcttacagtagaagataaagagtagttctaaatttagaaaggaaaaataaatatacacagtgaaaatatgtgtcagtgagatgttaatcaaagatcaactattgctgagaccagcaatattaaatccctgcacaattactcatattataatgagaattttaaaaagaaaatatgaacacataacataatgaaggcagaagtcactctcatccttcatctttgtattcccaattcaggaagctggtatagtatcttcattataattactattcaacaaacatttgtaaaatgaatgaataaggaatgaatgatgagaaaaatgataaacatctccctctgtctcctgggagttaactgcactactttcttttaaatttaattaatcctcaatgtccttgtaaaatagccaaagggaaaatgtatttacattactctaaatattgatgcaatctacaaaaagtgttaaacaacttcctcaaagtaaataaaatgttcacaatccagctaggataaaaggatttaaatcatttcctaggtagagggctttcaattagagcccctgctgcattaaccatgggaactcatctcactctcttcatgatggagccctgagtgttgctgctaatctgtactctaccattctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttaatcacacttgtatataagagatcatagaaaaacagtttactaacctgtgaaaataccattcattctctgtttacctctggtccacagctaagcaatcagcaggatataaatgtaccctatgttcactattcagtattcataagtatactacttatgaattggaaatctgacacaacatttacatgacctaattttgaaaatttaaaatagtgtaaggcccctaggcttaattttacaggggaaagattaaagggacacaagcaaacatatattctctctctgtgctgtgggacactggtaattttttgacttaaaatatttgatacttaaaatgccaaacttctacatttctgcagtaacaaggcagttatcatattgaataccatttctttctctccagtaagtagagttaatattagcacatgaactgaaaatattaagtgattataaaaacgtccaaataaattcattaaaatttagcttggcaaaatgttagtttcatgttcttggtagaagtccttttatatttatattcaaatgaaatgaacaatttacaagcaaaggaaatggcatcaaatatttcacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgcagtcaaacctgtaagtcaaaggatatgaaataatagtaactatacattaagcacagaagaaaatgaaacaaacaaaaaggttttaaaccaaccaaaaatatgtcttattttggatgttctatatgttcttacattctctcaggtcttttgtgtcattatgaacacaattctaacaagcttgattattttatttccattcacatattacaggcaacaagctgaaaaagtagaacggggtgtagagagacaggacaaagtacagattagggcttgaagtgcccctgaccagtcgacagcaaccacatggaataatgactcatgtgcattaatgatcacactaaatgatatttgtttttttacctagtccttcaactgacagcttaaagaacttcaggttgttctgattcttgagcctcctctacagcttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatctaaaaaaaataatgctgggaagtcctaaccacatcaagaatgcctcagatcagtgacccagggaaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttagggaatgtgtgcaaaccatacacttaagcaagctctggggaatgagagttggggggaatcaactcttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaatggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatccaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcagacaatacaagaaaagccagtagaaattgccaaatgtatcagaatacacacaggctttctaaggatatggcccaagaggaaggctctagagcccaccctgaaacaggatttttgacttcacagataaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaggcaattaacgctggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtggcttctccataggcagaaaactagcgtagtttttttattagaaattgttattcaataatagtacatgttacaaataaataccattttaaactgaaaaaattgtagactttcaaatcagttagggtggtcaccctaaaaaagggcattttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatatgaagatatgtttatagcaattgcatataaatagagagatagtatgtagtaggaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatattttcctgattcaaatttatatgcccgtgtaatgttccggggtttttttttttaatttctgtaaatcagaatattcagatgttgaaaaagtctttgccttcagatttaaaagatacctttgaaatgtagcatatcccaaaatgcaacccagaggctggcaatgtcaacatttttctgttttaaaaaacctcttatgaaaactattgccatactaaattttttacttgctgatgacttacagctggaaaggattctgtacatataagacatcaaatattgaggatactggaacttttaaattaatggcaaagaaagtcaacaaaggaagttcatatgaaatcaaactagtaatatgattacaaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaagtaaaaataaaatctgactgttaactacagaaatcatttcaaattctgtggtgataataaagtaatgaccacttttcagctggagggactaacttcttttttttttttgctgcatatatagctgtggtacattttaatgtgaaatgatgactgcatcagcttatatccatggagcagattttagcattcagcttgggtctcccagtcaatatctacgagtctcttcttaaggagatcgatgacacagatacatacagactaacaaatgtgataccaataatcaagaattcactcagttaagattttgcccactgatttccacacaagaaacctagaatttactagattcttgtgcctgtgaggctccactcatttccctgaatcacaaaagctacagagtatttagatagaaatatacctactcttaacatgaaccattttaaatatatgtattactgtgtccacaggagtacactttaaagcagggacttcactcttcaatctctccaatcacgtgttacctaaagtggcatgtggttccctaaagcttaataactgacattgccttaaaaaaggggtttgcttcccgactaatgtggaaaaagtctgaaaaatgattttaaatctttcactaaatttctcatttggtcacgtggaggaaaatgatttcaccaaatagatactctcattaattttttaatgtaatttatcaaagaaatgaaatatttagataaattccagatttcccccaccatgagcttctccgaaagtatactccatcacagactgctcactaagaagctctactgcagtcaaagtgaccgaatttaaggggacataatgactacttctgctacacagaaacattatccatctctaacacttccctatgagatggaagacggacttctaatcaggtaccagagagggctctgccaacttcagggctttgatgaataagaatggttgagagcgctcatcataaatgaattcagtataactgagtgagaaagtgagagaaccagagaaataaatcctcatgtagaaaatttaggggtatgaaatgccaaatgccagttaaccaaagctttctttgtcataaagcaacttctataaaaattgctgaaaataaattcttcatggctcaatgtgaatcagtaatttccatctctattacactgttgtttacccaaaaactatttttaatgactaagactcagagtttgccagagtgttttccacaaaacaactgttttgagatactccagatctgtaatcaagtaagtctgaaaaaccccaaatacctcactcacctcttggatatgcataaagcacactaatatataacgttctaaaaagccaatcattaaaaccgttttatattgtttaagcatttcctagacatatttggctacaaatctaacatctaattaaacagtttgggaaatgccatcacataatgtaggaatattactagtcatttaagaaactagaaaatatttactatattctaggcagttggctagcagttggagttctagtctctaaacaaaatactgacttatttctgtgacttttttcttttaagcagctctgtgcttcacaatttttttttcctggtttgttttccacttttgtctgtactttattccttcacagatgtgaaaggctaacaaatgtaaactagttatatgaatcagcctctgcctcagttctacacttcaaatacagtatatactctatcaacaattcttggataataacaacctgtacttgttttacaaacaataaaacaggccgggcaccgtggctggctcacgcccataatcccaacactttgggagaccgaggtgggccgatcacctgaggccaatatggtgaattctcgtctcgactaaaaatacaaaataattagctggccgtggtggtgtgtgcctgtaatcccagttacttgagagactgagacaagagaatcgcttgaacccagggggcagaggttgcagtgagccaagatctcaccaactgcactccagcctgggcaacaagagcgaaaactccatcttaaaaataaaataaataataaaacaatgatgaaaacacaactaactacagcacttcagagttagttgacaaatccaccttttcaatctacatttcaaaatgttcagaaagacaccatcctaggggaagtcaaccagcagcaacctctctgctaatttttgtacacagaaacttgacctgactgcacaaaagtttcaatagatgtctccctctaaaattaatattgaatgatttgtcatcttccatttaataccaaaagggtatcagccacaaactgaaatatcactcatatgcaaataaataacattcaagacttttgtcgttgtggttattaatcttgtaatggatggacataaatctattcacattctcatcctatcctcaaatttcactattctctcctctcattcttactttgttctactcatattctcactctatcctcctatgcataaaatattatgtatcctaatgaacagagataccattcgtgggcaaggaaaaaacacaatgaactgctctttataataaaaaccatgatcttgacacagatgttatcaatcaataaactttacacagctttacactaaattaatacaaactgctgatgagtgggtggggggtggtcactaagcaaacagaagcatgtaggtgttaggaagcatgagaaacatatatcagtgggtagggaaggcagctctcaaaggccaagaatataagttttaggtctatatggaaaaagctgtggtcacattcgaaggcttctgaacagaagaatgattaatttcatgcttaaagagttcaggtgtaaataaactggatgggtaagaaactcaaaatcaagaattttaagacactgggttaaggtgattgagctaagtcaaagccaacagggcatgggctaaatattgacatgggatgggatgaagaggccaacaatgtttcaaagcagaggttgccggagcttcaggaaccagaagaggaagacttgaggtgaaatctgaaacagcaatccccatacctgtctcaaaagatgtgatactgactaggaaaaggctggagagagaagcttcttttaaagaggtaataagggattgttttgatgtgctgggttgaggtgaaaatgacaaatattcaggtggaagtgtccagcattcaagtaggataacttggaacagaaagcccaaattatgtcatggtgaaatgaggataatgtcttattaataaaaacacgtcttactagtctttcctggggaacatgaaagatagaatttcagaaatttagagaatgaaaaaggaaagattacaaggcaataagttgattaaaatagactaaactaatcagtggcagctatcttaaagcaagatatatcttctacagcacgatctacccaaatgcaaatctgggcagagaaatacaaaatatttttaggactgacaaaatttcagctatatgtctttttaaaaatgctgcagagagaaatttagatggattggacaaatatttgcataaggattccacagccaacgtacacaattttccaactactatggttagcactgggctcaggcactacctttgccaaccagcagattttcagtattgcccctggcagacatcccattagcaatctctccccattcccaaacattcccaactattctagtcatgccaattcaaccaatgtcccttaagccttacataaacattgacttacaccgaaatgtatcctatggctcttactaactgtaacttacttaaatcacccaagcctctgttttccctgctataaaatgtaaaatagctgacaaaatacctatttgtattttttggaaacacgggataaagcaaggcaagcaaaaagaacagcagagacaatgcttaataaatatcctagtaggatcaccttaatccatgaagaaaatggagtttaatttttttaatacaaaaaaactcaatgaagttatacttacgttaaattggtggttattttaggtcagtggttttaaaactcaacaatgaaactgttttcaaaaagagttgttatacagaacagaaaaaagcagccacaattttaaaaaagatatgaagacccagattctcactaactcattcagctcccttcatactccctccccacagccaccccagctcctgaggcaggttcccagggctccaaggaacatacttttaaaaaatcagtattttgaatacataataagtgatgtaacttaaaagtatggtgagaaagtcccattgccaagagaaacatgttaattttttatttaaaaaatcatcactcttttcattgtgacatcttgaagaacgctgaatggcttcaaaataactgcatatgccaagatttctggagtgggcacgtttgatcttctttcataatgaaaactgacaaacatttttaagggcatagtattgtttcttcactctcccccctcctcacccctgcacacacatacatttctccttcctggggaactccaaagaaaacaaaggccctttagcaatcaagtagattgtctctcttgatggcatcccatgagttatggaattacatactgcaggcccaggtggattagggcccctagaaagtttgcttgatcaacagagtgctgttgattttttcaactgaattaattactcttggagtccaaactctccagtgtgccacagtcctcatcacttcctgtatcttaaatattgcattatctgtcccctaaaagtatttgaacatgtgacccagagaagaggacttacaacttgactaggcaacttctgtcacactggattcatatgaaattccactgcaagtgacatcaccagattggggaccctgaagtgtttgagtatcttctccacatctggtcatttaggctaagaaattccttcttgtctaccaggtcttttagcattcattttgtaagtcattcaacacctacttactgagaaggaatactgggctagacagtgtgctaggggctggggaaaccgcaatgcataggagagaattcccatctccaagaggctcacagtcaaacagacataaataggtgattacaatatacactaacaacatagttttagaaacaactagcagaattatatagacgaagatgccaggaaaggcttctcagagaatctggcttggcaaatatctcaacaaagagggctgagcagggatgagccgaaggagaggatggaaagtaggttgtgggtgagttttccaggcagcatgtgcaaaggtccaggagaaagaggaaggagcctgtacttggaggaatattcgattactattatcagtgtcacacttgctattcatctagacagaagctcctgaaacaaaaaggatacacttcaaaagatgccaatatatccatgaccacacaaaagagtgtctagtcatataataaagggtgtacatatgcaggcaactcacatcctgccaaatattaaatttctaattttattataatttctaataaaacattagatttattattatacagagtcatactccttgattgggaaactctcaactcaataaacattctttagtctcatgtcttttctaaaggaaagaaattaatgttatattcttgggtgaaaaaaatgtgaggtctcaaaagagtataatacaatttggggatgcatatatattttacatgtatatagacacataaaaatctaaaagcataaattttaatatgttaacagaagacagaagtcatgtattttttactttcttctttttggcatatctctttttctaacttttttttttctttttacaaaaaacaattgttatttgtgtacttttaaaacctcacagtaatattttcacactaccttcttggctgaaagttcacactcggaattccagagcagtccatggccaggcccactgggctccccttgctctctccttggctttggtaaccactggccccagggactcagcctgctttcctatccatcccctcagtagctgtcaccatgcaggttaccccttctgtttcttctaccactaactccatgtctgactgcaagtgaaaggaacagaagcccaaacctttgggttttaaggagtttattgctaatctgtaaaacagaaagagacaggagataagcatgacaaaatatagggaagaaatgacttttgcctaaacttcccaattgtgtacaattgaagcctctgctttatagctcttagcacacctctcaaataagaaggcagtactgggaaggctctgaacctgtggcagaaccactgatagctgtggagctattccaaggagtctgggaatcagggggattatcaagatcattgttagaataaattaatcttactgtatatatagcagaagttttcaagcatatgtaaatgctactaataaccaaataattacaccttgtttttctttaaactgtaactctcaagtatgtctctacataattttttgattggtagtgtctgcatgctcaaaaagcttgaaaacactactggagaagaaggtctcgggagtgtgatgaaatacgtttacatggcagcttcatcatttaattggtgaaagtgactatgtgtcttaaactctctgagcctcagtttgcacatccaaaagcaaggatataattccatgaacctttccacctcaagtccacaaggcagaatagcaagatgttaactgccactctgaggaccaccaaataaaaggacaatttattaggccacttgccagcatggacacaatcgactcttggcatttcttattatccacagaaaaattaaaagtataaatatagaacaaaattatcgtgttttttttaatagtaacatgtaagatcaatctttgtctttaaaataccgtgtatctcattctcggaaagcgtcaaaatgaaaatggtatagtaagttttatctacaacttgaattaaaattattcttgaaatatgttctgaatggttagatgaaatggtaattaaatacaaatagagataatcatatactctctctccataaggctcccacctccttcaatgaagtctagttcacctaaaatgacactattaacattaattcaatattataagttgataagcacattaaatcaaaacacagcaagattattttaagagtctgactgaaatgtcaggatgagaaatagattaataaatattggcttctaatgtcggtaatgaaaacaaacacgttattttcagaaaataaaaggtcttcgtcattaggtacaaatcataaagggattatctacggttactacactgtaacaactttttacatattgtattatagaacaagcttttgagaagacaaagcaacacatcagcagtttaaccaattgtctttctcttttaacaggctggtctacattagattagatataaaaggcccaggtattacttgtgttcgatcttagccacatggctgagaaacatccaggtacatttaaatcagtgacaaaagaaaacattatcccttagtaaaattacataaaataggaaacatctcttactttaagagcaacgatggtacttgttcctatggtgaaaactgatgttatctcgattagttaattattcatcccaacacctggtcttgcttccttttccacctctagctatgttaacactagagttcagtaatttgttgataaagaatcttaactgcagtatctaacagatcttagtgattaagcatatgacttaccctttgtacagataagtaaactgaggccaaaagaactgaggtatcttattaaaaatcagagagctagttagttgaaaagtccacctgtccttcctttccacatgtctcaccagaaaaacagcaatggtgaaaagtcaactctgtttttaatgggccactttgtatattttaactgttaaaataatccaagaagatagtagtcatatacgaagatcctttagatataatgtgtaggaccagcattaatttaatcaaccaagtctcctctcattgaattgttaattcataattacaaagatgacattacagtaaattaagaaatactgtaatttcattctctccaaaaagtatacattgaagtttggtgaatactgttatattttcaactagtaaatcagtgtgccaattctgggtcttaggcatattgtatatactggaatgatattcactttaattaaatttgttttgagatgtagaatgtaatacagatcctacgtgtttttaaaagttcacatcaatttcaagcttttaaaaatgtatgtacacaagaaagcttcttttgcaatttatatgtttacaaatgttgccattagctaagctatattttggaatgtgatcaaacaatattgaatgtcaagtcttaacagcagggctggtctaaggaattccctctaagctaaatctgatcctttcatatgtggctactgctcttttaaactactgtatccctaaagggctaaaaggaagaaaatcctaacttaataagtgaaggcagcaaggcatagtatttgaatggctacctttcattttaactctacttcttaaattcacaattggatttgggtttgtttcaagttgttcacaatttactaacgaaatgtgcatctctcattcttcccccaaaagaaagaagtcatccactccagctacatataagtctccaatttctgtcttacaactaaacgtgaaaaccgaaataccactcattgaaaaaaaaaatatacagagaattggcaggctgcatgtttatgtgaaccttcagaaaacatggaaacacgcagccccaactcaccaggaaaatcaacacttgtgatcaaactattttgtgacattttatgtcttttatacatttcacttcatatccagtattccagttttgcaccggcttgcctgtatcaaccccaaatcgcctgagagcaatctagtactgtagcagaaccgtttcaacatgaagagttctgctcatcgcctgtggcgtggtcttcgaaacacctgaatcaaacattgattcccctccccctgctatttaaaaccgagggacgtcaggcttgggttgtaggtaaagaaaagccacagtaatcaaacaagcaaccaaaatacccgaacacggaacacgctaagaacaaaggaaacacaagagtgtgaacaggaaatgaagcaactctacacccataaataccttctggggccgccaacataggtaaaagtaaaggtggagtctgagtatctgaaatctgaaacagaaagtcctgtcaaaagctacccctggagtggatttgttttaaccccgatcaggacttgggcgctccatttggtggagtcaggggaggcctggccgggcgggtggcgagggctagagggcggcgaggtctctccgcgcagcgtcccaggggatgcggcgcgcccccgactgggtgcagcggcaggccgcccccggcagcaagtgccgggtgccatggcaacggcgggaatttcccagtcggggcggccggaagcagccccagccgggctcgcggcagcgaaagcaaaatccgatctctctcccgggggagcaaaatggacgaaaggcgaccccccaggcaggggcgctgggtgccttgggaatccgaggaatcccttctctttgccagtcggaggggactagatggagccgaaggggccggagatgggccgagcgctgccccccgggggtcctcggcgccggacgcagcttacgagcgcaacgcagcaggctccattcccggccgccgccgctcagcccattacgcaaacctggcgggtccaaccaaccccgctctgccgccgctgctggaacccatgaggcgtgcttgcaggcttcgggcactacgcggggctggaaataccacgcactgccccttcgcctagacccccgctcgggccacgcgggttctgccctcaaagctggtagctgccccagacttgggggtggggggaggggaaggggcgaggctggcgccccctcccgcttttggctcccgcgttcgttgcagcagctgttgccaaatgaaccccggaatgcggacgtgcaaaccctccaccccacccccagccacacacgtcgcggtcagagaactgggaagggggcgcggggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggaggaggaggaggaggaggaggaggaggaggaggaggaggtggaggaggagggggaggtcggctttccatttccagatgtgaccgcccagctgctgctcgccgctgctggattccaatttcctccccttctggcgatggattggtgatgaaaccgagtctcactttctccttcccccgcccggaccaaccgccgtggggggccgagggtgccggggacggccggagagcgatcaccggctgggcggcgggagccgacgaggggcgagccccgctccggctcaagcgcgcacacccctcacggcccgcactccggccttccacacccgtgcacactctcgcccgcgggcggcggcagccgtgcccaggctgctgcagcgccacccgcccgccgcggaccctccgcgccctccgcctagtcacccggcccggccgcgggccgccggggctcgcagagtgtcagccatcccgggcaggagtcgcgtctccccaccccgacctccactcgcgccgggagctgagcggcagtgtaggtagtgaagactccctggggctcccagccttccctctccgcgctctccccccatcacttttatgaattcgactccactttctaaaggaattatgagtcttgtggcaaacacaaaccggagtggccgggagggggaaaaggagggaaaagaaaatctttaaaaattaaaaaaataataaaacgaacaaatctttacttgttgccacctcagataacacggaaaaagccttgaaattactccagatgtgcaccctccccttccctcagtgcctgagtctttttcctccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaacctgtttggcttgctttttaaaaccacctcctttgacagtcagtccagggaaagctacaatccaggtgttcagaaatgagatactgctctgattctcactttctgttctgcctaaggacacctcagggtgacgtagctgccccacctctatattggtttatgccctaggagaggtctccagcaggcacttttcttattgatcttttctccgctgagaaggctcccaccagtagaccatgactcgttttgctttgcattctcagtgccacgtacagtgcctggaatacaggagggtggcctaaatgttggctgaatgcatgaatggtcatttcttgcagcctcttttcattaccctgtctcatcagctttcttatcagaataagtgcccaagagtgccaaactgtttcagacccttaatcaatttagttctgattctgaccgtgacaacatgatgttcagcacggtaggaatgactgccatctctgaaggagtcttaagattctgtagaatcaatgaaagattctatgttctaacgcctttatctttcaggaaagaaattacaaaatagtttcattgtccagtcatattcactatgagttataagaggaaacattctatctagaactagaaataccatttgacccagccatcccattactgggtaggtacccaaaggactataaatcatgctgctataaagacacatgcacacgtatgtttattgcggcactattcacaatagcaaagacttggaaccaacccaaatgtccaacaatgatagactggattaagaaaatgtggcacatataccccatggaatactatgcagccataaaaaatgatgagttcatgtcctttgtagggacatggatgaaattggaaatcatcattctcagtaaactatcgcaagaacaaaaaaccaaacaccgcatattctcacttataggtgggaattgaacaatgagaacacatggacacaggaaggggaacatcacactctggagactgttgtgggttggggggaggggggaaggatatcactgggagatatacctaatgctagatgacgagttagtgggtgcagcgcaccagcatggcacatgtatacatatgtaactaacctgcacaatgtgcacatgtaccctaaaacttaaagtataataataataaattttaaaaagaacaaaacatcacattgtacgacataaaaaaaaaaaagttggattttgcaaggaagatagacatctgactaaagtttggccaagcaaggaatctttgttagtactacttcttgtttaaggaaagaagagacattcatctttccttcaaacagtataagtctcttttcttgtttgatcaccttttattcattaaggaccagttgaatcatctgttgggacttggtagcagaggatatttcctggatagtgtgagctatcaggcctttaatgtgggaagtttagtttctataaaaataaaattaaaaaagattaatagttggaacgaactataaagacagtttctgagcccagagggcagctgatcaataagatttctagatgctgggcttttaatatcttcagctggagtgagaagaggcattggattagtttgcagtttgaatgccataaagatgggccacacacaagctgttgtggtaatttttctgaagcttatgtcaagtcatccagtttcagtttgaaggacttcaagaaaagaaaagtttataattttagtgattccaagccagaatagcaggaaaaaaatgaaatattaatttggagtattgtagctaaatattgtagtaaactagaaaaattgaggatctattgcagattgcaggcagataataaaacctcagaaaaaaaaaaaaaaaacagctagaatctaatattgggtgcactgcagttttctcccgaaacataacttttctctctatattcactctcatttctgtcaaagataatcaaagtcagattgatttgtttgctaaataagtttaatctcattaaacttgtactgtttatgtacacaagtgcagttaagagtagtgattgaccatttaggctcttttaaaggttgcgtttgtcagataagaaatctcagattaaactttttgtttttgtttttttagacagagtctccctctgtcactcaggctggagtgcagtggtgcgatcttggctcactgcaacctccgcctcctgggttcaagcgattcttctgctcagcctcccgagtagctgggattataggtgcgtgccactatgcctggctcattttttgtatttttagtagagacagggctttcaccatattggtcaggctggtcttgaactcctgaccttgtcatccacctgacttggcctcccaaagtgctgggattacaggcgtgagccactgtctccagtcagattaaacttttaaaagccacttgaggctgggatacaagcccaaaacttgtcattagtctgcacctgttacatttatagattcagataaatttctctcttcttgaggtccctaaaatatcccaaggtttccacacctgccaaacagtgacattctttatttacctgtaagtctgggaaccctagagccagtttttccaagatggtactttattggttccataaagccaaccttagtcccctaaagccttctggtcatatctgaaaacatgatgtttcagtcaaagccttggtgatataacctgtgtttccagtttgtcctgttacaaagacaacagattcttattaaacttatgcaaataaatactttgccataaaaataagaatatgcacaaatagtttccaaattctggagggataagttagggagaaaaagtaaatgtttccattttgcacaaaagtattctttactgaattggtgtaagctagagatagcttaaaaaaaagttttctgaaatctggaaaacaaaacatttaaagaactagcaatgtttccaacaaaaagtcattttaaaaattattctcatcagttcattcagtaccacgtaattaaatcttgttttgcttgatcttgggttagtagttacatgaacccgtcagttttattagagttctggaaattcttaccagtccaattgtatgatgttaaagttgttcagaaacctgtattccagaatactcataagagtattttccataaatctccttgaagaagaagccattttggactgtagctaatttcaaatgcttttagagaacaagtaaattaaaacaatgactgtctacagatgacaaggacttaaaatgtccatggttaaaaaatctaatgagagttcattacaatgatgcaatttataagaaaatttggttagcatggcatacagcattttaacataataaccaaaattatgactgataacatactagatttctaggaatctcatacaacttttgtacacttatcccaataatatatccataaatataacttaaagatggcttagcatcactttttatttgaatgctacacatataatttagcatattaaataaatctaattggtttaatctctctttcatacaaaaagaaatattctttgtggctttctgagggtccaatatggagaatcctaagttaatttgaggtcaaaaagacttaacttagaatgtgattttgggaagattgtcaaaaatgtcaaaaagtttaaaacatttaaaacaaatattaccatagttatctatttaataaaagctccattaaaagattttaaaggcaaattcagattacatagttgtgaacaagaacttagctcctttaatattgagaagactcacttttcttaagtaaccaaaacctaataaaacaacatgaaactcaagaaattatcttgatgaaacagtctctgtttctgaggccaattacttaaaaggaaaaaaataccctttacattctcagaccaacattccaagaaaactttaccattttaacggagaagatcaaattctacttttgaatcaatgtattactaaaactaagttttaataaaaccttataaataaatctatccaatctcagtcagcttagaccatacaagataagattttcacaatccttctagatatgttttcttatttacatttgcaacagacatacaccagacaattaagcaatttacttttactacatatcctattcttaggttgaatttatggttttatggccttaaacatctaacagtaacaacacaaacttgtctaatcagcaaagccaggtaaaataagtgtatgctgacagttctgaaaatgtttctatttttattttaccaatattttttaaactagtttttatttactaaggaatatcccagattatgtgaacctaaaaaaaattgggtcagtttctacttttctgaaaattttatacattcttatttgtttgagtgctcatttatccctagccaatttgggtattttagtttggtaataacgttggaggtagaaaaatatcacatatacataacataataacatagatacacacatgtacacatacacaaacatatagactgatgtaaccagatcttatgacttttcatttaaaaaattttaaccaggccaggtgcagtggctcatgcctgtaatcccagcactttgggaggctgaggcgggtggatcacctgaggtcaggagttcgagaccagcctggccaacatggcataaccccgtctctactaaaaatacaaaaattagctgggcgtggggcatcgtggcgcccggctgaggcacaagaagcacttgaacccaggaggtggaggttgcagtgagccgagattgccccgctgcactccagcctgagcaatgaagtgagactctgtctcaaaaaaaaaaaaaaaaaaaagtttttaaccatgaggcagtaaaacagagtaatacaaaaatacaaactcactggtttatctccactttatattgttatccaaattgtgtttctggtgagaaagggataagttgagttgacctacataacaaaggctaaatctttttaccaatatttgtggaggaggttttttaagattttttttttttttactttatcagtttccaaatagtttctttttttctcctattatcagccccaggtgcttgtttttgaggggcctctgagtcccttgagagccccctcaaaggagggtaggataggggtcctgaagttcagcagaaaagaaacgggtctggcaagagtggacagagaaatagtcagcagagacttgagaagaggggtttcaggtgacagagctcccatgggagaagcaggatccaatagagagaagagaaagagcagagtggttttatagagagccaggaagaacaatttgtagctcagggaatcagggagtaacccctcactcagaaaaagagagccagaaagaagagacttctagtctagggactcagagaatagatcactcagaacaagaagcccacaggaagaccttcctgcccagaggattcctttcaaaagaagcctgggactctaccccagcttcagagagaatattcatcccttaagattcaaaatctgtccatagccatcaacgggcttttgtgtggagcaatggctcagaaatctgattcaccaatggatccctaatcagtcagaaatgacaacaaagacttcaaaggcatgcatttagggtcctgagtgagaggcccaggatccagtgatgaatctgtttcaacaccataattgttaaagaaaaaattattcagtgatacttcaaatgcacagtaaagaagactttattcaggaccattaccatagatataggaaccactgcaacacagtcttggagctggggagagagatgggcttaactctgaatacagcacggggaagtgggaatttatagcccaggagcaatgcaggggtcagtgaatggaaaatcactaagaggaaacatcaggagtaagggagattctggctaaaccgccctaaaagaattcttgctgaagactggccagggtgatcagacatcacctgcagaatggtgaagaatgaagaacctgatcagatattgagaatgagggggtctttggtaaacttggcagtgttctttgctaatgctggattttgtgaggaagtgcacagtttagcctagctgaagatttagaagcctgactaaagttggccaagcaaagaatctttgttatcaacatattccatcaaacctcacatccctgccttaaatgatcaaaccatccgcactcctgtatgctactgttctccatgaaaagttacttcttctttgtcttaaccaaaatccagccattctagaaagacaccagaaggctttctgcagcatctaaaatttccccacattctaggcccaaatccttttcctttccctgttgcttttagatccacattgtgtaaccctcatctagaaacctcagtttcttggagtcattttttttttttgggacggagtttccgctcttgttgcccaggctggagtgcagtggcacgatctcagttcactgcaacctccgtctcccaggttcaagcgattctcctgcctctgccccttgagtagctgggattacaggtgcctgccaccatgcctggctaattttttgtatttttagtagagacagggtttcatccttttggccaggctggtcccgaactcctgatctcagaagatccacctgcctcagcctcccaaagtgctgggattataggcatgagccactgagccaggccattctgtctttttatataatataacttgtacttttatgtagtaagttatcacaatggtgtcagacactctgaggaagagtattttactgtatcattcccattacccaatcaggaagtcttaacaggcagattttaacaaaaatataagacacaactgtgcctagcttttctcacatacttcctacctcacacttcacacatttctttttctcagcacccactcttaagtaataatttatttcccctgaatattatttaccttctgtgggctaccttacatatcatctgaaagcatgatcaaaacagttatatttgtgaataattttattttggtttatttcttagcagaaggaggagttaatagtaacatttgtaggccgggcacagtggctcaagcctgtaatcccaacactttgggaggccgaggcttgcggatcatgaggtcaggagatcgagaccatcctggataacacggtgaaactctgtctctactaaaatacaaaaaaattagccgggcatggtggcgggcacctgtagtcccagctactcgggaggctgagggaagagaatggcgtgaacccaggaggtggagcttgcagtgagccgagatcgcgccactggactccagcctgggagacagagcgagactccatctcaaaaaaaaaaaaaaaaaaaagtaacatttgtaatctcccagagaatgccaaggaaaacattctcctggctgaatttatgtagagttcatcatctaagcataaaatattttataaaggaatgggccaatcaaataactgctatgcggttgacactgtaaaccaagttagcttagtaccactctaaatagttgctgggaatataatgattttcaaagacatgatctctagaaataaataactaaaagagaagcacggtgtcatgcatttatgcatacacataagcagggactagagatcaagaatagaaataaaagaggtttttacacttggggtgctaaggtcgcaatgatttatttggagagaaaacagaagcccttctttagtaaatgcaaagcaccatgtgtttaatgaagatacatgacctaagctttgaagatcgtttaactaattcaataaccttaccaagtatccattactacatctcaacaatcaaatttacagtgacatctttgagttaaatatctccatagatgtctggaaacagcttaattctgttaactgctgcccattgaattatgcttaatttggttgtagaatttcatgtcatctgttattctccctcacaacttgggagacgttattcctgtattgtctgttctcgttgatgaagagaagtctgtgataaagtaattgtccttcctttgtaggtaatctgccttccatctctggttgatttgaaaatattgtattagtctttagtatcttgcattttactgtggtatgtctacatatggatttatacttactgagtttgctcagagcttggagtatttcctcagtcttaaaggccctagttgtgaaaatgttactacagaaaaactttatttttttaacttaaaatcctttttattgggaaataaatgtaagattatagataagtttgaaaataaaagaattgttagaacaaaaaatactcatatgcctgttaccctaatttgtctattattattttattaaatttaggttaccatttgttctctctctctctctctcaatatatatcccaattttcagtctttagttctaaatctttcagcaacctggactatcatggccccagtgtaatgcttggctttgtacctcatgagggaagacattttttttttaatcttaagttctaggttacgtgtgcaccacatgcaggtttgttacataggtatacatgtgccatgttggtttgctgtacccatcaacttgtcatttacattaggtatttctcctaatgctatctgtcccccagccccccaccccctgacaagccccagtgtgtgatgttccccactctgtgtccatgcattctcattgttcaactcccatctgtgagtgagaacatgcagtgtttggttttctgtccttgagatagtttgctgagaatgatggtttccagcttcatccatgtccttgcaaaggaagtgaacttatccttttttatggcttcatagtattccatggcacatatgtgccacatttttttaatccagtctatcattgatggacatttgggttggttccaagtctttgctattgtgaatagcaccacaattaacatatgtgtgcatgtatacatctttatagtagcatgatttataatccttcgggtatataccctgtaatgggatcgctgggtcaaatggtatttctagttctagatccttgaggaatcaccacactgctttccacaatggttgaactaatttacgctcccaccagcagtgtaaaagcattcctatttctccacgtcctctccagtatctgttgtttcctgactttttaatgatcatcattctaactggcatgcgatggtatctcattgtggttttgatttgcatttctctgatgaccagcgatgatgagcattttttatgtgtctgttggctgcataaatgtcttcttttgagaagtgtctgttcatattatttgcccactttttgatggggttgtttttttcttgtaaatttgttgaagttctctgtagattctggatattagccctttgttagacgggtatattgcaaaacttttctcctattttttagattgcctgttcactctgatgagagtttcttttgctgtgcagaagctctttagtttaattagatcgcatttgtctattttagcttttgttgccattgcttttggtgttctagtcatgaagtctttgcccatgcctatgtcttgaatggtattgcctaggttttcttctagggttttttatggtgttaggtcttacatttaagtctttaatccatcttgagttgatttttgtatatggtgtaaggaagggatccagtttcagctttctacatatggctagccagttttcccagcaccatttattaaataggggatcctttgagggaagaaaattatttctaatattttaatccagctatgtatgtaaaaagaagtctttttcatattttatctgttatttctgtatgattggagtatgagtcaaaacatctcaatataaataaaaagttacatttcagtaatttttttttctaaaattacaaaacactagtggtcaaaaacactactatttccaattctctttcctttgttaacattactttttgtacttatgagagaagagtttgcaatccaaaaagagcaggaaggaagagagattagagattttttctcctgcttgctctatacatatgagatatttatatatctatatatcaacagttgacctttgaataacactggtttaaactgtgtgagtccacttataggtggattttttcagccaaatacagattgaaaatacagtatttgtgggaagtgaaacccacatatgtggagggccaacttttcatatgcaagctctgcaaggttgactgtaggacctgagtatgtgcagacttcggtatatgcagggctcctgaatccaataccccactaatactgagggatgactgtatatgtctctatctatctactctatcatatatatatatacacacacacacacacacaaatatgtgtgtatatatatatgtatgtgtgtatatatatatgtgtatatatatatatacttcctatattactttgctagggttgttataacaattactgcagactggatgagttaaacaagagaaatttattttctcacagttctggaggctagaagtgtgaggtcaaggcatcagatgtgttaattttattctgaaatttctctccttgccttttagatagtcattttctcatcttgtcttctcatggacttttttctgtgcacatgtttgtctgtacctaaatttcctcttcaaataaggacaccagtgatattggattaggacccagacatgtgacctcattttacattagttacctcttaaaagtctctatctccaaatatagtcaccttctgatatactgggatggcagggggcagggtacagcatattaatttggggaaaggccacaattcagcctataacatatgcaatatattcttctctgatctatactatataacttttatatataatacatatataatttaatatacattttaaccccttgattaattttgtcactgcagagaaaacaagaattaaagaaaagcttcaggtgatactgtttttgaatgagtaagaattgagcctgcccttaacacaagaatgaagtagaaataaactgacttagggaacagcataaaaaagttctcttatgagtcaagatttcaatgtgatgtcatcattttttccagggattaaatattagaatatattgcatgcccatattgaggtggaatcataaacttatttcagacttattataatggctcattttcttatgccttcaccattgaacttgtacttagctggggattgagctgaaagtttgccttttctgtatctagcatagttgcaccaaatctgaccttaatcccaaattttcctttctgtaatatcttgtttccaaatgaggctcacattgaattttctcttgttagaaatataactggcaagaccaatcaaaaccattcattccattcagttgcctgtgaacaagcttgatttgctttgttattaatacagattcttgtgggttaagtagaaagctcttttgtaaatatccctcagtttaagtatatatagtttacatttccaggtaaactgtaaattctctgagaaaggcccagcatggtggttcaagcctataatcccagctctttgggagtctgagatgggtggatcactggaggtcaggagtttgagaccagcctggccaatgtggtgaaaccccatctctaccaaaaatacaaaaattagccaggcatggtggtgcacgcctgtaatctcagctactcaggaggccaaggcaagtgattaaacccaggaggtggaggttgcagtgagctgagatcgcaccactgcactccaacctgggtgacaagctggactctgtctcaaaaaaaaaaaaaaaaaattctgtgaaaagatctgtgatttccattctcctttatagtaattgttaagcactcacaattagatggttataacaactatcaaagaaaaacaattattttaataaatatttttcatcattttctcctttctaagccctatgctatgcactaaaaactgcagagaaaatcaacacattctctacctcacagcagatttcttggagagagataggggtggggaggggaataagggttgctaaatgttgtcaactttgtaatacaactctcaaagggagatagttattagggaggcaaagtgctcaggctcagatttcaggttgcctagatttgaattctgtcttcactgcttcttttatgatttgcccaaattacttaagctctttaaaccacagtttcctcatccttaagagagggataataaatagaacttatctcataaaattactgtgagaattataagtgattatgaagttgattaaatttccccagtgcttcatacaaagaaaggactcaaaggatatgctagttcatagtaggggcatagaagaagatatcccttctctcctgggatatagggtatacataactgtccactataaaattgaagataggctagagaaaagctaaaaatgaagaatctaataactctttagccaagagaaaatgaaacatgagggaaagggagaagttccaaatgaggtccacatttgtcgtgggccactgaatggtggtgccattcaggcagaggaaacccagaaggaggagtcattctgtagttagagggcacttaatgagataatattagagataactgaggttgagttgttggtacgtatctgggtgcaaagtctccataggtccggaattttgaatagttttctggagtcatctggttattgttaaagccaagagaattggtgagatcacagaatacaataatgatcaataagagggaagggaagagagccaagaatgggagactgggaagcatacacatttaattaaggtttggtaaggtgaaaggtgtcagcagagaatgtaaaggtgaaataatgagagaaaaaggaggacatcaaggagaaagtcgtgttttgaaaaaaacaaaaaggacacattttcaagaaagacattgtcaatagtttaaatgtcacaaaatagtagagtataatgcatttaaaaaaaacaaaatctattgcttttgttaattaaatgactagtaacctcggctgcagcagtttcagtagagtgaggagagttgacaccaaactgcaccagtggagtgaaaataagtgggaagaaagagtgaggaagtggaggacagtctttttttttttttttaataaaaatattttcccaaactgtcttttctggaacttccaacatgtctgcttaagagcttgtcttagttgaattcattcgaacttcttgaacctaattagtttctttttgctgtttttttttttttttttttttttttttttttgagatggatccttgctctatcgcccaggctggagttcaatggtgcaattttggctcactgcaacctcctcctcctgggttcaagcagttctcctgccgcagcccaattagttttaaagacgctgcatatattggcagggaaaacctagaacacaaagtcaaacttccaattatctcccttcagtgctcaaatcaagagttcatttgttgcaaggaatggggatctggactccagggagaagaatagagttttaggaggaaagttctcctaaaactaaatggaaggagggttctttgagataccaaggatttgcaggactttatttacaatgaaatgttagtttcagacagcccaggaggaataggtctattaaaggaaagcaagagtagttggcgtaaggaaacaatttgcactggagcctgagagtgagtatagtaatgaccacatgagagacccatttgactcaagtacttcaaagcattgccagtgttagtctttgctccataatcaagtggggaaaaagtgaaatgtctttgaagagcatttcctgtaggtggcctttgaggaggtcctgaaaattccaaacctgcaagtattaatggcaaagaataaaaatttgtttatataaaatacttttaaaaatctttctaaatagcaagacattatatattatcattgttaaaagataaacgaattgagaaatatcattagaattatatgcagcagataaaatggtcacttttttttttgagacagagtctcgctctgtcgccaggctggagcacagtggcgtgatcttggctcattacaacctccaactccctggttcaagtgattcttctgcctcagcctcccgagtagctgggattacaggcacgtgccaccaccccagccaatttttgtatttttagcagagacggggtttcaccatgttgggcaggatggtcttgatctcctgaccttgtgatccacccgccttggcctcccaaagtgttgggattacaggcgtgagccactgcgtccagccaaaaggtcactttttaaacttaaaaattattaagaaaacagtgaaaacttaatgtttaaaagagtagaagatagggaaaattattacacagaaaaagataaacaacagagaaagataaataaattgccagtgaatatgtaaaaagttgctcagcaccagtggtagttcaaatccaaatagcactgagttagcatttgttaactaataaattggcaaaaattatattttgataaaacccagtgttgttgacatctcaagaaaaagggctatgctcacacagccttggagcatgtgcacattgatgattttgttggcataaaaattagtggtttctattaaaatcagcagtgtaattcacaatcgctaagacatggaatcaacctaggtgcccatcagctgtggattggataaagaaaatatggtacatatatgtcatggaatactttgcagccataaaaaagaataaaattatgtcctttacagcaacatggatgcaactcgatgccgttatgctaagcgaattaacacaggaatagaaaaccaaataccacatattctcacttataagcaggagctaaacattgagtacacgtggacacaaagatgggaacaatagaaactggggactactcgagggtagaaggagggagggggtaaaggttgaaaaaaaactactatgcctagtacctgagtgatcagatcaatcatgcagcaaacctcagcattatacaacatacaacatacccatgtaacaaacctgcacatgtacccactgtatctaaaatcaaaagctgaaattataaaaaataaaaaagaaaatcaacaatgtgtatttctctcacacagccatcacgatgatgtatttggaataatatatgcataaggatgttcattgcagtgttgtctgcaagggcaaagtgaaaacaatctgaataaccatcaatatgacacagagtaagtaattattggtacgtctgtacaatgcctcatgcagtcaccactgacagcatgggaaagagagacatctattatgaaaagaccactaagacatatgattacatgataagtgcaaggttcatgaataaatagtatgtatactagtatagcatacttctttctaagaaagaaaccataacacatacacgaatggacaagaaattattaacaatagctaactttggtgataagactgtaggttgtaaaaagccagactttcatttctcattttaaacccaatgaattatttaaatctaaccctactgcattcattatctttataataaaataaatatgtataacaatgaaacatagtttttaagtatttgggacataaattaaacattaatagattacacctcttaaacttggtactttagtatcccatttctctgtgagaactctgaaagcttcatcttccacagtttaggtaattctttggtgtcttattttgttattttcttgccctgagattagcaatgtcagatctccaaactactaactcttctctttggcagatcaaatgcttcttcttaaaaaaattgattttttaaaatgtatttcataggatttttgttctctctctccctctttttgtgcatatgtgtgtgtgtctgattagtctttattatcttaaaatggttagtcctgatagacctgtttcttcaaaatttctctcagttctttggcagtttgctcttagcttataattaaagatcaatttctgacttgtcttgttctagaaaacctcaatggaaattacagcaagctgaataggatattaattaaaaacataaacctggtgaaacccgaacatagaggctctagttcaaagatgcttccaatagttgacatggccattcattccttaaaaccagctatttttctttcgaattacattacctttaattctgtaaattggatgttatatagtaccatgaaaactgctgtgagtaattataatactcattgctgagtgatgtgacttctttctcaaggctatttctgagggaaattgtacaattagatctttaggtattgtgacttgttttggaaatcatggtggccctccagggagctaatgaatctttaattatttagaggttcacatgagaccccttacagatataagcacattagctctgtagctaagggaacatttaaaaacagtaacatgaaatgtgtcagacatagaggaaagatgaagaagcaagtagaagctaatgcaaacagaggaactgccagctctctgtggcactctagctctctctgtcagtatttggttggcaatgtagacatagtggatgagtgcaattacatatgttaggctcattctgaaatgcaggagcattttagattttcatgtagaagcctgacaagcaaactacatctaggatatactttgataattttgagttgagagccaaattttttgaaggtaaaccatctccctgttttaaagtagtgtttaaaattataaaaatattaatacatctgtaacataaaatatttagatataaatactacaagtgcaaatgaatttttttttctacttctgcattcaacttttctcttctccctttagggaaaacacttttgtgtaaaggcctccaaaatatatgtagaggcgtatgtatgttaaaaacatgtatacatataatgcataaccaaacaaatgaaatatcctaaacatatggacctgaaaattgcttataataaatttgaactgaacatataggcataaatgtggttcagaagtgtccagttgaagcaacttcactttgttaggtcaacaaaagttggggacactaagatctactcctctgattttgttctagcattatcttaatggaaatgtttactgaaatggaaatacatgtagtggacatcgtggtggtgtctcaagcattcagtgttccctgctctcacacactcctagccaaataatgaatttctcagcttcacaatgtttaagtgacatgagtcccatgtccaattcttggtcactgtaattggtgcatgaaggaacgtgtgccttctgctaatcaaatcagaatgaagtacaactttttcattccatgattgaagagggaaatgccttctttccaaatgcagcagaggaagcacgaggtactaggattggaagttgtctactcatgacatgatattttaagccatagaataaaactgagacctaatgtcttagtcctttcaggtcgctataccagaatatcacagcctggatggtttatgaacaacataaatttatttcttacagttctagaggccaggaagtccaagatcaaggtgtcaacagattcagggtctaatgaggatttgtttcctggttcacagacagctgtctttttgctgtgccctcacatggtggaaggggctaggaagttctctaaggtctcttttataagggcactaatctcattcatgaggactctgtcctcatgacctaatcaccccctgaagacccactgccaaatatcatcacactagggattagatttaaacatacaaattttggggggatacaaacattcaatctatatcacttaaggtagagtgaagaaacagggaggacaagaagcatttattttgtgttattattaaacttctgcattaaactatcttgagcctatactattgttcaaaatctctttattatacaagccattttgaattttgattgtttgcaaccaaaattaacctaataaattaaaatgtactataatgttacatcataatttgtctgtactagtagtatttgctagaacgtttaggggaatacttgcttgttaactttttagtaaatataacactccatgttcaaatacatttggaaaatactgagcatttcacacttttagagactcaaaacaggcagcacatttttaaaaaataaaaataaaaccaaatagcattgcatttggagaatggtataaaaaaagagaatttgataaactggagttatcagaactcagtggatactatgtgttagacattattataagccattaaacattttacaagcttgatatctgagttaaaaattaataacccaaagacacattggaagagaaaagttgacatatttttattatattaatgacctaaaaatatcatagcaactaacgtcattatagtcaacaagtgaatgaacgtaaataatattaaataactattagaaagtctctctgattaagcatggaaataaataagcagtgcttttgaccaataaatggaggagttacaatactttccaatacaaaacaaaaagattctaaatgtaaaggtattaggcccaaaatatgttagtcaattcatgacagcagaaattcagcaggtcatatttttgaggtaatgtaaatgacaatagaaatcatggactaaagtgtaacaaataagtaatatctaggcaggtggaaattttaagatcttttaaattaacttctggactatagcaaaaattcaaactaaaattcatcagggagtcagggaaggtcaaatgaagaagcatggggactgaggcaaaaaccctgaattataccaatattatctttttttttttgagacaggatcttgctctgttacccaggctggagtgcagtggtgcaatcatagttcactgcaaccgcgacctcctaggctcaagggatcctcccacctcagcctcttgagtatctgggactacagaacctcatcaccaaaacacccatctaatttatttattttttgtaaagatgaggtctcactttgttgctcaggctgacaagtattatcttaatgttatagaaaaaaagtaattctggccatatataggtattattctttgcagtagaatatcatttcagaaatttgtgccaaacataaaattagttttctagtagtaaaaagtaattaaactctttaaattattattacccctagtatactggggaatgggtgtgtgttccaaatgaaaaaacttgggatgtctaatgagatgctgttttctgtcgcagaaaatctatgtaaaatgttttttctcacgtgtacactgttgatatttgagacagcacatgttaacacttcaagaagtaaaataaatgtgttgattatatccacagttttcatatttattaactacatatttcgtttttaatgtaatgcctattgaaaaacctgtaaatagttgtttcttaaaattgacaaatactgcctaagatttttctgtatattttcatatttcaattttcctgtgaggttagaatgaacactttagctaagacatttgtgcctccaaatcctaaacctttcagaatgttagtttattatttggtttttacctaaattattttctgcttattcaagaaccttaggtctatccagttacgtttttatttttttatttttatttttttattttgaaacaaagtctcgctctgttgccaaagctggagtgcattggcatgatctgggctcactgcaacctctgcctcccaggttcaagtgattctcctgcctcaacctcccgagtagctgggattacaggggcataccaccacacccagctaatttttgcatttttagtagagatggggtttcaccatgctggccaggctggtctcaaactcctgacttcaggtgatctgcccacctcaggatcccaaagtgctgggattataggcatgagccaccatgcctggctgtatccagttacatttttaagaccagccaggcttaatatatatttggtcttttgctcaattcaatttgttgcattttgtccattgtacttcatgtgacacagaatatatcttaatttaaaaagacatatgtttgttgagctatctgttacgttggtatatcttggaattttaaaaaatataaaccacagaagccaattatggctgacattaacaataaataggtttatcacagaaatagtggggaacttgtagaactgttgagaaggctagaaagccagatcaaagctaggcagccaggaaatgtaccccaaaccatgctgtagaactcatccagggaggaaaccactgtcaccaccagtaagaaataacaccgaagatgcaggcagcaacaattgcagcaattgctcaatcctaggctaactgcaaagccaccagcaccactcccacttgttcgctttgcaacagatattgtagcagctgctacatggcctccaccagaaacaagagaaagcataactgaatctgcttctttttttattaattccgaagtggaaattcagcactggcaaacagatgggcaaaacctaagtcatatgcttgtaccctagctgcaaaggaggctgagaaagcaagcatttggcattttagcttctaaagcaggaggtggtttcttgttttcgtcaaaactgagaggctgaggaattcctcaaacacagcaacaaacatcaaataataaattttcatgctttaacttgctcaatatcaatataaactttcccttttgaaagtaaacacgaaagacccaagcttccttctaacagagtgcaactatttctctaataattgaacatgtacctacaatctcttgaacaatgaaacaataaaaaattctcaatcacagcatgtactctaagtctaagaattctgggttatgtccattcctctacgaagttcttcactatactctcttgacattctgccatatatcatttaaaaattaagttaatcaccctcaataagccctgttttaaaaagagggataaatggagaggaaagaaggaaagttgttaagatacataagtatgcacaggacaatacaagagaaacaatgtgtttggatgtcaaggctctcctttctgcaagtggccagcaggtcactattggcatctatggccatgtgccctcagctaacacctctgctagtcagggttttgccttgtgagatgaccaaatattcattcctgacagagaaatgtccttgataatctttttgtgtgagcgtgccatggtcattgttaatttctttcatttaacaaaataatagactttattttttgagcagttttagctttatggaaagatcgagcagaaagtacagagttctcacatactgtcacctttatcccacccccagtttacattagggttcactctttgtgtggtacaggtctaggagttttgcaaaacgcataatgtcatgtacccatcattacattattaccaatgtattttcaatcccctaaaaatcgcctgtttcagaactatttatctccctacccatccccaaactcctggcaaccactgagcttttttgttgttgttgttgttacttagtttttatttcataatcataaacttaactcaactctgcaatccagctaggcatggaagggaacaaggaaaacatggaacccaaagggaactgcagcaagagcacaaagattctaggatattgcaagcaaatgtggtggaggggtgctctcctgagctacagaaggaatgggtctggtggtgaaaataaaacacaagtcaaactcattagaattgtccacagtcagcaatggtgatcttcttgctggtcttgctattcctgtacccaaagtgctccatggcttccacaatattcacacgttctttcaccttgccaaaggccacatgcttgccatccaaccactcagtcttggcagcacagatgaaaaactgggaaccatttgtgttgggtccagcatttgccatggacaagatgccagaacctgtatgctttcggatgaggttctcatcatcaaatttctccccatagatggacttgtcaccagtgccattatggcgtgtgaagtcaccaccctgacacataaaccctggaataattctgtgaaagcaggaacccttataacgaaatcctttctctccagtgctcagagcacgaaagttttccgctgtctttagaatcttgtctgcaaacagtttgatggagatgcggcccaagggcttgccgtcgacggtgatgtcaaaaaagacgacggagttgaccatggctgatagtacagggctcacagtgatggtggcgtctgcaaagataaccactgatctttttactgtctttatagtttgtccttttccagaatgtcgtatagttgaaatcacagtatgtacccttttcagactggcttctttcacttagcaaaatgtctttgttttttctgtatctttttgtggcttgatagttttttccttttagcactgaataatattccactgtaggaatataccacagtttgcttatgcagtcacctattgaaggataccttggttgcttccaagttgtggcagtcttcattaatttctttctttctttctttctttctttctttctttctttctttcttctttttttttttttttttttttttgagacagagtcttgctctgtcacccaggctggagtgaagtggcacaatctcagctcattgcaacctctgcctcccaggttcaagtgattctcttcctcagcctctggagtagctgggattacaggtgtgcaccaccacgcctggttagtcttcaggaatatttacaggactgtatagaattaggagccatcaaaggggatccctgaattctttctgtttttcttacaaataccagttttaaggtcaagatttactaccccatgcaacaatgtagccgcattttaaattttaaatttttgacagtttgtttaaaggtctcaggcaacctaaaaggctagatagaagtctctcatcctctaacgaaggatggattgtaaaatggaatactgctaagactctccctttgggtactaattctgcaaaaacctagaatctcagagacaagagacaagtatttggagtggatcattagatgtaatgacaaaaggagtcacttcaacgttcataacaaatatcaaagattgttgtattttttatatgggagacaccagacaagcttatacttagttactagttcagaggatacaccaccacatcgtctagcatgagtacaaccttataagccattgtctccagctggcactgtgattgagtctttaataaaatattcaccattgtataataataataattttggttggtgataggataaatggtggaccaggtgagtccaatgaatatctactcatttgttatacaacaagttcttttaatagaaggatgtagaacaggatattatggcagtatatataaggcattcaatgtacccatggagagtggcgatcagagaaaaatgatgtcaggtaaagcaaatgtaattcaaggataaaggtagattccatttacaaaattccttgttgcctttatcatagaggagctccagtaaaatcaacaagtctgacaaaaggtgactggtttattcacccaggatatgttattgtgtgcttagccttggactttgttgcttgtgtgttggacacctaatagtcttgacagctaaataggcttttgtaagcgagagtggtaaagtccaacatgttgctaaacctatgtgtattctctactgctaccaccaatgttgctgtttattagccttctgagcaagcaatgtagtgcctggtgaaagagattgtttcataccttcatatctatttgataaccttcctgatgatagtttggtgagcatttgtattaagcacaaatattcttacactctggctcattttctgtggttcatctacatattttttccccaaaactcattgccaccaatccttcagtgtttgtctttctgagtccctaattatcttttcttttcttttcttttttttttttttttgagacagagtttcactttgttgcccaggctggagtgcagtggtgcaatcttggttcactgcaacttcttcctcctggattcaagagattctcctgcctcagcctcccaagtagctaggattgcaggcacacaccaccacatctggctaatttttgtatttttagtagagacggagtttcaccatgtcagccaggctggtttcgaactcctgacctcagacaatccacctgtcctgtcctccaaaagttctgggattacaggtgtgaaccatcaggcctggccccaagtccctaattatctagacaaattattagctgccacatatacatcaataatatctctccttctagacatcgtggacaaccaattacataggctgaatttcttttaaaattgcattcacgtaggttataatgcctaagcaatctacttttggctgttgctgtgatgttgtacagtgacttctgtaaatcaggctcaatttttccctcactaatcaactggccatagagaacttcccatgaagacataggtatagattctattattcctacctgctgatgaagcaggatagttaattggaaaacacttatttcatgataagcagctcatgttgtcatatttttttgcattgataggacttcagtttctacaatggtccaggatcaatcaagagttctttaaagaaaacatttattttgtcaaagaaagaagcattttgttccaaatcctaagaacaatagtagtggtgtgtcagaggctctattgcatctggatataaaaacaaaggggcacaatattcctgaccagttgggaattattatcttgatctcaatcccatcaaaaggtggcagcatgacaagtcatgaagtaaaaggaccaggtgataaaatgaggtctccaaaatccaaagcatcaaagttctcagttagtggacagggctgcaaagtgccataatttttcactttggaaggtatatcttgagaatattgagtgtatgagacaagttaaaaggtcatgcagccagacgcggtggctcacgcctgtaatcccagcacttagggaagctgaggtaggcggatcatgaggtcaggagttcaagaccagcctggccaatatggtgaaaccgcatctctactaaaaatacaaaaattagtggggcatcgtggtgccctcctgcagtcccagctacttgggaggctgaggcagcagaatcgcttgaaccctgaaggcggaggttgcagtgagctgagttggcgccactgcatccagccttggcaacaccgcgagactctgtctcttaaaaaaaataaaaaaataaaaataaaaaaatttaaaagctcgtgattaacacctctgttagcctctgatctttataataattatcacacacacacaaaccaaacaccacacatagaggaaacagtaaaagattaaaggacacagctaaaaatacatttgtattattacttcccaaagttctaaaattatgagaagggactagtgaatctttaaaaaatattgattatccaacactttttaataaccagtataattgcattgaaggctactgaacatgcacatgttcctaaaatttttctgttatggtgtctggtttgcgaaaggaacaaaattaaacatagttccttggcaatttttccctcttccactctactaattggcgtatgtgcgatgtgtgtttattgtaaaataggaataagattcagaggtcaagaatcaaagtgagtcagagtaggaaaagccagactcaagcataacagaagggcagagcctgtcaaaccccaaaattaaagggtaaatttcaacacaagtagaagtggttcaaaagctaagggcatcctcatagttcatgaaaagcaagtattcacgcaggtagcagactctaatctgcttcaagccaatgtgctattctcttcgtgttatttatatccctcagaatacctcaaagttcccaagagcagtcagtatttaactctaaactatatcatctatatgatatatttattatatataatatatatattatatgtattatatattatatatttattatatgtataatatatattatatatttattatatatataatatatattatatatttattatatatatattatatattatatattatatttatatttattatatatataatatatatctgtttattattatatatttttttgagacggagttttgcttttgttgcccaggctggagtgcaatggtgctatctcggctcaccacaacctctgcctcccaggttcaagtgattctcctgcctcagcgtcctgagtagctgggattacagacatgtgccaccacgcctggttaattttgtatttttaatagagaaggggtttctccatgttagtcagtctggtattgaactcccatcctcaggtgatctgcctgcctcggcctcccaaagtgctgggattataggtgtgagccaacgtgcccagccaactatgtaatattttaattgtgtagtgataaccctcatcaaaaggagtattcattatggccagtgtactctgcttatttaccactaaagcttaacacaaaattgttgaaataaacatgcatattgaagtacttagctagctattgaggcaatacaggtttctagatttactcattgttttcactgtacacacatgtcatgtgtgtcatgataaacccatgtgtgtgcatatattgattaaatattatatttctttttacttttattattattattgagaaaaggtctcactctgtcgcccaggctggagtgcagtggcacaatctcggctgcctgcagccttgtcctcccaaagccctagaccctgtaacataatagaatatgtatgtttctaatttgtgcaatatggaagcaggaatactacatagaactgtcatcttttcctattgcatttattttggtgtggaaaaatctaataattggcttcagtcagtaagtctatttcattcaagaatatttaaatataatccaaaccatcttagatacattttgtgatacaagaggatggtatcttctatttggaaatataaaatcccagggtctcacagtttaagtatactttccaggggtatgtataaaacaagaatcccactttacaaagttaatagaaaaaaaatatgctaattggaaggagaggcttctgattgaggataaagtggaaattttcacatactgctaattacactttaatggagtaagaaaaaaagaattggaaatagtaccctataaaacttctgaaatgaaattacagtttctctctctctctttcttttttttttttcttgagatggagttttgctcttgttgcccaggcgagagtgcaaaggcgctatctcagcacactgcaaccttcacctcccgggtttaagtgattcttttgcctcagcctcccaagtagctgggattacaggcatgcaccaccatgcccgctaattttttgtatgtttagtgacccaccacgcctggctgtctcctctttttagaattaggagaactgatttttttcagtgctaaactggcactgtcctatgttttcaagaaagcaatatggtgaaatggaagagtctggatagcatgttttgttagctggtgtctagttctttaagttccatgagtctattgtgtcttctttacatctcaaaaagaagagagaagaaacctgcatctaattactgaagcagtttcattcagcaaatgtaattgcatcgcaggcacatctcaaattaaaaatcttgatcttggtctctgtcatttccattttaaactgggactgaataacctgttttgccactcaaaataatagccagtgtctctttcttattaaaatatgtgatcttttgcttgattacctaattatgtcacctgcaccttacgtgaggcagatagaagagtcttccagtctgccagagcagatctaccaaactagactgcacatacaaattacctggggatcctgataaattacagattctgagtctgctttcaaagagggcctcaagtcaagctgatggtattagtcccaggatccctcactgagtagcaaggtcttagaattaaaaagtgtgcaagtataaggccaggagcagtggctcatgcctgtaagcccagcactttgggaggccaaggcgggtggatcacctgaggtcaggagttcgagaccagcctggccaacatggtgaaaccccgtctctactaaaaatacaaaaaattagccaggtgtggtggcacgcacctgtaatcccagctactcagaaggctgaggcagaagaattgcttgaacctgggaggtggaggtagcagtgagccaagatcacgccactacactccagcctgggctccagcctgggcaacaacagcaaaactccataaaaaaaaaagtgcaagtttataaacatggaaacgtggacaattgtaagcaatattagagaactgtagaaaacaattttttaagtgatatgtttaacctatttagaataaaacccattagggtcctaggaatttctggaactgccttacttgtgagaaacatgatcctaagatgcccatttgtttatcagtacatcaattttctccttcttaaattggtataattattttcttccaagaagcctagcacacttttgttgttgtcattgaaagagggcatataagggttatggctgctatttggagaaatgcattagaaaataaaaagcttgaaaaagttgtattactgagaaaaaagttgaatgaaaataagaaagattaaattgaaataaataatgaatcagtaaggtatgcactgttaaacacttgatgggatttcccaagtattgacatgctgataacttgaaataagaatgggagaaaaggtcaatctgaattcttaaaatgttgaaggctgggaataagaagtaatatatcacagaatctgatagaaaaatttttatttattttatgggagaaaatgggagactaacagacaataggaataggaaagaattaatagaaatagcaaaaagaagtgtatctgcaattattaatataatacaagaggaaattgtgtagagatatttaaagaaagattgatgaaatttagatttatggagaaatatcctaataaaggcattatttataatcaactgttcataattattatataattctgacagtttttaggatataaatgtaaggcagaatgatctaatataaaatgtataaatgggacaacatataattttgcttaggaaattgaataaataaagtagtgatttacgatttgcattaatataaaaaaatttaaaatggtttacatcttgtttgaaatggatgataaacaggaaaagagtaatttagtacattgagtaatttagtacattggtcaccaaagaaatacaaattgaaactataagatgccttctcccatctttgtcagatttgtaggtataaaaacagtagtagttgtattggttggagaacagaaagatgacactttcatatgcggctgattagagcacagattggtatattatttctgagatgcaatttgaaaatatgtaccatcagcctcaaagatgattatgaccatgtgtcactactttcttggaaatcattattaatgcatgtatagattgatgtttactgtagtattacttaacataatgagttgagtacaaccttcactcccaaaaaacatgaggtaggggtgaattagttaaatatacaatcacaatgagctatgacaaaatgcagttacttaaaagcacatttataagactattaatggcaataaacatgatttgatataattttttcaaaaattaggggaattctattcctagcattgtgacagactaaatttgctgaatcactatcctgctatatgaaatctacaaataccagataaaatgtacatgtcatttttcaaaagtatattactgacttgaatagaaattaaggtgaaccacataggccaagcataaggagaatacataaatccagagaggtatgcagacccccaaaccagaagcttccataaggacagtcctggccctagtaccctgagcttcaatttttatgaccacctgggatatgggagagtgtgagacaaaacctagtgcctgcccagtatagcagtcttacaggagaaaactgctgaaagccagagatatgaaggactataatttcagtgaaaggataaactagataaaaacctgttcctcagggggagacaaccaggaaattttcctgcctcaaactcggtgctatttagaggaaaaattagaaggccatcttcacatgaatttgtggtttaaattttcactgtaagtataattttaaaaaaacccacacatgaaactgataatttattttatagttatcccatgttggtattaccaccaaacacaagacgaaggcaaagtgtctttggagaaacccacattcagcccatgtctcaaagaatggccacaggtaaaatttcatccaaaatgagaaaaaagtaagactcttacaaaactcatgaggaaataaacatcatgagcagaaacagaattatgcccataaagatttcagatattaggatgattatataactataaaagctgtgtttaataggtttaaaaaatcaatgaggtgtgccaggaatataaattgagacagtgtatgtatcttatgttaagcagattgaaactgaacttaagagatcttttagaaataaaaaatataatgaaaattaaaaactaaatggacaggttaaacacaatattggatagaaccaaaaagaaaataagtgagttggaagttagactaaacaaattatgctgaagacagtacagaggaggaaaggaaaatggataggtgaaatagaggttgaaaaattagagtatctaatcatatctgcaaaagaaaaattgaattgggggaaggttatatttaaggttatatttaatatctgagggcttttcatcattggaatttattaatgttcaaggaaacctggaaagttttctaacacattaaaggagctttaattataagttccaaattcttcttagaagaagagaaccagcaggcccagacatttttactggtgagttctatcaaatgttttcaagaaattgattatttccattttataaaaacaactccagaataaaaaaaggtccatttgtttgttcattttatgaggccagtacaaccttgataccaatgttatatgagaaatgtgtaagacaggaaaattacatgccaactttcctcatgaacctaacggcaaacattttaaattaaaagttagcaaattaagtttagaaatctgtaaaaaagataatatagtatgaaaattgtgtttgttccatgaatgcaaggatttctaacaatagaaaaaaaactatgtataattcatcacattaacaagttaaaggaggaaaagcaaatcatcattgtagaagaggcaaaaagtgaattcaataaaataaaatatttaactttgacaaatcttgtttagcaaacaagaaatagaagagctttcagtgtttgcttataaatcagaaactattcttcgtctttcaagcagaggtgatttaatacaggtgattgattacacaagtgatggaagccaaaccaggcttggtgagtcagcagctcaagagcaagaaaccagtactgcccctaggactagaaggatcatggaagaaggtgttattatcagagccaaggggccaggacttcaggcaggttgctagagctaatgggaattgggtccatggagggaggggctatctggtgggaagcagccctgcagagaagaggcaggcttttatggcatctctcactggatagcctactgggaaaatggagggcaaaggagactgggaaataaatgttattttcctgaaacatagaacagagttggagagtaatttgggagggatctgggggcaaatttgtcaggacccaagacatgattaaagcaggcagggaaaagagatgctggtcaaagcaggtggcctttgctggtatttcaaagtcctagttttaaaactcagaggttttaaattattatcttattactaatcagatattttatacatatttaatatatttatatattaaatatttaattataattcaaaacttttatgtacactataatctcattattgttttctatactattatatacaatatacaaatacagaaatacagaaatgtacctcagtttgaaagagaatttgaatatgaggcaaaaaatacccccaaattatagttacattacaagaattgaatttaagaaggaagaagcaaattgcaagagataagaccaagcctctttagtaatgatcattctaaatccaattggtataaatttagagatgcacaactggattgcagtgtaactaagaaagtttgtgtgtcaaaaaccatatttatcctatgtgaagaaataatagtttcataggagaaggttaattggcatggagtctgtaaaagagaagtttggatagatgatcgagctatatatttgtcaaataatatctaaaggtaaaaagatctagttcacagaggcgaatctctgattttttaatttgcattaacagaaacaacattggaagggagtatattaagattttaatagtgactatttctgccaatggtttctgttttattgtttactattttcggtatatttccaatgtttcttaataagtgtttattatttaaaaaatgagaaaacagcaatgagtaattcagtaaaataaaatttttcaaaattgtgactgctatgattatgagccaattatgaaagaaagagacacagatagaaatagggtgaccaatctttcaacttactcaggaatgaaggattttctggatgggggatttttgttgctaaaatcgggacagtaggggacatattgggactgtggaaaaagcctacagggatttatttcctaactatgaatgtctatcttggtctagagacgactgttctcataaataggtagagtagatgtggtatttctggaatgagatttaacatctttacgtagcttgccctattaaaagtagacaaatgcttgtgagagaatatcatatacttttgaaagctaatgtcttaactaatttgctgcaagcaaagctcttgaagactgtgatgtaacagagattcctaggtatcagtgaagatacggagatgaaaaagggaagttgaaaaaagaagctgagagataagcatggaaatcattttccaacctcatttttccagtctccattttcctgtattgagaagtgaaaatatgttttctagagataaagttctagaaatgaactctgacatagatattttaaaaccaatttcagaaacaaaataatatgtgaacctagagtagttgtaatttatgtccttttgtttgtctttatcctgtagttaagtttcccttgggatctctttgggaaaatggagtactgcattttacaaggcaggacttgaattttctttcttttccttctttctctctttcttcctttctttctttccttttcttctttcttctttctctctttttctttctttcttcctttccttccttcctttttcttttctttctttctctctttctttcttcctctctctctttttctcttctttctttctttctttctttgttcctttctttctttcttcttttccttccttccttccttcctcttcttcctttctttctcctttctttttattttttttgacatgatctcactttgtcacccaggctagagtgcagtgatgtgatcatagcttaatgcagcctctctctcctgggctcaagcaatcctcccacctcagcttccagagtacctggggctacagctgtgtgccaccacgcccagctaaaggacttgaattttcttacatatcttggccctatagagtggttctcaaccttggctgcacatgtctattacctgagaaaagttttaaataacctaatactcaggtcacaccctagactttaggggtgagacaagcattaatattttttaacactcttagaattaagagccactaatattgtagcattgcaattcctataaagagaacagatgtgagtcaatttgttacagtattgttgtattcatctgttttcatgctgctgataaggacatacctgagaccgggcaatttacaaaagaaagaggtttaatggacttacagttccacatgggtggggaggcctcaaaatcatggtggaggacaaagaggagcaagtcacatcttacatggatagcagcaggcaaagagacagcttgtgcagggaaactcccattttaaaaatgatcagatctcatgagacttactcactaacacaagaacagcacaggaaagacccatcctcatgattcagttatctcccactgggcacctcccacaacatgtgggaattatgggagctacaagatgagattgggtgtggacacagccaaaccatatcaattgtcatcactcaaggcagatgagtatatagaaagctatcagttgtaaggaattggactaagtttaagagaataataattaagatagaacaaatgtttggtcctgcttaagggctaggatagatgaggcacaatagaatcatgtggggagctgtaaaaatgcccaggccctactctgtgtcaattaaatcagaatccagaatctctgcttgagtgtgtctagagtattggtcaaaggaaacagtgattttgatgtgcagccagttaagagctgatatcctcaaggatcatgatgtgacacagctgtttcagaagggtaaatctccatactcccactttagaagaaaagaaaagacaaaatgacaaaacaatcaagcaaaagggctggaagagctggtagataacagggtgtcaacttgaattaattcagctctttggtaaagattagctggagtaaagaaattccagttagtcaaatgggatgaatgtccttttatggaaaccatatcatgctttttgaatgatctgagaaagactggaagcattagaggtgaagtatatccatttgctcaatgggagaagattttgttttattttatttacataatgtgatatgcttggccatctgcagtagtgcctgaaaggggatgtaaaacggaaaatgtagtcaatgagactgattaataaccctgggtagaaaaataggccaagtggaaaaacttattcatataattgcttcattttgctgactgcaaaaggatttgttttggaagtgatttctgctctttaacctagtggattgatagatcacagaaaggtcttagaaatgacattacgtaattttgttcataacatgaaattagcttgaatcaaaaaatgtatacctttttttgtatctaccttctaagacatttgtcttgagaaattaatgattctacaacataaatagtcattgtgaaaggaaggaaaaagataacagagggctttcataataatcatggactcaagattatctaatttaaaaagacatatctcattttcctttatttaaacataaaacaaatgagagaaaacagaaatagctcataattttatttatctgataaaacatgctgacataaaaatataattcatgcacccagtaagaaaatcaaaaaattaaataaaggtaaaaatgaaatataaaattctctttcctctagtctcttacccccagacatctagaatctctccttaagataatcactgttgacaatttcttgagtacctttttaaaaatgaccttaatacacatcccccgtatagaatatagatcttaaacaagttagaaaataaaattttatcttttagtattacacaaaaggatgttcagaactaagctttgtatttttttttttctagagatgaggtctcactgtgttgcccaggttggtctcaaactcctgggctcaagcaatcctccagcctcagtctccaaaagtgttgggattacaagcatgacatgaagtcttgcctggcctaggctttctatttttgtttaataatttaccttcaagatattcttaacttttaacaactgtattgtataaatatattttttatttaaacaataggctaccaataacattaataacatatcttggtttatgtattttacaagattctccaagtgataaattccaacctgaaaagttgctatagaacatatgaatttaacattttttaattgctgcgatctaatatgatcctaaaacatggccctagtttatattcctatgagaatgtctaatacctacactcttgctaacattgactgctattgcattttaaagactaatttgattggattgatgttgaacatcttctgttactcctggccattacatttctttttctacctattaatctcccttgtataatattgcattattcgtcttttttgtctcatttatcgacaaagattaaagttattggcagtagtgaaaatggagaaaaaaatcaaaattcaaatactgtagagtacaatattttggagaataatttgattctatatattgaaatttaaattgtctttaatctttgacccagttattctatttctagtaatttttctacccaaataataatacaggaaaaaaacctttacagagattattcttataatgtttgtgatacaatatttacaggcaacataaattctcatccagagatcagagtaaatattatatagtatatctgtagaatgaaatgtaccttgctgtttaaatgagtaaattagttattatcataaaataaatgtcatgtaaagacatttattttatggtgtataaaattagaaaaacaagttattaaaaataacatgattttttgtaaaatgcttttattttgtttttaattgacataataattgcacatgtttatggggtacagtgtggtgctttagtgcatgtgtacattgcgtaatggtcaaatttaaaaattaaatgtattgatagaaaaagtgtttggatatttgtatcctaaatgctaacagtgatgatatctggaatgtggaactgctggtaatttttccctttttcttttagagatttttgtacttatttttaataataaacatatactaattttataataaaaataacaatgaagtcctttccattttgaaaaattaattccaatagaaaaatattgtacttgagccactttccagggttttcttattcttagtgctggtataaggtaccagtgatattatattttcagatatgtttggcttttctgccttatggttgaagatgagcttaggaagtattgctgcctaattttcaggcttttgagccaatgcttggtgcacaaaaagcaccacatcaactttaaacagaatattctgcttctttagactgtatttcctactttttatagtatttattagcgccagaactctgtgactgtttcccaaagaacaagagagaaagatcaaggaaagtgagaagcaatgaaactagatttaattaatactctggcttgtcagcagccagatttgtttgttgaagaagttgaacctattagcttaaacagggattaactctgccaactctgacagagcatggacaattaagagtttattggaaattaattgaaaataatacagtgttgtgaggtgagatgaagatgatttcctttaaggaaattatgccaagtgttttgaatcagccaaggataaacaaatgcagactatcatttgatggaggtattataaactgataacatgattcgaagtataagaatggcaaattgtgaagaatgaatgaaattacagagataaatagcaaaaatgtgaaactaaaataaagaggaacagtgagtaaatggggttagctgagaatatggtttaacagggcatactctattcatttatgaagaaattttaatcctcaaaatgctacttgtcttagtctgtgtaggctgctgtaacaaaataccacaagctgagtaacttataaacaacagaaatttcttacagttgtgcaggctgggaagtccaatatcaaggcagattcagcatctggggtgaggttcacccttctggctcatagatggcaacttcctgctgtatccccatactttggaaggggccaatgagctctctgggatctcttttataagggcacaaatcccattcatgagaatcttgtcctcatgacctaatcacctccccaaggctctatctcctaacacgagtagtttgggggttaggatttcaatatacaaatttggggggacataaacagtcagtctgtgacattgccatttcatcagtaagaattttcatgaactcactattaagatttatgtttaggttttttatgtggatgttctcactttataatattgtttgtctgcatagtttaaagaaaaggacaatgcccaattagaacaggaggtgtcttttgttggccagcaaaatattttaagatgcctttagtgtgaccctacatagagatcatcaaggtaacatcattttgttcttgttatagatccacatgtttcactcaagatcccagaaagaaaatgtatgaaaacacattgaaagacaataatccatccttacaatgctagccaatgtttattattgctttctatgtgtgaggaattgtgttaaacacttaaaaagatgttatccctcataattatcataacacctgaagaagtaggtggggtgattttctccaatttagatattataggaactgaaacacttgcccactaaacaggcaattgaaagagataggatttctatagaaaattgccagctccacagctagtgttcctattctcatcattagtgttcccttagtggttttgatattacacctaatactatttaatacaaaattaaagcatccaccctattctgggatttactgtcaagaatagagcactgagcctgataaacagtatccactttggaatgcatgtttctatccagctacttaatatgacataagttcattggacattaaggccagatttcttgacatgctttaccctcaaattaacaagtttggcttattcaattgtggacctttaacccttaggccagatagtatatgaggcctagagtagtggaaaaaggtaactggatttacaaaatttgactcttcaaattctgtaagaattcaatatattgaggaaagtttaggtgcatagtaaaattataatttcatattgttgcacagactcaggcagatgaaagagactccaatagtggtcaggtagtacccagacagtcagttgattgtctctgtgctgaaaggatttaagaatgaagaagagtttgctccaatgtatgtttcaatatctcattgttttacaataatatttgaaataatacctaggaacccaacttacaagggatgtgaaggacctattcaaggagaactacaaaccactgctcaaggaaataaaagaggacacaaacaaatggaagaacattccatgctcatggataggaagaatcaatatcgtgaaaatggccatactgcccaaggtaatttatagattcaatgccatccccatcaagctaccaatgactttctttacagaattggaaaaaaactactttaaagttcatacggaaacaaaaaagagcccgcattgccaagtcaatcctaagcgaaaagaacaaagctggaggcatcacgctacctgacttcaaactagactacgaggctacagtaaccaaaacagcatggtacttgtaccaaaacagagatatagaccaatggaacagaacagagccctcagaaataacaccacacatctacaaccatctgatctttgacaaacctgacaaaagcaagaaatggggaaaggattccttatttaataaatggtgctgggaaaactggctagccatatgtagagagctgaaactgggtcccttccttacaccttttacaaaaattaattcaagatggattaaagacttacatgttagacctaaaaccataaaaaccctagaagaaaacctagcaataccattcaggacacaggcatggcaaggacttcatgtctaaaacactgaaagcaatggcaataaaagccaaaattgacaaatgggatctaattaaactaaagagctcctacacagcaaaagaaactgccatcagagtgaacaggcagcctacagaatgggagaacatttttgcaatctactcatctgacaaagggctaatatccagaatctacaatgaactcaaacaaatttacaagaaaaaacaaacaaccccaacaacaagtgggagaagtatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttcacactgttggtgggactgtaaactggttaaatcattgtggaagacagtgtggtgattcctcaaggatctagaactagaaataccatttgacctagccatcccattactgggtatatacccaaaggattataaatcatgctgctataaagacacacgcacacgtatgtttattgcggcactattcacaatagcaaagacttggaaccaacctaaatgtccatcagtgatagactggattaagaaaatgtggcacatatacaccatggaatactatgcagccataaaaaaggatgagttcatgtcctttgtagggacatggatgaagctggaaaccatcattctcggcaaactatcacaaggacaaaaaaacaaacaccgcatgttctcactcacaggtgggaattgaacaatgaggacacatggatacaggaaagggaacatcacacactgtggcctgctctgtggtggggggctggggggagggatagcattaggagatatacctaatgtaaaagatgagttaatgggtgcagcacaccaacatggcacatgtatacatatgtaacaaacctgcacgttgtgcacatgtaccctagaacttaaaatataataaaaaaaaattaaaatattctgcagtcacagtgactgtcttggcttctcttaatttatgaggacctttgtcttatagactcttttttaaaaaaaaagatggggtcttgctatgttgtccatgctggagtgcagtggctattcacaggcttgatcattgcatactacagtctggaactcctggactcaagtctcccagtggctgggaatacaggtgagtgcctaccacacctagcctgatttacagatttttgacatctattatagttaaatgtattttcagcatttgcatattaaaggaataatattgatgcttaacttcattagtgatcagggaattccaaatttaaaaaaatttttttcatctcttatagtatatttaaaaattcattgctgataaggattcagggacgccaacattgtacattggtagtgaaaatgtaaattggaaactttctgtaatctgacagtaattatttttttaaaaatccttttgaacttgcagttctacttttgggatttgaatttatggaaagtaaagtgccagtgagaaagaatattgttgccccttgaacaacatagggttaggggagctggcctcccacacagtgaaaaatccgcatacaacttttgattccccccaaactaataacctattgttgaccagaaggcttactgataacatgcgttacatttaagacatattttgcatgctatgtgtattatatactgtattcttacaataaactaagctacagaaaagaaattataatcaagaaaattgtaaggaagagaaaatatatgacccattcattaagtggaagtggatcatcctaaaggtcttcatcattgttgtcttcatgttgagtaggcagaggaggaggaggaggagctggtctttgtgtcttagggtagcagaggtggaagagggtgaagggatggaaggggaagcaaaagaggcaagcacacttggtgaaactttacaaaaatacatcattatttctgtctattttgctttttcatttctctaaaaacctttcagtgtagtacctatccgtcttccaccatttgctttagtttcagttcctgtatcatggaacggtctatgtcataaaagaagtcaaaagtagtcttgaataatcaaagctcttttgccagattgttgaatgccaatttgttttctggcactgcttttcctatgtcttcttcctcattatctggcactggttaggaagcactcatctccatgaagtcatcttttgttaattcctctggtgtggtgtgtattagctcttaaattcctccaagatccatatcttgcaacccttcactccacacctttttttcccttcatatccatacttctttccatggttttctctaaattgggtttgtcgtaattctgtagctatgcacaaaatctggacacaaattgtacttttgtccagcaggaatttattgttttgagtttcatggttttctatatcaactgatgacatcttgaaaggtgtaagccttccagacttccatgatgttctctgtattgggtttctcttttgcaatgttgacaaacctttccatagagtgccatatgtagagccttaaaggtccttatgactcccttatctagaggctgaagtagagatgtgtttgggggaaaaggagaacacttcagtgcctttggtgttgaactcatggggttctgggtggccagggggcattttccaattaaacaacaacaacaaaaaactttaaaaagcagtcccttactggcaaggtacttctgacttcagggacaaagcactgatggaactaatccagaaaaagcattctcatagtccaggccttcttgttgtacaaccaaaagactggcaactagtgtttctcttttccctttcaagactcaggggttagcagctttatagttaagggcagccctgatcataaacccgactacatttgcacaaagcagtagagttagcctatcccttcctgccttaaatcttggtgcttgcttctcttccttactaataaatgacctttgtggcttttatttttccccctggaatagggcactttcagctgcattaatacctattcaggcagatatcctttctcctcaatgtttttcttaacggcatttgagaattcacttgctggttcttggttggcagaagttgctactcccattatcctgacatttttaaaaccaaaccactttctaaaattatcaaatcatcctttgctgccattaaattctccagctttagatctttcatcttgcttttactttaagttgtcaaataatgacttcgctatttcttgaatcaaataagagtctataggtatgtctttcttatagcaattctgtaccccacataaaagctgcattttgaatatgagataagaaaggacaaggttttcatgcctgttggcatgaaatgaggccttatgaatttctcttttttttttttaagggaccttacactggattcatttattttgaaatggcaggcagctgaagaactcaatctataggaagcaatctaactttttctcataatgtcacaacttttctctgcttcttgggagcactcccagcatcacttgtggcactttgtattggtctcatggtgttattcaagatttatagtattacactaagcacaatgaaaagagaactgtgagagaacacactatttacttagatacagaatttactgaagagaccaagtgctcatggcagatactggcaacatgagctcaccacagtagcaacagggggtggctacaaaattattataatagtacatacactggaaagtagacgctggagaatattccaaaagatgccagggttggaggggagtgagggttgaaaaattattattgggtacaatgttcactattggggtgatgagtacagtaaaagctcagacttcaccactagcaatatatccaaataacaaaacaatcatataataaaagtatgcttgtacctagcacatttataaaaataaaataaaactaattatttgggtagtacagtatgtgctatagttaattgtatgcagttgtggtttaatacagcatctttatgtttgtttatgtttctcttgactgcaaatagtgacttgtacggtttgtgtgcatacattttgataagttttaactttttataatagatttgtgtatattttatggtagtaaatgataaaatagattaacatatacatatactttatgcattcaggatgtacatagctttttcttaatttttttcttatattctaggctatgcagttagtctgctagttttttcaattgcaattctccaaaactttttctgatatatttatttttttaaaaaaataccagtgtaggcggacctgcacagttgaaacccatgttgttccaaggtcaactaaaaaatctgaaatctgaaatgcttcaaaattggaaacattttgagcactgatatgatgccacaggtgaaaaatttcacatatgacattatatgactggtcacagccaaaagacagtcaaaattttgtttcttgcacaaaattttacaaatacataaaattaccttcaggctacatgtatactatatgtagggaatgtaaataaatttagattgggtctcattcctaacatatcatgttatgatatgaaaatatttcaaaatttgaaaaaatccaaaatctacaatatttttggtcccaagcatttcatataagggataccatactccagaatgttagaatgtttatggctactttgtttgtagtacagggggaaaaaaatcatgatgagtctccatcagtaaaaagatagtttaaaaacttgtagaatttagtcatatacatatatttacacatgcatatatgcacacatattatttttctctatatagagaaactgtgcattcatttaaagtgatatttcctctttttgttaattgacttggagaaatgttcatactgtattgataagttggaaaatcagtttgtttacatgaggtgaagtggaaaagttaaactacattataaagtacattataggcttttcaaagggcaaaaaagtgtcacctgagatgaggcaatgaagtgctcatggccattcatccctgttttacaccaatagaaagaaaagtttggaaaatgatggatttctcaataaaatttcaaggaagtagagataaatatgttactgtactaatgtattcatgtcttcttaagagaaatggaactccaaatttttagaatttttgaataggaatgatagaggaaagaaaacagaacactagtgactccggcattgtctgaagctgaggactgggctgtgggtaaccaacaggtgatattactttagcctgaataatccagacgttatgatgttttggcctctgtgtccaagactcttgtagatttcttgtcaggccacaattctttgagtgagagtaatattttttcagtaggcaaaaatcccttgaaagatcaatccagggacatttataataaagataggattagaaggtagactttaggctagggttagggttggaaaaatcaaaacacgttgttctctttagagtgagaaattggtttatcccagactttgaaagataatataatctataaccctctggttatgggaaagaagagacctacatgtggccatcttgggagcaaggcagagagcaggctggaagatcttctaggatggatatggacttgtgaaatgcagtagttaaacaaagttttctcagagttacatttgccttccatcattcctgaacactcatgtcatcatgaaattagaagagctgatccaatactattgataaggaaagagactctcctttccccaaagcgagagatagcagcaataatcagataatggcccagaagatggatgatcatacacacggcttgtgtgaggcttatggaagataaaacaaccacaatatttcagaaatgtttatatgttgtttacagttctaccactacaaagccttctagaatgtgagacagaatggtgtgatgattattcttagtataaccagattaagtaagatttcacaggtggagttaagaattaagaatttttgattcaagagtctcattcaccctcttccttctttgttaatagttctgttaggatctgcctttaatttgtcttttcctttagggcgctcaaaacaacacaaggattaaatgcctttctatggtcaaagttctctccttatttgccagttctttttttcatgtcccaatcataatcttaatggtatcgttgatcactcaagcaactaaccctgaagactgcccagtcgcaggagccaatacatctttttatgtttaaactcaatcacttcaaatgttgatcttaccttgtataatagaaattagtcgtagagactgtggtgggatgagatagcattgcgggtaatctggctcagctatggctgagtggaagaaacttgcatcaattatttatggttaatacagagtatcctagatcgtagttgtggactgaatacagacattcagctccctcccccactgagctctcataacaatgcagggactggaaagaatgtcagcatatgggatgggagaatgagaagacgggagcttcttgggcagatattacgtagtgaggaagcagtgggtgagaacattcagtgagagaccacaatgtaaggagaaagtctatctgacgagtggaagcagagactccagactcagaacctttggtacgaagagtaactacagcaaacgggcaaagaatagattgtgaatttggaggttatgtgcttccttctggcacatgaaaaaactcctaaagctttttgtgggtccaaaatgaaataaaaatctttccccattggtatgaaaataagttaattagcttttacaatggtttgtttttgtgttactagtttccagttgtggctgtttctctcagtttctctctgttttggtttgtttgtttgttgctgttttccttctcttaggaaactttggcagataattgggcacagaaattggtcattttttaaacactctaggttagtgattctcatagtccctagacatcggtatcagtattacccggcaacttgttagatatgcaaattctcaaatcttacctactgagtcatatactgccaagtgagccaaggaatccgtttaattaggctttgcaggtggttctgatgcacactcaagttgaaccactgctgaagccataactattggagacaatcttgcatagcttgaaaaatggagagctctaactgttggtaaggctttgctttatttgtcttaagaaagcattaatgagaatagctttgtgtttctttgaagttctgggtgcttctgaaaactctaaaggttttcaagcatttaaatttctctagcccttttctcaaacaaacaaaaaaccccaaacaaggaaaatctcatagaaatataaaaatgagttaaaataagttgtgaggaatattctatacatcaacagtaaagtattactcaacctcaaaaattacatctctaccataatctataatctgactggataaggactataaataaatagcatatgaaagtctacaataaagcagggagaaaatcatcactggctccgaatttgataatgacttcttgttgtatgtatgtaaatatcttctgaacaaattattgtacattttcctatctctggagaaaattaatgaattaggttaaacaatttcttaagtttaatggagcttctgttttccttggcttatgtatactagcacaggtaacttgctgaactgcagctcagaagaaaaaatctatagagaggtttagttctgaggtgaattaatggactttgttgctatgtcagaaggcgagaagcaagggaaggcaggcgggtaagagaatcgcataacgcaaaggacttcagtgcttcagaacaaaattgaagcgtttcaaaaatttgactgaagtaaagttcagtaatatttttaatcatgggaaatccttggataaatgtatatggtttgataattttggtttaaattaattatgttttttctctgattttatcacaatcttagaattaatgttagcatatttttctggtttataaaatattttaacttaccagagctttctagatgtcccctactcgatttaaggctcagctgaattgaattattaaactagtattttttaaaacatttgttcctgtaacttgagatggggctacaaataattatactgtataggtaaaaccacacataccctacctggtaaaaaattcaaatttcatatgtaacacaattttcatgtaaatttttatattttagtataaattctctgcagtgtgtcagtttaaaatgaattttaacatactagttagctttatgagcttggctaatatttcattgagataattagtgaaaaatctttggataagtctcataaaatttttaacatatccttgctgcatatttttacacattatagagtggctatcaagtaggagaatgaacagtatgtaaaagtacccttagttctgattaatgcacatgttcttttatactactttaagaaattaagtcagtttgagtatttagaaaagtgcatgcaatataattaatgtgtttttgcttatcaaggcaaagagagtaattttgtctaaaaggcaaattgtagagttttgctagaatataaaactgaattttaaaatacaaatttaagggcatacaataattgtagaatatctgagggaagtaaacttcatttgctatagcttataatagctgcaaataatgagtttaaatgagcaataaaacgtttataatttttggactaactttactcaatgttaattagtttgggcataaaacataaaagaacttttgagtcttttagtcaatttgttaaatggatggtctcaaaaaagtcatattagtatttgggttacctttttgataaaataataaatcaatctccatatattagcctttttttttttttgagacaaagtcttgctcttgtccctcaggctggagtgcaatggcgccatcttggctcactgcagcctctgcctcccgggttccagtgattctcctgcctcagcctcctgagtagctgggattacaggcgcctgccaccatgcctggctaatttttgtatttttagtagaaatgggatttcaccatgttggccaggctggtctcgaacccctgacctcaggtgatccaccctcctcggcctcccaaagtgttgggattacaggcgtgagccaccactcccggccatatattagttttttagcaaaaatttaacacttgtattctccacagtgtcctaccggattagatatagctctcctggactaaattgtttctcacccacagcaatattgccatccgggagaaaagagatttatagtagtttactttgtactcctagaaatcctttcaagaagtataaaagtgaatacatacatatttaaatgataaacatttatctttgtgataaaatagttaagtttccatgtgagtcaggtttaccacatgagtgatgaaccagctttaattaacaatataaccattctcctctgtcactgtaggctgttctaaaaaaagaaaaaagtttacaaaagccttaattaccttatgctatttggggagaattaagcaatgaatggagtgttgcatttaacaggttatagaaaatttttctgtgtccagcatataatcaactactaattttcagactggtttggcacaatatagattttctgccactgaatagaaactaaaaaatttgaaagtcagaaaattatttcccaggttctgaaagatatcaacaaagatatttttaattgactatgtatgattattgatttgagatttaatataccatgtctatgagaattctttgtaatacttctgcagtgtaatttgctacataatgaaaattcatttttcataataaatagttttcagaagtcatgttatctttcttgctcccagcaagtagctctatttcttggccacattgaggaatcaaaatctaatgtaattcttctaaatagaatagagaacacctagagtcgctgctcctatgacaaatctttggataacaactctcatgtgcgtaagacattttctgatctcttctgtacttcaacttgtaaagaactttggacattacagtcagaaagtctgctattcctacaaagacaaaaggggaagcctctaaattccctgagtagtggggataattagctttcatactcatctgctgacccctgattatcagaagacatttttatctctttggcatgccccatcacctgctgtctgtctccaaaagacctgtagatcagagcaggcattgtaaggcagggacagttcctgaaatttccaattaactgatgatgggaaagctcagaaacacaaactctggggagtggctgcctggtactgctaatactcctgctggaaacaggggcacctgggctacaaacaaacgtaagactttggaagaaggtgcgttaacttaattctgcctttcacatgtgagctcccaatttcccttgtggctatgagccacaagggcccaaattcaatgggagggtggttcgggtctatcatgacaagccaggatggaggagacagaggtcagttattgggagcccagattcttgccctttagaaacatgtgctgtagcagagaggaacccactacagctgggatcctggactgacacagcgagtgggtagtccatccagggtcacctgattgatagcaggcccttcacatctgcagcccccacctgtgacactgtttttgataccatattctccaaatttaaccctcaaatccaaaatagtaaaactactgagatgttatttatgaatacagtatctctgggtttctcagatggctgctgggaaactccagagatcctcctcctagctcttaacatgaagatatattagaaataaaggtaatgttttgcattctccagatatttaattggctcaaaactatgctcaatatagtggaagctgctgtgtttttcaaggccatattctgagaaaatagcaataaaatcatcttaaattaattaaatgcaataattatgtatgattactgtggctatgttacaataattgtgcacttctcaggttggattcaggcatatttatgttcatgtacaaagactggtgcaataaatgtcaaccaactgattaaaaaaagtaaacttctcagttggtgacaaataataatatctactttgtggggaaaattaaaggccctggagaggtatcgggatgcactaattgttcttcatgtgttctgtcttttacggtaatcactgattaaaatttcattagatgagtatgtattacacctcaacagagaatgccactgtcccccattgtgatgtcgtttgctatggcaaaaaattaaccaaactttacagttttattattagcaacatctcctccccctatccccgctgcttttttttttttttttttagatggaatctcgctctgttgcccaggctggagtgcagtggtatgacctcagctcactgcaaactctacctctcgggttcaagctgtcctcctacctcagcctcccgagtagctatattcaggtgcccgccaccatgcatggctaatttttctattttcagtagacacagggtttcaccatgttggccaggctggtctcaaactccggacctcaagtgatctgcctgcctcagcctcctaaagtgttgggattacagacatgagccactgtgcccagccctcctttccctttaagcatacctaaaagcctctctacaaagcgccaatcagaatttgagtcatctggaagaaatatcaaaagagctccagtaataacggtagcagacactgttgatactattgataccacaggaaattgactcatggatataggcctccaagaataggctgaccttgtccccacagacaatattccaactatacgaagtaaatgagtcaggagttccaagacactcacaatgtagaagcggatgaattcatgaaagtagactgcttaactcaagaccagcacgacaagaggttgttatttaggattaaagggcctcagtaaggcaatttaattgaggttagtttaattttctactttaatgaacatgagaacaacccattttctttcttcttaatctacctttaatctccaattaaatttacaaattattaaatttgtaaaaactaaataaaacactctgaattcttagtgttgagggaaaaaataccttgcagaaattcttaatataaaaacaaagctaataagttgccaagaaaaacatacaaataattattttgtaaagaattgtgacatacaatatttggttttgtctattaacatacccttaattagcaatattggttaaatcttgcacaaagtttctttaataaaaacatttactttttgtgactatgtagttatttatattggttcaataagaatttgtcctcccttctacctgaatatattactaattagaattttttttttttttttgagatggagtcttgctctgttgcccaggctggagtgcaatggcgtgatctcaactcactgcaacctctcaatcttgggctcaagcacttctcccacctcagcctcccaggtagctgggattacaggcacccaccatcatgctaggctactatttgtatttttatagagacggggtttcaccatgttggcctggctggtcttaaactcctgacctcaggtgatctgccggcctcagcctttcaaaatgctggggttacaggcatgagccaccttgcccagccaggaagaatcaattttttaataaaaaatttatagctgtgctacaaattcaatttaactagacaagacaaatccagtaataagaataatttctatgtttttcacgcagaagcgatgcctataacatccttctaggaaaccaatctggtgcttgctctatggactatgcaatctcaggcttggaggtaagaaagaatgtcctttcttggcagagcagggacaccgagacattggatatcttttattaaaaaggatacatttgcattataaatactgcagatgaaatcaggtagaggtgaacggactggtttggtctgctctaaactgagctgttaaacatgtaaaagtaaatttaaaccacaagggctttataaatctatagatagacgtaaacttgtgagacttagtttattgtttcatcaaaaaaatactaggaggtcattaaatattaatcaacacttcttagatctgtgcaaataaaatggatcaaattaaaatgtaaaatcaatagtactgattaggaacattgttcagcaaatggaggtagacaaacatgtcctgtagagaaggaaacatgaccgcaagatgaagtgtaaaaaccaaagtgacatcggggcctgacaccattgtcagcccattcatcatgtcccactgctgaagaaacagagaaaaaaaaactctgcactctgacataaagaaacaataaaagggtctctctgtctacctgcagtcctccaaatgaataaaaccttgagcatttcctgagatttgctaactccttaatgaaaatcactttatccttgactttacaatgctgtttattgtctgaagatatgtcatgaactttctgaatataataaccatgataaaattgctgttttctgccatgaagagattaatataaaccctatagtcttcataatattgtttgtcttaaaaagttctatttttttaattttttgggcagttcttttgaagaatgacttcctcacatttctttgcaagtaaatgcctccttctgcttatttttccaacatgcttttgtttctgagcctttctttcatgctctatacacacaaatcagcaggagatagtacctgcagctgtatttggagtttactgcctcaatgttcactttcaatgaaagagcgtatttcttaacagaagaccagaaattcatgctgaaccaataaattgtcctctatagttctcatctgcaaggaggatttaaatatttctagctcagtagttcagccctgaagattatttcacccccactgctaatcccgacctaatctgtttttgtgttgttaatgctcctatatactagccaggtcagtaattctgtaacaggcttaatttcttaatattttaggccatgtgttaattttactatttcttagccattttttcctcaatagttttaaattgcatccctgcttactctcccttttactggacgggcttcctctgtttactaatacaattccccaaattgattcatccacttgttgaaatacctaattttaggccctgcactgacagcttgcctaggcttatacttgtgtttggtgttgcagtcttcagattctaaaaacaccatctagaccttacattacctccagccagggctattcccccagggcctgccttaagaagcagatttcttttcaagtttcatcttcttcccatttatttcatttcatgacagttagagaagctgtatactaacgtgacaaatggtaagttagcagagaaaaacgttatttcaggataagttcagggaaagctttttggaggaaagtcagctcacattagtcctgatgatggatagtgtatagagactacagatgatggaacgatgaagtggaaactcgagtggctacatacggacattccacatagaagcagtgtgagcaaaaccaccaagacaggaaatgagatggaattgataaggcaatgcaaataattcaggttatttagatcatcagtgttgggggaagctgggtttatgggaatcaatggttaatcagaatgtgagcaccattggtttggtaattcatggaagaggttatcattcaacagggggagtggcttctcgattataaacatgtctgaaggtcactgaacatcaaggctatccttcagttaaaatcttattaaaattatactgacctctgatgaccttcagagagctccagctagatggattgatgataagagaaattcgagaaggcaatggggcaaatctttgtgcaaatctctgttatgtcatatatctaaggcttctgctggatccagtgatttgtttgttctgactgtagtacaaatctattggaacaataaatctagttataataaatgacagagggcattgaagcagatgcaagaagcaaaatatacaggtgtaaagacaaactatattaggcctcccatcaagcttctctaatattttcacagcacagccctgcctgacttctctctatctggataggccccttctgtttgataaccagttctctgatgttgactacctgattctctagtcctcaagttgactcatcctgtttattgagagtgacatttttagactactaataatatttatatgtaagaaagaaactgggtttttatataaatatataatcttttcaaataaaagattataatcaaggaactgtaaataatagaaaaattacataatgtttccctatttggggattggttaaatgcaatattatagaagtctgaaaaaataatgactgtattacaaaagaatataaaaataattgaagactaggaattatgtctaccaactaattcagtcatttggctgtttattctcatttgaacagtagtggattaagaaaaaaacaaaaagactttcgacttccatcacagggagaaaaggatcaagtacacattagagaaagctgatggcaatgatttctagtttcagtttctattttctgtcaattaaccatcattttggtaaacagcctttttaaatgtcttttcttttaatttttaaatttttactttaaagacagggtctcactatgttgcgaaggcattggcctcaaactcatggactcaagtgatcctcctgccatagcctccctaggtgcatatcaccatacccagctattaatgtctttataaaagcatttttaaccctactggtctagctattgcatcaaataaatagctaattccattgaggaaggattagggactcacgagtgaaaataaatgttttatttggataatggctacaaaatctcaacagtcaaaataaataagagattaaaggcatgatgatgacttaaaagataaagttaggtagaaatgtgaactaagggaaatgactcaacacattcagcaacacaaaactgtggcctaaattcactctgacagttgttatgctatctcctgctgcccgagtaaagtaagttatgaacaagacacatgaaggggatcaggcagacatatggtcaaatgctttctgtgcaatatttctgtctccatattatcttctctctcattgcactttggacatttttattcttcctgcagatctatttttatgaagcaatgtgatttaaattaaaagagcactgaattctcagccagatatttgagttctagttgaagatttatcacctagtggttatgagatttggggcaaattacttaatctctctctttctttaccacttcatttgtaagttttcttgcctccctacaggactgtattggggatcaatcaatgttgagttgaaggctacatggtttaagttggcttaatggagaagtggtaaatcacttaaacgggtagaacaacacagtgtagaggatgttgggctgcatgaggaagtgtggaaaaaaagcatgccatgaaaatatcatcacaatctcacatttcttcatttatttgcacactctgaacacatgcatgtgataaggactgtgcaaggttctcaggatacccaggtaaaaatcaccacttctgccagtcttgactttgcaagcttgaggagcaggcctggagaaatttggctattaccacaccaaagttgttcctcacattccctttgacatatggtctcaggaaaaaatgaaaagagtaaaaaaaaaaaaaaagtccttcatttttgaaaggaaaagtcataattaatttctagaaggagaaagaaaaaaagagataacagtgtgtgaaaaggcttagaaaatgctagagcactacagaaagataatgtgagattatgtctaagagtagcttggttattttgcttttgttgacaaagtatacctccttcattttcatagttgtcataattctttccatgattttcttagtgggtttgtttaggagaaactgtattctttctttattcatctaactctccttaactccaaaagatgcttcttaggataacattttaaaaggatatacattatgcacatttttaatgcttctatacaggactgaaggccaatattaccatgataataaggcatgtaacaaaaatttgttctgcagagagtgagaaagcgtgagggaaaacacagtgcaggattctatgctgttgcccaagaacccagacaggcaagtgaaataatagagcagacatttcctgaggctgtggtcgatatgattaggagatagtgggtaaaaatggcctttaaactatatacacatgagaagatagatgtgaaagcccattgcaaaggcaataaaattatgcaaatataaaatatcactattaaaatgtatgatgaattgacatgccatgaaaacagttccagtgctgggccagaaatcaggaaacatgggcttttgatttctcaccattaaaatgaagaagttggatttatacccaagggtaccttgtgggctgtatggcttctaagtaactggtcataacaaaagggacacaatcaggtcagtttcaaaccaagaataaaatgggaaattaaagaactgaattggctactttctgctcaaatgattgttaaaaataaagtttaaaaaaagccccaaggactatgcagtgcagtgagcagaggctcccgatattaaaaagaaaacaaggaaaatggattcctggtgatagaagtggtgtgggggaagacaaatagtgtggctgcaaatggaacaatatgcaaaagaaaagtagctaaatatagctcttttttgggaaagagattgtgtctaagtccatcagtggaaaggcaacttaattgttgtataagtctgttcaggttgccataacaagataccatacaccaagtggcttaaactatagaaatgtatttctcacacttctggaagttgggaagtccaagataaaggtggtagcaaagcggatttctttctaaggtctcttcctatggcctgtaagtggctgtagattcactgtgtgcccatgtgaccatttcttcgtgcaccagggggaaggcggacaagcaagctttctagtgtctctcttcttgtaatggcattaatctcagcatgaggacaccactctcataacctcttttaatcctgattacctctcaaaggccccagctgcataaatcatcacagtaggtgttagggcttcaacatttaagtgcgggagttggtgttcacatttcagtcaattgaggtgacaattgaaatgtgaaaggaaaaccatagttactagagagaacggttgtcttggggaggatcactggacaggactacggtcctgtccaggttgttatggcaacctgaacagacttatacaacaatccagtcctagaggcaatacaacttctctgctgattccagattctgagcgcctctcagtccttggttgggttgttttgatcctgtccatattatatttataaatattctcttcataaaactctctttaggccgggcgcggtggctcacgcctgtaatcccagcactttgggaggtcaagagatcgagaccatcctggccaacgtgatgaaacccgctctctactaaaaatacaaaaaattagccgggtgtggtagcgggcgcctgtagtcccagctactcgggaggctgaggcaggagaatggcgtgaacccgggaggcggagcttgcagtgagccgagatggcaccactgcactccagcctgggcagcagagcgagactccatctcaaaaaaaaaaaaacaaaaaaaaaaccacaactctctttaaatcacacatccgagtgtgtcccttgtttcccaccagagccaagactgaattgagatgatttcttaaggtcaggttgatgtcctaatccagttgtgctgctataacaaaataccacagagtgagtaacttataaacaacaaaaatttattgctcacagttatggaggatggtcagtccaagatcaagttgccagcaggttcagtgtctagtgaaggcccattcctctgtcatccaggctgaagtgcagtgttgcaagcttgggtcactgcaaccttcacctcccaggctcaagtaatcctcccacctcagcctcctgagtagctgggaccacaggtgctcaccaccatgcctggctaattttttttttttttttttttttttttgtagagatggggtttcaccatgtttcccaggctggtctcaaactcctggactcaggcaatctgccagcctcctgagggagtgctgggattacaggcatgagccactgtgcccaccccctttttccagtattacctggacaatgtgtctccctgtcagtatccagggaatggcacctggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcaataaaggaatctctaccagcagacacttgatttttacccttcctaggacctttaacagatatcttgttattactaatctttggtctttgcttgtttaacctccttgtaaagtttgtgtcttctagattacaataattccatgtaaagacgatgctggcacaaggctttcaatccatcccctcttctgacccagaaaataaagacatcctgcctttgggtcttttagaacaggtatccagagattttacttctccagtgctagacagggtctatgcccataacatcagcaggaagcagttacagaagatgaacctccacccttctgcaagccccttaagattaaggaggagtatataatctctgatggggaaatgaggtaggagaccagaaggaccattgaacagagcaggatctggtcaaaacagggtgcagtgaagaagcctgctgaaaccagcagatgatgatgaaagtgacctctagttgctctcactgcttatgagcataaagacactaccactgggaccatggccagtttacaaatgtcatggcaacacaccttggcaatggcctggaagttactttatatggttctggaaactccctgccccttttccaggaagttctgaataacctacctcttaattggcatgtaattaaaagtgggtctaaatacaactagctagcagcccacaggcaccaactctgggcacattgcctatgggttagccctgctctgcaagtagcagcaccagttcaataaaagttgcttgctttcaccagcggcttgcccttgaattctttccttggcaaagccaaggaaactacagtctgggagaaatttctcaggctacaaaccagttttgaggctcgcctgccctgcgtcactatcattgtttccttgggtttcccaggaatgtacatgtgtgagactgctgccctgcttatagatctgtttccctgcaggaaacaggagtatcttgcctggggcttccagagttggagatacatgtagtttcactactgagtgctaacatttaattttggaatcaagtgatgcattcagactggctgctatcattctgtggtatacatgtagtgaacacatttgtgactgagtttcctgcttttagctggagcaagaaagttttgtaattgtgatttgtacaaaaaaatcataggcaagagaatgtgtgtaaaataaactttattgtcagaggtttctaaaggcttatccttcaaggaaagtggacatatgctgaagagctgataaacagtctacagcagtgttattctaacttaatcttgattccaagtccttgccattttcctctagctgctgttgactccagttatatataggttgggggaaaggggattatttatggatctaggcatcattgtctcttgggcagttatcacatttgcagactgaagggatgtgatttctacaatcaaactgtccatttggaatacaaatctggagtggctataaaatttgcttttcagagatggagctttcagatttggactttcaattgttctgttgttttagtttttctcatcaactggggaactgtttgtgactaagctttgttaaaagtagagaagaactttccatagttccaacattagttgctacttgaaacaaacaaaaacacacacgcacatacaacgaaacaataatctttggtgaggtcttgctgatacctaactgaggctagagtgagagctaagtggtgatacaggccaggtgcaaactgagtgcagctaagtggataatctctggtagtgaactacagtctagaagaagatagtaataatagattgaaaagaaagtctcctgaaatgaactagctggcctgtggtgtaggacacaggaccccagccaccttatggttctaaaagccttgctcaaagccgctgcagatgagttagctaggtctctaccacatccataatactcctctggagagaaataaaggtctttcacacctcccaggaagggatttgcttagcctcaaatgtgcacattcagaaatagcttgtcataagaaagagaggatagtttgcagagaaataacccttctaagtccacatcctattccttttaaataagagagtggtgccaagggaagagccctagaatgtcaaagccaacagggtgctcagataccacccaagtacagttccatctttggccataaggagacaatggtgtcaagaggctaaggccatatgatctgtaggtgaaaaacccaggatgagaatcaaggcctcaaaccttttccactacatcacagatttaggagcagttagagggaaggcttcaatctggagaacactaacaggttttagagattattgggtcatggtggctgggacagaaataaggattcacagaaagatgtttatagtcaatgttcttttacagtaaatgttcttttgggattttccttgataaaaaggctgagcaaaagtgaaaaaaaattttctttctttcttactttctttctttgtctttttctttctttctttgtttttttttttttgagacagttttgctcttgttgcccaggctggagtgcaatggtacaatcttggctcaccacaacctccacccccagggttcaagcaattctcctgcctcatcctcccaagtagctgtgattacaggcaggtaccaccacgcacagctaatttaaaaaaaaaattttttttttttatttttagtagagacagggttcctccatgttggtccggctggtctcaaactcccgacctcaggtgatcctcccaaggtgctgggattacaggtgcgagccaccacgcctggccaaaattaaaaattttctaattgcaattctgaacaacttatgggttgtgaaatcaatatagtggactgcttactactacaggctttatttaaatactaggaagggtggattacacataataaaagattttttaaaaactgatcacaaagaattgtgtatttctcactgcatcttgtggtcagaaaagtttgagaaactgctccacataggcaaattataggttcaatctatccgtctacctctttttctcttctctttttttccatgctatgcaaacaagaccatggagagaggaaggcaaattccatcaatgggtggggttaagccttttctatgaggtagctgcacatttgggacactcctatgctggcgacttgacattctagtagatagattgtccttttcatctttagctacatgttaaaattacttgggagctttttaagactactagtgtcttccacccacctggaagcatttaaatcagaatctctatgtgtagagtccaggcacttgtgttagttaaaaccttactaggctttataatatgacagaatggtttaaagctactgagtagacctaccctatttcccaccattttctttgtttctctttcaccataggcttctttcccatgagaaagtaaagattttagtctctcttttcacagtccgaagtaaatcactatctttctcaactggacttccaaggcaaagatttctctccatttacctatctggatttttacaaagttggcctctggattcccttttcccaaagctaattcaccacaaacgcacccctcaagtcaaggagctgggctttcatacacctgcacctgtcaatcatgggtaaatactttgcaggcagggttgcatgtgggattgacataaactaccaggtattgccagctctgagcctcaggcaagcttgtgactaagtgactccagtagtctgaggacagtccttattcagaagggtctttggaagcaaaagcaaacataggcatgagagggtaaaaaaaaaaaatcccatgtgattttggcttatacctaacagaacttgtgcaagaatggatattaaggtgggtattgtacacagcagagcttagtaaataccaagtctgcagtttaagggataggctgaagagattttgcaggtttgtaaacatttttgccaatttgaacatacttttgtttgcgtttggtttttctcctcagtggtaagagctaggcacgataaggtagctagtatattataatttcaatcaataaatttttattttgccaaggaccaagatgaactacgacgatttcaattatttagtactttattttcataagtttgaaaattaggacttttgctcttttttggctcacggcatctttttggatttcacactttctcaaaggccagtaacttagaatctaaattatgattgcttattctttcagtattctaggggaaagttgatttaatcttgacaaaatgtattcaattaaaataattgttctcttaaatcttttctgtctttcttttctttttttttttctttttttttttgagatggaatcatgctctgtcactcaggctagaatgcagtggcgcaaatttggctcgctgcaacgtctgcctcctgggttgaaatgattctcctgcctcagcctcctgagtagctgggactacaggtgcatgccaccacgcccagctaagttttgtatttttattagagatggggtttcaccctgttgttctgttaaatcttttcaccttttaagtttgtccttctcttctccaatttgcaagagtggggtgtggctcgcaccgaaatactgtatttcttagagctacttattcctggagcctggcagtctgggggcctggagggggtgtgtctagaaagcagccctctctaagttgagaatagctatgagaattgtgggttataaggttttgagcagctctggcctccccgtcctcttttatttctacagtggagtgtggcaagagaagggacccatctgagagtgacttcatattgtggcctttcaccacttacctctggaaatttgattcaggcaagtcgggagagtctccggtattcttctctgagaactctgttttcattatacagctggacaatggaatctatgatttgcctgtagaggttagaggtgcatcctgttccaggaaattattacaatttatgcaagttatacacgtttgcttaagagaatgctttctgcacatttcatgttcttcctctctatcttagcctagggagaaaaccgtggagggctggaacgttagtgtgatggggtggaagcttaattttcacatgattctcaacaaatgccagcacatcacatgtattatcatgtccaatggctgcaatatgaaggaggcttttccaaaatagttacggctttggtatgggaagggacctgcttatggttcttctggcccagcacaatgttatgaaatgatggcctctgtgtgagaacaatctaagaggaggggggttggagagaaccaccttggggtggtagaatgaagagtcaccaagacataagggaagctgatgaggatggcagtagaggagactcattctgctatgtgaggtgctcagaaacctgggttctactgaatgccaatcacataagaagcagagagacagcaggcagtgtacagcagcagacagaagacagcagacagcttaggaatcacaagaatgattttagaagtagatacctctaagatgaaggcatatctttaagcctatttatttacctataaataggaatgatagtagctgccctgcctctctagctgggacatttgtaatgaataagtgaagtaaagtatgtcaaagtgtttgaaatctataaaactctgccccagtcacacgcctttagaaaaatacatattgccagaagcaggctgacttgggcctctcctaccattttcttcatcaaagctgctgtgatgacgttctagcttttctcacaggcagttgttgatgaaaagggtctccttcaggtgctgccactggctctggatctcatcttctgcagccattccaccaggacatggaatgagatgggaagtgaagatgctgatcactaaagggatagtcaggggcctctcgtcaagatccctgcctttcaccattcttttgccaacttcatcttctcatcagggaacataaggcaactttctttaagagcttttaaggtttcaaagaaagcatggccaagtgctaagcaaactccacagggatgcctcccacatggagatatgggaagtataaggcaggttgacaggaggtgggaaaacactgaaggtctctgagtagggcttttctagcactagaaaaggtatgaccacttccttgagatgacttataggtactagggaatatcttcctctctacaaaatatctctcctgaacatattttgtttttgttgttgttttttgacagagtctcattctgtcacccaagctggagtgcagaggcaccatcttggctcagtgcaacctccgtctcccaggttcaaaggattctcatgcctcagcctcccaagtgactgagactacaggcgtgcaccactatgcttggctaatttttgcatttttagtagagacagggtttcagcatgttggccgggctggtcttgaactcctgacctcaagtgatccacccacctaggcctcccaaagggctgggattataggtgtgggccaccatgcccggccctgaacatctttaacagatggtaaagaccttcttctgcaccattactgtgaaattggaaagagaaataaggatgcctttgtcagaagatggtatgactaattaaagccacaaacttacacccatcactgacagaatgacaagcctaatatggtttatattactgtgaaagctcaatgagtgaattaatataatctctttttattgcatagaagagtatataaagcatatagtctcctaacaatccaaacttttgcccccaaagtaaagtcaaacattcaagtaagggagaggagatataggtcaaggttttaatctatacacacaccagagaggctaccaaaccaaagggctcttatatacctaatgaagctccaatggctagcgtggagttattctgggaagagggcatgctggcggcattgctcttagattcagccttttctccagcagatagcctcattgtttatttagatggaattacaacactgagacgaaactaacagacatcttaaaaataccttggtgctgcacaaagattgagaaccctggctatttaccaaagggttgccaagatcaaagtcttgtctttatggaaatcccctgatattccagtagtcagatggaaccttatgggaaagcaagcatctgaggggagatggagactggagcttgaaacccaggaaccattataattgcacctccaaacatatggacaagcctgccaacattcttgggatggctagaacagcttgggaaagctgttcaggaactataattatcaagagtatttcaggaaggctgggtgcagtggctcacatctgtaatcccagcactttgggaggcaggggtgggtgaattgcttgagctcaggagtttgaggccagcctgggcaaaaaggcaagaacccatctctaccaaaaaggcaaaaaaaatagccaggagtagtggcatgcatctgtgttttcagctactcaggaggctgaggtgggagggtcatttgaccctgggttttaggttgtggtgagccaagatcatgccactgcactctagcctgggtgacagaacaagagaccctgtctcaaaaaatatatatatttcaggaaagatgagatgtcccattttaaagaagaagatctgttaaacagatttgtacatgcgcggcagtagtggcagagagtctgccataatctcttcactctctccattctggcctgctttgagtataccggcttgcagatgccggtctggaccagagggactgaggtgaggacaggaacagagcaaattacctgacacaccagggacctgtacttgagagttgatcccagagctgtgttcagcctaatcacttttttaaagtgaatgtttagggcctgcctgcagagaataacatctctcagtttagacagaggtggtgagcatgtagaatgtaggagctactgagagattgatggagctttatttttcttatcaaaggagcacttactggctgtttccacagccgaggggccttcctgtgcatcaaagaggaaggcattgctgctgggaagctggtgggagtcatggcagctggaatgagtcaaatactgttcatctagtgagtactccaggacttcatccatttcttcctcctggacttccctcttgagccaggtgaagtaggcaagacaagggattaaaccaaggcagcctggaaccacatagctagttctgatctgaagctcatggaagaggcaccaaaaccaaagggaccatcacatcaaagaggaagtatacagtccacttttgactgggagtaaagtgtgcctagagttagtatagaagtgaaaaaagcaagtgatcagtgcattgacctcataacacacagataaggcagcagactcaacaactactctacaatacgctcacggcacacaggacacacagtgacccatactgtcggcttcaaaatgctgtgtttaaattttatttaatatgatgtggagtggtccactgaatactggctcttgagacaacacaacctcccacggcttttgcagattttagacccctagctctaaatacttggtatggtttcaatttatttttcaaggtaaatttctggctataaaatatctgccaacataattcaggacaactgtgcagaaaccagataggcatctcactttggtttgtaaccctataggttttaaagatacagaaaccagggatccctggttagtttacttttcggtaagactgactggttaactaagtgtgagaaattactaggaactaggaaccaatacaaaaactgcaaagagaacagagaaccatttttaaaaggacacattgtataatcagtcaacaaaaaaaggaacaatcagcagtttctgctttttctagatctgggacctttaacctcttgagtccttgcttctggaattctctctagatttggtcagtccattatcagccccttcatcatgtagagttacctgggagccagtggcttttgcctgtcttcatttttcttaccattgtgattttctgcaaaccaaaattagaaagagctagtcagaaattaagcaggtcccatttcacacattgcacacatgggccctatatgatcagggacataacagcttacatgtatgttcagaatgctctgtgagaattattgcaggaggcctcaggttgtgtctttagagaagtggcctggcaggcttgccttagcccactggacagggtgttcctgatatggtgaatcatcaccagacgtcagctgcctgaagcagagcaaaaagttttaaatgccttttgttccccagctcaaagaatacttgcctggctgccctttggacttctccagttgtaaccttccttcctgctacaggctggttgccagaccacgactgtttgtcccattgctactcacacacagaacctgctccagtctctgagaggacaaatagccctgtcctacctctactccaaaaccagaggactgcccaggtgccttcaagtctgtccctgttgtgcttcctcagatgttgttgggggtaattattttttttcttctcagtttgttagtgagcattggggttgattctgtgaaaaatattccagtataaatcaacttttctaacaccagcttctactatatacagtgcctgaactaaccccaaaagatttggacggtttattgggacccaaaaataaaaaaataaataaccctgaaagagaaatacactcatgaacattaagatactacttcaactgatctgtacagcagccatggaattatgatttgactcactttacaaatggggaaacagaaattcaagaaggatcaatcacttgcacaaagttagtaaatacagtgctgagactagagcctaggtaatgctgattcttagcccatgggtcttcccattctaacaagctgccttctgtcatactgttctttctgaccacaaagatggaatggagacttctgcttctggccaatttggagtaatggggacctgatttgtcctccaccttaaacaactgagaaactggaaaaagtattttaaactctatcttcaacattggatatagtgcagtactataataaataaaagaggtgagccctatgattgctccagtttgctgcctgagattgtcaactgtagagcagggagggaggacccaggcagagcctggtagtaactttgaagaagacagggtggctagacatcacaggacagactagagaataggttgctgcacagatagaatgccttggatatctgtcttcagtcttcagctaagtactgattagtacatgtatttgaggaaattatgcaaagcagggcaaagaacttcccaaaaggaataatctctgtagctcacacatagcttgcaacacttggtgtttccatcagctagtgtgaaaatcccttttaatagagggagcattggttagaacaggagtccccaacccccagcactggtccatggcctgttaggaatgggaccgcacagcaggaggtgagcagccagcgagaaagcattaccgcctgagctcagcctcctgtcagatcaacgatggcattagattagcatcggagcacaaaccctattgtgaactgtacatgccagggatctaggttgcatgctccttatgagactctaactagtgcctgatgatctgaggtggaacagtttcatactgaaaccacccaattcccaacccctaccaccccacccccaccttgtctgtggaaaaattgtctttcatgcaaccagtccctggtgccaaatctgtgggagatcactggcttagaatcttcaaaagagtattgcccccaatgtaaactatggactttgtgtgataatgacatgtcaatgtaagttcatcaactgtaacaaatgtgccattctggagagagatgttgatagtctaggaggctatgcatgtgtggaggcagggggtatatgggaactttctgtacttcctgctcaattttgctgtgaatctgaaactactctaaaaaataaggtctattttcttaaaggtcattttgcctccatagtgggaaaaaaaatagcagttgactaatagctgctcttatgctgcctaaaaaaaattaaaaagccagcttggagagatgaaaattgtttttaagtaactttattgtataccaaaacaaagctcaaataattttaacacaaaatgcaaaaaaatccagcacccaataagttacaatgctcaatgtctaaccccaaataaaataatgttaggaatgtagagaaacagaaaactgtaatccatgataagaagggggaaaaaatcaatctacttaaactgacttagaaaggacacatcaggtgagaattaaaaaacaataaaaaggacacagatgagagaatctgtagataagcacattgaaacaaatataactgtataccttgtattaaagaagctaggccagtgtggtggctcaggcttgtaatcccagcactttgccaggccaatgtgggtcacatgaggtcaggagtttgagatcggcctggccaatgtggtgaaaccccgtctctctgaaaaatatgaaaattagctgggtgtggaggcatgtgcctgtaattccagctactcaggaggctgaggcacaggaatcacttgaactcaggaggtgaaggttgcagtgagccaaaatctcaccactgcacttcagcctgggcaacagagcgagactctgtctcaaaaaatagaataaaataaaataaagaagctagaggaaaatatgaaatgatgaagagttacatagaagaacttaaaaaaagacataaattaaatttagatgaaaaataaagtctgagatgaaaatacactggataggattaacagcagattagatgctgctgaagaaagattaatcaattccaagacatggaaatagaaagaaacagagagaaagaaaagatacaacaaaaatgaacagaccattagtcagctgtggtaaaatttcaaagcagctaatataaatataactggagtctttgaaggagaagatagagagaaagaatagaatatacattatatatatttgatgtatatatgccaaatataatatattgtatatgccataggtaagactatgtatgtcattattattcaaatttgatgagaactataagcatgcagatgcaagaaactaaataaagtagaacaatatgtaaaagagaaaactatacaaggtcttatcttaatcaaactgcttcaaacgagtgataaatagaaaatctcaaaagcatccagagaaaaaagacatattatgtacagagaaacagaaataagaattatggcagacttcttgttggaacagtgtaagccagaagacagtggaatatcacttttcaaacacttttttaaaacaaaaactgtcaactagaatcctacatccagtgaaaacatcttccagaaatgaaggtgagttcttatgctcatcaagatgaagtaatccactatactctacctctcttactgattgaaactaagaactctcaggccaggcacagtggctcatatctgtaatcccagcactttgggaggccaaagcaggtggattacttcagctcagtagttcaagaccagcctggacaacatggagaaaccctatctctacaaaaaatacaaacattagccaggtgtggtggcacacacctgtagtcccagctacttgggaggctgaggtgggaagattgcttgagcccaggaggcacagattgcagtcagccaagatcatgtcactgcactccagcttgggtaagagagcaagactctgtctcaaaataaaaaacaaaacttagaattctagaaagaatatgaaaagtgattacctgagtgctctaaagagaaaacaatagaatgcagattaaggaccatagtcaaaactaaaataaaatctataatggagataagtttgcattttttctccccactttggggcacttgggaggagctaagggtcttcagagcctgtagccaacttacctgtggcaagttttctgacaaggatctctgtcagctggcttccttgtaccatttgctcacagaatctctgtctctggtagtaggcaatgtcagtgttcctgagaaggccctcaaaagacttgactgtgttcttcacatgctgggtgaaaaggtagcagacacctctcccttcctgtatcttctgttgtaagtgggtcagttcttcagcctgagcctgaattaagggatcatgtatcctaaggtgggaaagaagagtaaaatgtatgagggaatgtagtgaataataggttatagaagtttcagaggagagatctcttagaatccctgtaaggaactcccaagttgaattctttttttctttttttttgagacagggtctcactctgttgcccaagctggagtgcagtgatgtgatctcggttcactgcaacctccgcctctgactccgcctcccaggttcaagcaattctcttgcctcagccttccaagtagctgggactacagatgcccaccaccatgccaggataatttatatattttttgtagagatggggttttgctatgttggccaggctagtcttgaactcctgacctgaaatgattcatgcacctcagtgtcccaaactgctgggattacaggcatgagccactgcacctggcccaagatgaattcttgtacaagttgtgtgacttgcctgtggcagaaggaatgaagaggcagccttgggtttgtctgttattttactaaatttcctttaaaaagatgcccctttggttccccactttagcccatgtaccttttcatatgcagtaactggcagaaaaaaaaaaaaaagccaagttcaaaactgttgggccggtatctctagtattaattgaaagttaaaaagaaaaatcagtgaaaaggtcaagaggggcagtattcttctgaatgacatgaagatagactataatcagtaagaaggcagttaaaactaaagttctggccgggcacagtggctcatgcctgtaatctcagcactttgggaggccaaggcaggcagatcaccttaggtcaggagttttgagaccagcctggccaacatggcgaaaccccatctctactaaaaatacaaaaattagctggtgtggtggtgtgcacctatactctcaactgctggggaggctgacctaggaggatcacttgaacctgggaggttgaggttgcagtgagctgagatcacaccactgcactctagcctgggcaacagggtaagactccatctcaaaaaaagaaaaaaagtaaagttctgagtagtaatttcattactctgtggggatttattttttttctaattattgtttaaatatttctcatggtgatatggtttggctctgtgtccccactcaaatctcatgtcggattgtaatccaaccagggacctgctggatagtgactggatcatggtggtggatttcccccttgctgttctcatgatagtgagtgagttctcatgaggtctggtcgtttgaaagtgtgcacctccctctttgctctctctctctctcctgctctggccatgtgaagaccatgcctccttcccctttgacttctgcaatgattgtaagttttctgaggcctgcccagaagcagaagcctgtacagcccacagaaccatgagccaattaaacctcttttctttataaatcaccaatctcagatatatgtttatagcagtgtcagagtggactaatacacatgggttccaatgtagagtgtgagctctgtgagtctaaagatagtgctacctattacccaacttacagcacccggtagtatgtacccatacaagtagttattcagttaatgtttagaaccatgtaatcccagagctagactgaacatttacagtcatctaacccatctaatgcttgaattttctccccaccagtcttctaagtagttatctgcaggtcctctttcaaactctatttcttagagttactagaaagtgtcaggggaagtaaagacacatactggggagaaacaggggctccagacctatcccaccttcaatcaaatatctctgctttggtgagttttacaaatttgagcttctatgatttcatttcaacaaaggattaaaagaagtttcgaatgctacaatctaccttatgtctgaaaccctctaaggatagtcaatgctggtcctgagcgaattaataattcattttccacacaacagctgctcaatcatctatctacccaacagccctaccagttaatactccacctagtataatacttttttaaaaaatttggaggagaaacattgttatcatgaaaggcactttggaaagtttgaaaatatctcttatagaaaatattaatgacaatcaccacatctataaatgggaacaaatataataattacagaaaatagttgttcagagttttatatgtgttagagatggttctaactacttgcaattgtgcatttaatcttcataaccctctaagtagatactgtcagtatttgcattttataaatgaggtagcctaggttaatgacacgcagaaaagtgaagtaaatttgaccaaggacacacaaatagaagccacattgctagtattccaatgcagacagctgtctccattttactaatatgctatttaatggaaaaccctagagacctaactagaccatagcctcattgtgtcttagtctagttctgtgcctgagtcatacatttctgcccttctccttgcacaaatttgctctttgttctaccagcctgagctgccctacttcaaacagtatttatgcacttcccacagaggtacctccttaccggagccttgcagctgacctcggcaattcggccagctccctctcctgaaactgcacctcctcctccagcacagattctataaggtctttgcactcttcacactctgagaaaagatagacatgcctgcatcatggaaggctggccatgctgctgtggtcactgcctgcagggcaggaggcagggtctatctcaaggataaaagtatccccagtaccaggctttatgctgggatttccatatctgtattcctcagtctctcaactactccctgttttagagatgaggaaagaaaagcctgataaagtcacttgacaagatgattcagctggaatgaggcagtcagaattcacatcccctgaggtctgacgccacatctttttcttttcttttttttttttttttgagatggaatctcacttttttgcccaggctggagggcagtggcacaatcttggctcactgcacctctgactcccgggttattctcctgcctcagcctcccaagtagctgagattacaagtgtgccccaccataccctgctagtttttgtattttcagtagagacagggcttcaccatgttggccaggctgctctcaaactcctgactgcaaatgatccacccaccttggcttcccaaagtactgggattgcagtaagtgagccaatgcacccagccatgacttcaaatcttaaggccaatttaccaagccttacagcctcttaagtaaaacatgaacataagggcatgaaataatgacttcctgtgtgtttgggaagatactaagaatggtaggactgatggtcctcctgtgtcaggagtttcaataatcccaaaatatttcaaagatttaaacatttatctgtatacagctgtgtaaaactgtatatagaggagaaagatccaaatgatatgtgcccaaaagctaataggtggtgttttaaagggagaaccaacacatagtgtttgtcatggtactgttgcagtaggtttttaagaattatcatcatatgatcatcaccaccatccaaagaggtagttcctactctattaccattacagatgagaaaactgaggcacagtgatgataagttagatttgaacccaggaaatttggccccagggtatatgctttttaatcactgcacaataatacctttatactagggtcttaggtaatatctttcttcttctctagcttgagaaatttttgtcctacaattataatgagtgaaggtttttttttttaaactagtttttccacacaccaaagctcatcttttcacttctttaataagtgggcttttggttttacttttctatgacagtaagttagacagcaacttttagccaccccccacacaatgatgtattttaaaataattgtagaaattggaaaacaaactcaatttctatgttaaccagaatcctcttctaatatccctgttcctctcatgcccttgttcccatgtttccttgtcattacagcttcccttccctgactattagtaacaggtttgggattttacagtggatttaaaaatgtgagagctaactgtggagaggaaggggccagcccctaacctggcctggccttctattgagaatggcagtctgttccacttggccttgttctcattttggccatatgtctcatagctctgatcctggatgtccacctgcagttgcttgctgtctgtaaagttgatactcagagagagacagaaagggtgttacaaagtctctgatttttctggaaataccctcaatctaaccagagcatgaggaatggcttatctgaacttttgtgggaagagaatcttgatccaggtatcataaagacttttttctgtgtctgctattgaagttcacatctccacatatctgtgactcagttgagaatagctagttttaagttccttcaaggcagatagggtataatattacttctttcatccctggtgctgttggcactgtgctttgcaaatgggcgctcttaaaaaagtttaaatcgaatcctgagatgttttaaccaacagtgatgttacatgtttgtagaatctgatattcattgctgagaggggaaagacagtttcatgcctaaaccaaggttttagtctctattcctcactacactcgccctgcaaactttacacctttgtgcctcagtttttctgtccttggcaaattgagagtaaaaggcccacttctacctttctgggagtgtagttagcataaaattaattttgatagagaataaagtccgcagtgtttcatttcacagaggaaagatgggcaatcatttatcactttggtgaccatgcccctttgggacctactatatttctgcaggtgattggccaggcagtaggcagtagctttggatgtcaggaatttctctgtgaggtcttggaagttctgtttgcacttttccagttcagagcgcaagtactgattggtttccaggatgctcatttctgcccttggaccaaaacaagtggtggcagatactgccatgctgaagcttgtggtggaagtagaatcagaacccagacaaataataaattaaaaacaaatgcatggattatggtaatggttgcactacttgggtaaattactaaaaattattcaactgtacaattataatgggtaaattttatagtatgtaaattatacctgaataaagtttctttacattaaacaaaggatttaaatgagtcaaaagaaagcagatctgattcataacttacttttgggataaatttcatcagcatcccgcaactctgagaatccttagccacaaaaacaagacaaaggtatctaagcttagactctaaggtactgtctgtggttcaggctctgataggaatgccagaggtaagacccagtgccaggtaatggtctggagtcacaatcagaattagaaggtgggggtgtcatggaatgttaggatctctgccttccaggtgtctaggccatgtggaaacacaggtctcttctgaaggtcaccaccaatggagaccactgcctcagcaagtcaatctcagtatttgtatacccttgtgacaataccacaggcctatctctttctaaaattcaaccatattttcattgtttattattgcaagtgcatagaaaacatcaaggaatacatatttccccaagttctatcgctgtcttaattactatcatgaattcattttcttcctaatgaaaaatttaacacttttagatagtcttggtgttcttctttggttctccagatttccacatcatttatattataagaaaaaaatcctgaatattcctctcagtgtgaataattgacttatatcgatttagaggccaggtgcagtggttcacacctgtaatcccaccactttgggagaccagggttgttggatcacttgagctcaggagtttgagaccaacctgggcagcacgacgaaaccctgcctctacaaaaaaatttaaaaaattagccaggcatggggctaggcacggtggctcatgcctgtaatcccagcactttgggaggctaaggcaggcagatcatgaggtcaggagatcgagaccatcctggctaacacggtgaaacctcgtctctactaaaaatacaaaacattagccgggtgtggtggcaagtgcctgtagtctcagctacttgggaggctgaggcaggataatggtgtgaacccaggaggcagagcttgcagtgagacatgattgctcactgcaagcttgggtccaggtgttttttgctgtagtgaaccaagatcatgccacggcactccattctggatgacaaagtgagaccctgtctcaaaaaataaaaacaaaataaataataaaaggattttggtcaatatcttaatatacttcttgctgcaaaccaatgttatactgacatcttttcccccactggggaagcatgttagttttttgtttttttttttgcttttttttaatagaaagggtctagctctgctgctcaacctggagtgcaatgacatgatcacagctcactgcagcctcaaactccgaggcttaagtgatcctcctgcctcagcctcctgaatagccgggactgtaggcacatgtcatcacactcagctattgtgtgtgtgtgtgtgtgtttttttttgtgtgtgtttgtgtagatggggtctcactatgttgcccaggtgggtctcaaactcctgggcccaagttattctcacactttggcctcccaaagcattggaattataggcataagccaccacacctggcccatgctggcttttcacttaactcgaggacaagcttgatattcataactcctaaccccactctcctcttctatgtgtggtttgcttagtgttacaatctctgtatacatattttgtgcttgtcacttatgattttcattctaactccacatgctttctttccaatttgtcacaattgctgaaataatttatgtatatctctttaaatacatgtagttgccacctaatttggaatgacttataaactgttactattttatgtgtttgaagcagtttttatggaacactaatgatttgcattggcctgagtatatattctcagacaaagcatggtaaaaatcaagttaatgagtctgtggtggttggcggtgatcaacagttttcctgtgcaatggggtttagtgggatagaaactgaggttttaaagacaggcatagataggcagaagagaagtcatcccctgatgtaactcttcacttcctatgtatcaattcctccctggttttttgagactgagatagggagactcttatggaatatctgtcctttcccttcagctgcctgactttcctgggctactggcctacacatgtgtaatcatggtcacctccacattcatgacaaacagaaggaagcaggaccaacaaactgcataccctacatgctaacctgaaactatagtgtgtgatagtattagtttatgagatatatcagaagttatatgattttagtccttttaaatttattaagatttattttaaaggctagcatatggtctattctatagaacatcctgtgtgtacttgagaggaagtgtattctgtttttgttgagtggagtattctatagatgtctggtaggttatgttgtttaaatcttttatttctttattgatcttctgtgtagttgctgtatccactattgaaagttgtggtattaaagtctccatctactattgttaaattgtctatttctcccttcaattctgtcactttttgcttcctgtgttttgaggctctattagatgcatgtgtatttataattgtactctcttcctgatagattaacccttttatcattacaaaatagccctcattgtcttcagtaactttttttgtcttaaagtctcttgtttattttgtctggtattaggatagttgctactgaaacaccagaggtttgatttaagtcttgctgttcactgcacagaaagccaatcactgagccaactagctttgctaggaaagaaggctttcatcaggtactacaacttaggagatgggagatcagtctcaaatccatcttcctgaccaatgaaaattcagggtttagatagcagggaagaaatggaactacatgcaggaaaacaggaattagggagaggtaagaaagaggaattggtcaacaggaagcaggtggtcacttaggcaattttgatgggataaggggtctgacatttcattgtccagatgtggtactctggtaaatttcagttctttgatactatctggagggcccaacgcttggtttcctgagaaaggaactcagataatacaaatgtaactttctcaaatttcaagactgaaagggtcaatttctatgtttattcaaaagaaaccgtaaacatcagttctatgggacaattgggttggtttaaaagtcacttcagctttcttatggttgctaattacataattatattacattgtatggcaaagggattttgcagatacaattaaccttaaaatggggagattataaaggttgactaatctaataacatgggcctttaaagtctggatctagaggtcagaggtcagcaaactaggaagtcagagagatccaaaacgtgttagtgattcaatgaggaagaaactcttcattgctgactttgaagatggtgagagtcacaaataaataaagtcctcagtccaacaacttcataatcagtgctacctgcaaatatgggctaacaatatttttaaatgcatttacaatatgtggtgaacagattcacattgtctctgcctactcttctcttttgctttgtccctgcatgctactatgtctgtctagatgggggggcacaaacatcagggctttgtgcagacttctctcctttcctggaatgctatggctctctagagccagatagcactgctgaaggtggctgagtacaggcaactgatggtgttagaagccacaggcccttgattaatccaggctctaatcttcacccacctcaaagtcctaagagtcctccttatagcttcctatctgatttatacagattattacccacaaaccttgctcttccttggacccctaagaccagggcttctaatatcttcatcatttttgaggtatctaataactcttctttctggagtttcagttacttcatccccactgccgagtgaaaagttaccagatgactagcacaaagtctcatatgcaaatcagggctaaacagcgagtggatgatattttgtctagatcagccatgggtattgtcaaatgtgacaagaatattatttctaaaagttccacactacagaaacacactagaacttacttcccacgttaaaagacaacctggaggagtggctattacatctcaggccaagcattaatctttccaggattacaacttggctcccaatgtcgccaagctattgcttagtcaaattatttaatctctgttataccaaaattatttccaggcccccacaatttgcacctggctgctatacttctatgaagactagaattacctatgagtaagagtccaaaataagctttctaaatcaattcagacctgtctcacatactttttggtttacaattgataaccatgaaggaattctgagtggaggtgccctgacctttgacaaatctcctatctgtacttggtaccagcttgagctatttttattgctcaaaccaataggaaaatttgctgaggcctcagagatccaccccctccagagaatccctgatttcccaaaatttgatcgagatctaaggtttattttgctgtacaactcattttctggagttttacttgcttccaacaatgaaggcaacttttcctgcttccatgatgatggagagcaggcaattcctttctggggtttcagttcacttctaacagggaaggagggaaggagagtttgagttttttcctgcttctaggatggtacagagcagtcttcagcctgggccccattcctaggtaagtaactgaacctgtgttttgtcttgaaattctcctaaatgattaaagttatgattaacaaccaggctgaggcaagagaatggcgtgaacccgggaggtggagcttgcagtgagccgagatcgcgccactgcactccagcctgggcgacagagcgagactctgtctcaaaaaaaataaaaaataaaaaaataaaaaagattaacaaccaactgatcataatttcttcttaccgttagagtgctaggcaatcatataaattgtgcgatcattaattttctgaactgttttttgttttctgtttgtttttattgttgtttccttcttttccccattgggtttgaccagttctatctgacttgatcaaatccaaaggaatgttccaaattatggggacaagacctctgaattggataaatctctgcagaaaaataaataaataaataataaaaatttaaaaagagggagagcagggaaagaaaaataaataaataaataaataaataaataagcagccatcatgaaaataaaggttttcattgggcacggtggctcacgcctgtaatcccagcactttgggaggccaaggcaggcggatcatgatgtcacgaaattgagaccatcttgacaaacacagtgaaactctactaaaaatacatctgtactaaaaatacaaaaaaattagctgggcatggtggctggcacctgtagtcccatttactcaggaggctgaggcagaagaatggtgtgaacccaggaggtggagcttgcagtgagccctgatcacaccactgcattccagcctggacagcagagcaagactccttctcaaaaaaaaaaaaaaaaagagagagagagagaaaataaaggttttgactaccagaggggctttatttatataacaaggccacctttgctagccaaaccaaactaaaaaagcaatggttgtcacctcgtaccccaggctgcagttcagtagctaaggttctgccctttttcaccatgacaacctgggtttggttcctaaatcaatttctttccagtttgatatttatgttacttttgaactttttttttccagggagctttcttagcaggatcattgctggctttcaccccagctgttacagaacagcttgactgaattcaaaatccagaagctcagagtgtatcctgggaagatggtggaatgagaagcacctggaatctagacaacaactgcacaggcaggatctgtctgatgtaaatatttcagagctctggagcctactgatggcttgcaacttctggaggaaggcccagttggtaaattgtaggtaatttcagtcaatttcagcccttagcacaatagcagctacccaacactacccccaaagcagtcatcttgtgttcctacagtaagttacaagctgctagcccatttcttagaacctctcatttcctttccatcgtggaaatctatcctcaaggaaacacttctcagtgttccatctgctattctactacccctcagggattgctcaggcccctccctttcctacacatcaagctaggggatttgcccccgcccaggactggcaaattgactttactcatatgcctcgagacaggaaactaaaatacctcttggtctgggtagacactttcactggatgggtaaaggcttttcccacagggtcagagaaggccaccacggtcatttcttcccttttgtcagacatcattcatcagtttagccttcccacctctatacagtgcgatagcggaccggcctttattagtcaaatcacccgagcagtttctcaggctcttggtattcagtgaaaccttcatatcccttacggtcctcaatctttaggaaaggtaaaacggactaatggtcttttaaaaacacacctcaccaagctcagccaccaacttaaaaaggactggacaatacttttaccacttgccttctcagaattcgggcctgtcctcagaatgctacagggtacagcccatttaagctcctgtatagatgttcctttttattaggccccagtctcattccagacaccagaccaacttggactgtgcccccaaaaacttgtcatcactactatcttctgtctagtcatacttctattcaccgttctcaactactcataaatgctctgctcttgtttaaactggtggtttactctgtttctccaagccatcacagcttatatctcctggtgctgtccccagatttgccactcttaactccctcttaaagtcaataaataatctttgatggcagggctatgctgaacccccttgggcactctctaattggatgtcctgggtcctcccaattcttagtcctttaatacctgtttttctccttgtcttattccgttcttttttcaattcatacaaaaccatatccaggccatcaccaataattctatatgacaaatgctccttctaacaaccccacaatatcaccccttaccacaaaatcttccttcagcttaacctctcccgctctaggttcccacacctcccctaatcccgctcaaagtggccctgagaaacatcgcccattatcactccataccacccccaaaaattttcatagccccaacacttcaacactattttgttttatttttcttattaatataagaagacaggaatgtcaagcctctgagaccaagctaagccattatatcccctgtgacctgcaagtagacatcaagatggcctgaaataactgaagaatcacaaaagaagtgaaatttaaatggcctgttctgatgacattccacaacaaaagaagtgaaaatggctggtccttgccttaactgatgacattgccttgtgaaattccttctcctggctcatcctggctcagaaagctcccccactgagcaccttgtgaacccatccctgcccgccatagaagagccccctttgactgtaattttcctttatctacctaaatcctataaaatggccccacccctatttcccttccctgactcttttcagactcagcccacctgcacccaggtgaaataaacagccttgttgctcaaacaaagcctgtttggtggtctcttcacacggacgtgagtgaaacacacaatgggatgcagaggcttatataccgtctcaagttaacagaatgaataaaggctcaaagcatggccaaaaccaggtaccattagagtcagaggtatatccatttattgtgggcaagacaggttatgggagggagagaagaggaggcctggctagcaaaggtgatcttaatatgtaaatgaaaccttacaggcagcagctctcagaaagaataagctctaaaagtttctttcagacctttacagctgtcagactctcagttaatctttcctagatctgggcaaggaaagacttggctgcatcaatgcagattccctacagatgcaaatctcctcaacgaaagacaactttgcagggctacttctgcagctggctttctgaacagacatctcaaaatatgtcaaagaaatgtattttggggtaaaatatttttaattccttcacatctacagcctgatgcacctgccgtttcaacgcaccattgttggtggcaattccattctttcctacaattaagccaaaagaacagattctccttgaggctagtctttttctcacagcacacatacaatttctcagaaaaattctgtctcctgtttggttaattacagactttaacctgcccaatctttctctttcttggtctttgaattttggcaaaggagtctcctgatacaggcgggattgattctactgacgagtctcaaaaccgtcagacatttaagagccttaatcttggggtggaggtttgggccacccttgaacattttctttgagactaccggaccaaatcagcctggccaggcctgtcttcaaggcccaggggcaggaccaggtaggtcctcccgacgcttcttgaagcttctcccgcgtgtcggcagccaccctcctcttccgtgtgacctgcagagaagcttcagggggcatttattcaattttctaggagcccacgaggcgcaggtgagcggtgacgctgtggttcccaccgcaccgccgcgctccttggtcctctcgctgtctctggcgggcagtaatgttccaggtgagcttgggctcctaagacaccaggcagggagggaccagtggggaagggcaccggccccttaggtccttcgcagtagggatccgaaaaaggtcttgaagaaatagaaaggtagagttggaagtagatcaaagggaaagaaagaaatcctaggagattttctatctgaaggcaccatgaagagatactccctcttctgggccgggtcctcaggtcgctggtgaaccgagttccgatctacgttggagaccaaaccagttgactttggcttgactcctagtgaagaagccacgctttgtcctcccctgtttagctcttgatcctgaagcacttgattagggctttgaattccagggatgcaaatgagaagtttgtttttaatgcacttccttgaagtaagagtatttgaaagtatttttgcgaagaaaaacatttccttttgcactgaagacattcagatgtgaggaagatcactcagctggggaaagcaaatgctgttgagaatgtctcacaaacacaaattacatgtcagcaggtaggtttgaccctcaggttgggcacattttaagtgcactgttggtggaatttaagatgaatctaggacattcatgattaatatttttagttttttaggaaaatttaatattttaaatttaaatacacattctgaaaattgcataaccagcacaagaaaccggctttatgccattttcacaaacacatgaaagatgatactttaaatggcaatgcttcataaatggcaacatttttaaagtactagagaaaaaaattaacctagaattctatgcaaaaataaaatttcaaaactgtgagtgaaataaggacattgaaaaacatacaaaaactaaaagaattcaccaacccacgctacaagaaatcttaagagtcctccaggcagaagcaaaaggatcccagataaaaatctggacctatacaaaaacaaatattggaaatggcatttagaaagcatgtactgcacattttcttataatttaaatctttttaaaaatatttgacataataaatgaaattaatgataatcacaaaacttataatgcataaagtaaaaatacgtaacactaggataaaggccagaaagggaggtataattacacttgaaagcagaatgtgataaattaaagatgtatcccagaaaccctaaagctgccactgaaataagagaagggttatagctaataaagcaacaaaggaaagaaaacggaattaaataaaagctatgtaaacactatgctggaacaactactctccaggcctccaccctatagaaatacaccagtggccaatgagaagtgtacaagaatgatgactgcagcatcgtttgtaatcataaaataatagaaccaatgtaattttaaagatacataaaaagggttttatttatttaacaaacagacaattgaacaaacaaacaatggaagcaagtcatttgccaaaaggaacacagagggtcatgatgatctactcctccaaggatttcagggttcccagacgcctagttttctgtctagttctggaagatgttattcttggggagcaataggtcctcgagtttggggctctttcaggttctctctccatttccccattctgctacaatagataaacaaacaaaaacaattctcacttccagaagatcccgcctgtacgtctgcacgagcccttcaggaggtctggatgtctggttcacaactcccctgcttcttttccagcttttgctttcccttcccccgctcccgccctaccgccccacgacccgaccaccgcccagctgagccccagaggctccacagcgcagaaggtgcaccggaggccgtgtcagttgcccgccccgcggggtgccaagaaatcaacgctttgtaaaaagaacttccccgtggaaaaaaatctcttgatttccactctcacctctcttcaaaggactaaaagctaaaggcgacaagggattcattcgacaagtcctagtcgtgcgcccttgtgagtgccagaccctgctccctgccaggggacccacgagcgaccctcaccaccatccctgccctggtggagccccgggcggaacacaggatccgaagatggcagcggaagctccgcagcagcccaacagcgactgggcagggtggatacaggctccttcactgggtgaaggcggcacaaagaaccggaagaaccatcccgggagcccaccgggcgttcagcttcccttgggaccccaggcgtctcgggctgggtcgccgaccggggcgtttctggggtctctccctctggctccagaatctcctaacgcgcaggtgtccaacgtgaccagcgcgattcaccgctctaatatctctggttttccaagaacttgctcagtcgtcctgccaggcgggccctgggaatagaagggacagaggaagtttagtgagtgcgcccttcctatatggcccagtggagttagcagtgcttgtctctgtggtgcaatcggttagcgcgttccgctgttaaccgaaagcttggtggtttgagcccacccagggatgcttattggaacttttaaagcatgcacgtattgtcaatcactacataaatggggaagaattagccactaatttatgactgatccatgtcaagggccagccagctccccgaccagattcttaatcgggtatctcctgaaacggcgggtttacacctgtgtaactcaggaatcctgaaacagagacctaggaacccacttctggtgtgataaaattctaattcagtcgattatacgcttaaatgagtaacttacttgtctccgttttttcatattttagtaataggagtccagtagtatctccaggatgtgcctggatttactgattggtctatcaataatgtgaccagtggaatcattcatcatcatagtgatcctctccatcatttttgaaaacagtatttttcctcagtttgtgcattatttatttaacccttttcaaaatgtttttgttagccaggcatggtggcatgtgcctgtaatcccaggtacttgggattctgaggcaggagaatcatttgaacctgggaggtggaggctgcagtggaggctgcaccagtggaggctgcaccgctacactcccgcctgggcaacagagcgagactccatctcaaaaaaaataaaaataaaaaaataaagtttttgagatgaggtaggtttcattgttttaggattacaaagaatgctgcagccacctttcttgtacacatatctttggtcattgtggaaatgtctacaccgcagatatttctatagtgtagggaagttgatgcactattgctacattatagggtttacatgatgcttctaatttgagtacattccgcaaatgtatctttcacgggagccgtaccaaataatattccagtagcaatatttataggaggaaaaatgtgcagaagtgcaattgagcttcgtgcctctccatggggcccatgttcataaaatggtggcattagcaatcatctgagagtggaggagtttgtggccctctgacatcaaaagctgaagcagaggacatgaaaaccctcactgtacatcctctgtagtctggccagaatcattcctaggtcagtggtctcttatcaggagggaatgctgcttgcttgttttgtcaaaaccacaaaagggagggaaagtttcaggccattggttgataacagtggagaggcaagtctttccaaagggctggtttgttaacccttaggaaaaaacatcctaattcttaccagatggttccatgaagttccaggcttttggtgtcccaaacaaagaactgtacatgacacacataaagcagcaaagcaaagcaaaagtttattaagcacagtaacactctcagagtggggagagtctgggagatgagatcagtattagtttggtgtactttgggtctttttatgtgtgtttttttcttctcttcacagggatgcctaatctttagccagtgtttgtcttttgattgacaggtgcttagttactttggcccttgtgtgcttgcacgttgcctccatcccataattttaagtacatgcatgatatgtagtccatatgcatgagttttaatgagctgattatcatatgaagtcatgttaagcatactttttctctctaatgcacatgcctgtctctgaggagctgctcctttactggtttggatattgcaggccatggggtccttgcttgctgttttttgtttttttgttggttttgttttgttttgttttgagacagagtctgtctctgttgcccagtctggagtgcagtggcacaatctcggctacctacaaccttctcctcccgggttcaagtgattctcccacttcagcctcccaagtagttgggaccacatgcgcacaccaccaaccccggctaatttttttgtattttaagtagagatggggttttaccatattggccaggctggtctcaaactcctgacctcaggtggtccacccactttggcctcccaaagtcctgggattacaggtttgagccaccaagcctgatcaaaaaaagattttttaaaattattcttttaggccagtcgaggtggctcatgcctgtaatcccagcactttgggaggccgaggtgggctgatcacgacgtcaggagtttgagactagcctggccaacatggtgaaaccccatctctactaaaaatacaaaaattacccgggcatggtgtctggtgcctgtaatcccagctactcgggatgctgaggcaggagaatcacttgaaaccagaaggtgaaggttgcagtgagcagagattgcaccattgcagttcagcccgggcaaaagagcaaaactctgtctcaaaaaataaaataaataaaataaaataaaaataaaataaaataaaataaaaataaaataaaataaataaaataaaataaacaataaaataaaaattattcttttagccgggcgtggtggctcacgcctgtaatgccggcactttgggaggcccaggagggcggatcacgaggtcaagagatagagaccatcctggacaacttggtgaaaccccttctctactaaaaatacaaaaattagccgggcgtggtggcgggcgcatgtaatcccagctactcaggaggctgaggcaggagaatcgctggaatccgggaggcggaggctgcagtgagccgagatgacgccactgtactccagcctggcaaaagagcgagactcgtctgaaacaaacaaacaaaaatattcttttaaacttgtgtcatggccgggcgcggtggctcacgcctgtaatcccagcactttgggaggccgaggcaggcagatcatgaggtcaggagatccagatcatcctggctaacacggtgaaaccccgtctctactaaaaatacaaaaaattagccgggcgtggtggcgggtgcctgtagtcccagctactagggaggctgaggcaggacaatggctaaaccagggaagcagagcttgtagtgagccgagatgtcgccactgcactccagcctgggcgacagagcaagactccgtctcagaaagaaaaaaagaaagaaagaaagaaagaaaaatgaggaagctactgatagtccagtatggtatactgtgacagattgaaaaaaaaagtggttatattttgcagcttctctcatcaagagagtctatttctcctctctttgaatcttggattggctatatgacttgctttgggcaaatgttggtgccttcgcaaacctggcagaagagaggcttgcacatgggaggattacctgcttttttcttcacttgaaatcctgaggccatgatctgaagatcccccaaagctagcctgctagagagatcacatgaagaaaaagatccatgcatcccactttttccaaccaatccacctataccccagatgtgtgaggccatcctagaccatccagccccaaatgaaccagcttggactagaagaatttccaagccaactcacagaatcactaaaaataataaattattgttattctttttttattttttaagagacgagatctcagtctgtagcccaggctggagtgcagtggcatgatctcggctcactgcaacctcggcctcccgggttcatgccattctcctgcctcagcctccctagtagctgggactacaggcacctgccaccacgcctggctaatttttgtatttttagtagagacggggtttcaccgtgttagccagcatcgtctcaaactcctgacctcgtgacctgcccgccttggcctcccaaagtgctgggattacaggtgttagccaccacgcccagccaattattgttattctaagtcaataagcttgggatggtttattatacagcagaagtgtatcaaaagggtgatggtagttgcaggaaataaatatatacctttaattgtatatgcataaacatctttggaatgatacctccaaaatacaaattcccatattgaaagagcacactcagtacccagcatggtggatggaaatatatcatgaagtttcaaactaataggaagaggtagaagattctataggcttttgggaggggagatgggagaagagtttaaggcaaataacaaagaatcagagcggcatccatcttctctatggtgctgatgtgctccagtgtataaccatcaggaacaaacctatagtcaaacctgagtatattggctcattgcaacacaggagacagcaaacactatggggaaattgtggggcaattcttcctttgggaatctcggtatttttatctagaaagtgggagaagtggttgcaagactaaacacataattggtaaagaatcaacagtcaatacaaaagttagccaagtatggttgggcatgcctgtaatcccagctacttgagaggctgagggaagagaatcacttgaacgcaggaggtggaggttgcagtgagctgagatgacgcccctgcactccagcctgggcaacagagactgtctcaaaaaaaaaaaaaaaaaaaaaaactggcctggtgcagtggctcacgcctataatcccaatactttgggaagctgagcggggcgggggtggatcacaaggtcaggagttccagaccagcctggccaatatggtgaaacccagtctctactaaaaatacaaaaattagctgggtgtggtggcaggtgcctgtagtctcagctactcggaaggttgaggcaggagaattgcttgaacccaggaggcagaggttgcagtgagctgagattgtgccactgcactccagcctggtgacagagcaagactccatcacaaaaaaataaaaaataaaatcattaaccgtcactattagtagctgggatgtttgatcatattatggtttgaacagtgttctttttatgttcaaatatgattgtgaaatagtatttctttcagtttagtgagagggtaactttgtctgatattggtgttgtgaaatttttcgttttaaccatagaacaccatggcctaggtgtttgtcagaccagctctagctcagagcagaaaaggcttacctttttctttctcagaaatgactatggaaaacagtaaacaacaagggccaggagccatggctcaggcctgtaatcccagcactttgcaaagccaagggaggcggatcacttgaggtcaggagtttgaaactgtagcaggagtcatagacaaaatccctcagacacccgattgtggaatgtaagagcttttttcagctgggaccatcggtagactcacatcctagaaaccgagctccccaaataagtaattcttgtcccttttaagggcccacaactctaaaggggctgtgttgggggggtcatgatcaactgagcaagcaaggggtatgtgactgggggctgcatgtactggtaatcagaatgaaacaggacagaaaagggaatttcataatgcttttttatacaatgtctggaatttatagacagcacaatcggtgaggtcagcggttgaattttaacaaccaggcccgaaatgtggcacccagttgtctgagcgtgattttcacttctgcccattctttcaacctccactttttcagcaaacaagaaattaagtgtaagacaatatgaggagtggtcgctctcaaaaccagcttggccaacatggtgaaaccccatctctactaaaaataaaaaaattagccggacatggtggcaggcacctgtagtcccagctactggggaggctgaggcaggagaatcgcttgaacctgggaggtggagattgaaagtgagccaagatcccaccaccgcactccagcctgggcgacagagcgaggcgagactctgtcacacacaaaaaaagcagtgccttcaaaaatctcagagagaaattatttccacctatctttttgtatctctatctagtaaaatatcaattaattttatgggtataaaagacattttcagacatgcagtgtctcaaaaagtttatttctaaggtaaccactttataggaggttttggaggatatgcatcatcaaaaggaagaagtgagtgaggaatgaacccccttgagatccatgaagcaggggatctaacaagagagaggcgatggaaatcccaagatggtgcagtaaagagagatattatgataacagctgtgggataagcctgaagagcaagtcatccagaatggaacatatagaaatgtgccaggaaaaatttctttctttctttcttttttattttttatttatttttattttttgagaaggagtctcgttcttttgcccaggctggagtgcaatggcgtgatctcggctcactgcaacctctgcctcccgggttcaagtgattctcctgcctcagcttcccaagtagctgggagtacaggcacccgccaccatgcctgactaatttttatatttttattaaagacggagtttcaccacgctggccaggctggtctcgaactcctgacctcaggtgatccacctgcctgggcctctcaaagtgctgggattacaggcgtgagccaccgtgcccggctgctcttttttatagacgaagaaattgaggtacagaaaatccagtaacgttttaaaagtcacgtcatgaatgaaccaagatttcaacccagaaattgaggcttcactacaagtgaagactggggttttcttgttttcaattattgggagttttggatttccaggaatgtgcaattgtaaaaacccagcttcaggaggtgatgaaataggtgcagtggctctggtgtaagctctgaagccccaggctcaggctctattgaaaaattacttttgctgaaatattcctgtttttaggaacttccatggaacttgagccttcacgcagcatattttggcatctgattcaaagctaatagaggtccggaggattcccaggattaaagtctttaaacagaaactgtgaatcttgcctaagcaaaaggtgccatccctggatgggcttgcaccaccaacctttcagttaacagtcaaacgcgctaaccgattgcgccacagagactctaatggcttgtgtcttaaactcatttgctgataccagaaatggctttttaacctctggctgcagataatctcatatatttgatgcctgtccaatcccgcgcactccagaaacccagaatacgggagacaatgaagccaagagtcgagtctttgggcactttggacgttctacccgggcagagtcagctgggggactccaacggccaaagggccacctgctcctcaccgtctgctcttcactgcttcccccgcctgctcttcaccctctcaaaagtcgctggcccctctacaggtgacaactgcagcttctccggcgaaagtcactcgctttcccattcttagccccgctcacaccttgcgctcacagtcatttccgccaggcctggaccagcggacgcgcgcgtgggaaggaccagaacccgtggtgtcctcactgcgtccccctcgggccctcagaggtgggatccacaggaaagggacctggagtttgcacaggctgcagcccttcgcccagagccaccctagcacctagtaggtgcccaataaatgctcagtgaaggaaggcattccaccgcagggttttaggagaaccatgaattcctgggtgaacattaagcgtttagtcctactaggaagtctggaatatagagacttgaactgtttctcaaaggcagctgttcttgtatccccagagccggtttagaatccagcaaaggcccctgcccggtgtatcccacctctggagacccgaggatagtgcggtggggggcaccgcgggttctggtctttcccacgctcacgtccactggcccaggcccaaaggaaatggctgtgagagcaagatgtgaagatagttacaaataccagctagggccagtgacagttgcagaaatgaggacttgtaatagttaggagtatttcttcattattttgagatgaatacatttggttatatattaaccaatacttttcttgagaattctcatcttccatcatcctcgctatcatattcattaatagttaacttttagaaatctcaatatttaggttacaggatagcaaatatggaatgtgatctagctaaaaaaggagtgaacatcattcaaagacaaataaaagactttatcctgttggggaaagggttggcatattttcactgaatgagaaaaagtatgattttcctattgtctttatttgaaccttaagtatggctttacaaggaggaaaaaggaggaagaagaagagaaagaagaggatgaggaagaggaggaaaagagaaggaggaggaggaaggtgcacattgatgccactttgagaagaagtggactgtggtggatttgtaatgtatcagttttgccaagctgaatgcacatttcccagatttgccatctttagatagctctaggttagcctgggcaacaggagacacttggaagatagaattcaagtggctgttacacgcttttgtatactgggaagggcgttgttacagctcaggcatgatcttcatcttccctgacccttggactggtgggtgttttgcttcttgatctaacattaaggttagaagttgcaggatcccagctgggttttgttacatccaatctggtttaagttcccatattattaggaaagctttagggtgcttcaggaaaacgctttttaaaaaatcagatttggaaaatatcaaatggaattacaggcaataagcataacccagtggaaacatgaatcaaaccctctagagcagggttgtctaaattttgggttccttgggccacactgggaaaaaaaaaaaaagacatttgtcttgggcccagcataatatacactaactgcaactgaaccgtgcgtgtaaagcttgtaaacaaaatctgtctgtaaagtctgtaaacaggccaggcgcggtggctcaggcctgtaatcccaacattttgggtggccgaggcgggcggataacttgaggtcaggagtttaagaccagcctggccaacatggaaaaaccctgtctctaccaaaaattcaaaaaattagccgggcctaattttttagtggcctgcgcttgtaatctcagttacttaggagatcgagtattctctggctgaggcaggagaatagcttgaaggcaggaggcagaggttgcagtaagccgggatcccgccatgcactccagtggactgtttgctgttaataaatgtttacaatgggctcccgtagggaaaagaaaagcttagttttatttctatagaacaaaaaaaaaagttaagagattagtagagacgggtccaccatatttgaccacactgacatcaaactccagagctcgagcggtattaacataaagttatcaatgcatctcacagactactgagattacaagcgtgagaaccaaccactacctggcaaaatctttactttgaaagtaagttacagatgggaacaaagacctgtttattagtttatactaacgccttgtatatgcttccacagcaaacaaaatccacttttaaaacgacaacaacccagggaaaaacacagacacagttccccactgccacaaattatgtaatcaagattcccacattcggggaaatcacaggggtcagcacatccacagtaaaactgctaagccttgctctggaaaaaccaccttcgtgatcataacatttcttctgccagataaacataagtataagctcacgcccctccgccccgccgcagcctcatatgcctcaccctttacacgcaaggtcacttgcgtcacgcgcatccaggagccatcctagccctaacacacagctgcgactctccggtccgaccagaggtcccagacttactcccacggcacgggaactctttcgtggcgaagcagcaggtggcgaagcagcagcccctgcgctgcctcatctacatagaaatcgccctctccgtgatgtcaccgacaacgccttctggatccccgtctgctcttccgcctcacccaacgcccctcagcggagcaacccgctgtcggagccggcgggagaagtgacttatgcctgtcccttctttctctcctgtccccgcccctcgtctcccgcaatgaagcgagtatttaatctgtgtcctgtggaagtcccatttggcggccagctggaagcccgtgcacccttcttcaaataatggctttcaatgagcagactagaacgtttaggattacaaaggaaaccgattcctttcaaacttggttatctttgtgatgtggcactgtgtgcatatcttcgttaaaacgcattgaaggccactgcactccaccctgggcgacaggaggtgactgtgtctcgaaaaaaccaaaaacactcccccctcaccccaaagcattagacgtcaaggctggcagggatgtctgttctcttgaaagttcaatatcaaaatacttggaaattaaactaaaatagtagaagcaagaacaaaaattaagttgaagataatatcaagaatatttcccacaaaccaaaataagaatgtaaaaacaggagagaaaagttcaggaagatagacgtccaaggtccatatgattagcatgcgtatcagaaagaggatagaaaaaaatcagtacaataattcaaaacactttccataccaatggattgaaactacagtgaatttaaagtattgaattgatattgaactttcaagagaacagacttccctgccagccttgatgtctaatgctttggggtgaggggggagtgtttttggtttttttgagacacagtcacctcttgtcgcccagggtggagtgcagtggccttcaatgcgttttaacgaagatatgcacacagtgccacatcacaaagataaccaggtttgaaaggaatcggtttcctttgcaatcctaaatgttttagtctgctcattgaaagccattatttgaaggagggtgcacgggcttccagctggctgccaaaggggacctccacaggacacagattaagtacccgcttcattgcgggagatgaggggcggggacaggagggaaagaagagagaggcataagtcacttccccgctggctctggcagaggtttggtcccctgagtgctcctttcttgtaagcagttcttgtttcatattttcactatctctgacactattaactgtacaattttttttcttctgtacacaaaaaaagtttgtttcaatagtgaagtatgagtcagggtggtggctcatgcctataatcccagcactttgggaggccaaggcgggcagttcacctgaggttaggagttcaagatcagcctggccaacatggtgaaaccctgtctctactaaaaatacaaaaattagccaggtgtggtggtgggcacctgtaatcccagctatttgggaggctgaggcagcagaattgcttgaacgcaggaggcggtggttgcagtgagccgagattgcaccactgcactccagcctgggcaacagagcaagactccatctcaaaaaaaaaaaaaaaaaaaaaagtgatgtatcttctacagtatactcttccaacttatcagattctgtcattgacatacgatgttgcatcaatacttgtgtaaggggtttaacactactactatatataatatatgtaatatattttatatatatatgtatatatatatataacactaaggtttattaaaacaactctcagtaaacagatgcccctgatgttccaacaaaaaaacctactattattagaaaccaaataaactcctcctcctatgaggaagaaagtaaacaacttctggcttggcgcggtggctcacgcctgtaatcccagcactttgggaggctgaagcgggtgctcatgatcacctgagtttaggagttcaagaccagcctggccaacatggtgaaaccccgtctctattaaaaatacaaaaattacagcgcgcctataatcccagctactcgggaggctgaggcaggagaatcacttgaacctggggggcagaggttgcagtgagccgagatcaccccactgcactgcagcctgggcaacagagcaaaactccgtctaaaaaaaaaaaaagtaaacaattctggaacagtttgaaaaagcaatttaagtgaaaatgaaaccaaaaagggtaaaaagaaaaaggagggaattgtaggaaataacctatatgtgattatctattttcaattctaagtggcttggtataggtttaggcaggctacctggaaagaaagaaataaagaagcagaatgtactgagccaccccctccaccttccttctttccctttcacccagtggccaggcatctatcggtgggggctccctcatctaccccttccccactccacaaagaaatttagtttaagctagcttgcaacatagataattgtaccctttcttatcagctaagtgcagccactagagctgtaagtcaaatgtttgaaaaatcctgagagttataatgcatcgtgtgctgcaataaaatgcagcagaaagaccctaaagaatgtacttgaagaacaatcaataggtgatgtctaggaagattgtggaaggctagtactcagcctatgaggaactgagggagggacctgtgcactagggcgtaaattgcttgttgaaactgtgctgggtgtgcctgcatgccagacacccgatcttgcaagaccgtcattaaaagtctcactttcgctgttctctgggtctctgagttcattgtttgggtttagatgggtgaatttgtttctcacaaatttgattggattgaaggatgaaagtattgatcctgggcgtatctgtgagggtgttgccaaaggagattaacatttgagtcaatgggctggggaaagcagacccaccctaaatctggtgggcacaatataatccactgcccatgaatataaagcaggcagaaaaacatgaaaaggcaagactggcctatcctgccagcctacatctttctcctgtgctggatgcttcctgccctggaacatcagactccaagttcttcagttttgagacttgaactgactttcctgctccttaagcttgcaggcagcctattgcgggacattgtgattgtgtaagttaatacttaataaactcctggctgggtgtgatggttcacacctgtaatcccagctctcagagatgcagaggcgggaggatagcttgagcccaggagttggagacctgcctgggcaatatagcaagaccctgttttccacaaaaagtaagaaaaaaaaagacaaaaaaaagtaagtgtaatacttaataaactcctttgtatatctatcctattaattctgtctctctagagaaccctgactaatacagagtcacataaaaatatgagcctcaggccaggcacagtgggtcacgcctgtaatcccagcactttgggaggccaaagcgggtggatcctgatcacctgaggttaggagttcgagaccagcctgaccaacatggagaaaccccgtctctactaaaaatacacaattaaccaggtatggtggcacatgcctgtaatcccagctactccgaagactgaggcaggagaatcacttgaacctggcaggcagaggttgcggtgagctgagatcacgccattgcactccagcctgggcaacaaaagcaaaactctgtctcaaaaaaaaaaaaaaaagcctcaaagaaggccgtatggttgaagtttatatgcagcacataaaggactaactaggcttggagttcttagggggtggtggccacaggttatgggaggttgaggggaggaaagacatggtgagcaaaggctgtgttgtgatgcagatgtgatgcagatgaagtctctcaagaagcagccctccaccagatgtggtggctcatgcctgtaatcccagcactttgggaggctgaggtgggcagattatttgaggtcaggagttcaagaccagcctggccaacatggcaaaccccatctctactaaaaatacaggccgggctcggtggctcatgcctgtaatcccagcactttgggaggccaaggcaggtggatcatgaggtcaagagatcaagaccatcctggctaacacagtgaaaccccgtctctactaaaaatacaaaaaaattagccaggcgtggtggcgggcacctgtagtcccagctactagggaggctgaggcaggagaatggcatgaacctgggaggcagagtttgcagtgagctgagatggcaccactgcactccagcctgggcgaaagagcaagactctgtctaaaataaataaataaataaataagtaataaattaattaattaacctggtgtggtggtgggcacctgtaatcccagctgctcgggaggctgaggcatgagaatggcttgaacctgggaggcagaggttgcagtgagccaagattgcaccactgcacactccagcctgggtgtcagagtaagaccccgtttcaaaaaaaaaaagtttcctgtcagacctttaaaagcatgagatcttttgtttccttttcctgtgagttaatcttacctggatccagataaagcagataagaaggtctcagagaaagccatttgcagttgatgtttacttcctctacacatgctaatctccctgacaaaaggacagcttttcataggtatttctgtgactgtgttgcctattgcactgcctacatgacttacctggacccctacccagatgttgttggccattgcagtgcctatgtgacatggctgaattcttactcacctttaactctgcttatttttaagaaacaggatgtctgtggtcagaagtttcttcttgggactaaaccagctgaagctggtgaaatccatgatggcagcttacgcaacctctgaaaaacatctagctttattataatccaatttccatgctaaatagcactcccatcagtgcatgacagttgacaatcactgtgacaatgaacggaagagaccaagaaaggacagaaatgaggtgactccttgattctaggaaaatctccatcccttactaagaaaagcatgaatattcctcaccttgctcattcccttcattaaagatcctctatatttgtaacttcctggttctcagtagctgagaaggtgatttgcaagctatactacttctccaattccatgctatgctcctacttctccaatgccattgaatagagcctgcactgcttgacgctcactcttggtttcatacattggctttgcaataataaacaggaaagagtccctttttggggtgagacccctcagtaacatctgcagcccctctaaatagccatctcaaattataccaaaggagtgtattttggggtggcatattttgggcttcccacatggctaagccaacatatagcattcttgctgaacgcagggtgatcagacatcacctagcagatggtgaaggatgaggagccctattagatattatgagtgatcagctattgaagatggggaattctggctaaattgactgagaaggattcttgctgagattgaacaatgcagagaggaacacagaagctcaatagttgaggcctagtgagaagaggactcagaagagcctgattagtttggccaaggagatgtcaacctgaaataaatgaaaggttcagaattcagcgttaaaatgtttattcattctgcttgtgggaactaatggtaaaaattaaaaaagagtttattcaaacaaaaatctgggaatagccaatcagggcacacagactccagagaaatggggtcagtgctgcaaagtcaaaagtgaagttcttgcttacatagaaagaaaaaaaattaataggatcacaacattttctatataaggctgctttaagagttacaacaaattaattagttgcagaatttttttttttttttttttttgttattgttgttgttctgagatggagtctcactctgttgctaaggctggagtgcaatggcatgatcttggctcactgcaacctctgcctcttggtttcaagtgattctcctgtctcaacctcctgaatatctgggattacaggtgcccaccaccatgcccaggtaattttttgtatttttactagagatgggatttcaccatgtgaaccaggctggtctcaaactcctgacctcaagtgatccacccacctcagcctcccaaagtgctgggattacaggcatgagccccactgtgcccaacctttttctctttccatactacttgttttctttctttatagctggctcacatttcctttccaatttaaaggagtgtatttaacattgcatcttaagacaatgcaatagccatgaagtctttatgagagcaaggtaagaaggaagttaatctataatgaaagtcagcagtgcagagggaagcaatcttccctggcacccttcaataatttgtataacatgttagaaaacaatgcgtgtggctgggtgcagtggctcatgcctgtaatcccagcactttgggaggctgaggcaggtggatcatgaggtcaggagatggagaccatcctggctaacatggtgaaaccccatctctactaaaatacaaaaaattacctgggcgtgatggtgtgcgcctatagtcccacctactcgggaggctgaggcaggagaatggcatgaacccaggaggccaaggttgcagtgagccgagatcatgccactgcactccagcctggcccacagagcaagactccatctcaaaaaaaaacaaacaaacaaacaaaaaaaaaaccaacaatgtatgtaaggaagaaggccaatctataatcagagaaacaaaggttacaactgcctagtttacaggtgcctctcatgtgacttaggctccatactcacattttcttcttttttttttttttgagacagagttttactcttgttgcccaggctggagtgcaatggtgcaatctcagctcactgcaacctctgcctcccaggttcaagtgattctcctgcctcagcctcccaagtagctgggattacaggcatgcgccaccacacctggttaattttgtatttttagtagggatgggctttttccatgttagtcaggctggtctcgaactcctgatctcaggtgatctgcctgccttgggcctcccaaagtactgggattacaggtgtgagccatggtgcctggcccatactcacatttttttaaggctcacagtaatttggaattccaacaacttacattttaaattacttattttcacagaaagaatctttgtcagttgtaactcgcttatttctccaaagaccatagtcctgtccagtgatcctccccaagacaatagctctctctagtaactatagctttcctttcccatttcaatttccactccaattgactgaattgtgaacaccaactcccacacttaaatgttgaagccctaacccccagtgtgatggtttatgcagctggggcctttgagaggtaatcaggtttaaaagaggttatgagagtggggtcctcatgctgagattaatgccattataagaagagacactagaaagcttgctcatccgccttccccatggtgcacaaagaaatggtcacatgggcacacagtgaaactacagccacttacaggccgtaggaagagatcttagaaagaaatccgctttgctagcacctttatcttggacttcccaacttctagaagtgtgagaaacacatttctatagtttaagccacttggtatatggtattttgttatggcaacctgaacagacttatacaacaattaagtcctagaggcaatacaacttctctgctgattccagattctgagcgcctctcagtcctttgttgggttattttgatcctgtccatatatttagaaatattctcttcataaaactctctgtaggctgggtgcagtggctcatgcctgcaatcccagcactttgggaggccgaggcgggcagatcatgaggtcaagagatcgagaccatcctggccaacacagtgaaaccccgtctctactaaaaatacaaaaaattagccaggtgtggtggcgggtgcctgtagtcccagctactccagaggctgaggcaggagaatggcgtgaacccaggagtcggagcttgcagtgagccgagatcatgccactgcactccagcctgggggacagagcgagactccatctcaaaaaagaaaaaaacctctctttaaatcacacattcgagtgtgccctttgtttctcatcaaagccaagactgatttgagatgatttcttaaggtcaggttaatgtcttaatccagttgtgctgctataacaaaataccacagagtgagtaacttataaacaacaaaaatttattgctcacagttatggaggatggtcagtctaagatcaagttgccagcaggttcagtgtctagtgaaggcccattcctctgtcacccaggctgaagtgcagtgttgcaagcttgggtcactgcaaccttcacctcccaggctcaagtaatcctcccacctcagcctcctgagtagctgggccacaggtgctcactaccatgcctggctaatttttttttttttttttttttttttttttggtagaaatggggtttcaccatgtttcccaggctggtctcaaactcttggactcaggcaatctgtcagcctcctaaaggagtgctgggattacaggcatgagccaccgtgcccaccccccaaattctactaatatatgtgcataattaaatagttaccagccatcattttctgatactttggcaattggttgaaagagtttatctaaagacctggaatccatagaaggcagtctctgtgttaaggggttgttcttattatgcagatgaagcctccaggtagcaggcttcagagagaattgattgtaaatgtttcttatcagacttaaaaaggtgcctagattagggaaaagacctggaaagggattccctgtagcatgtagactttccccacaagagacaactttgtagggacatttcaaaatatgataacaaatatattttagggtaaaatatttttatttctttcagggcctgctatctgtcatgtaatgctacactagagtcaggctggaatttggtgtcttattgctacaaaaagtcttaagatctctgttgtaatgccagttgtgcctggtcggatgtgctggtcagttgtgcctgaattccaaaggaaggagggtataatgaggcctatctgacccctacttcccatcatggtctgaaccagtttttcaggttaactttggaatgaccctggctgagaggaggggtgcattcaaatagttgaggggcttggaattttatttgtggtttacactatagaaagtatttttccagtattacctggacaatgtgtctccctgtcagtatccagggaatggcacctggatcaagcatttagtgttcagttgctacactctcacctaatccctcattttcaatattttgccatgttttccagtgacccaactggccaccatgtcacagactttatggtctccaagggagacccctccgttttatgttttgtgatttgagcaacagactggaatctacttgaaatttgcaaatggtctttgacttgggctttccaattttgctctacttcacagtgttttctgggttatatacaagggagatgatccagtcatttgttaagcgcctcaaataagacatgccctagatgtttttttgtttgtttgtttgttttgggatgggacatggaatttacacctaaaataatcagcgtctgaaaggacgtcccctctctggatatggaaaaggaagaactgcaggagttgtatgcagctgccttgcaatcccatgggaaacaatgctagctcacaggaaggcaaaagctgactgttgaaaagaaaccaagtcctcgaagacattgttaggccccaaaccaatcaacccagaaacccatttaccactgaatctagagttaaataagcaagaaaatccccttttatttaatccagtctgagttgggtattctgtcattagcaaatgaaggcatcctgacatgtgggaatgtcaagacacacaagctcttgtgcagttttccatgcatggggacagtgccctggcattccagaaatcctggcttacttatcaccactctctaatcaactgcaaataacattttaaaactaagtgcaaagagaatgatcaggaatatcataaaatctgcatttatttaaaaaaaaaaaaaggagcttacagtgaagtagtctcaagcaattgctttctttttttttttcttttttttcttttattattatactttaagttttagggtacatgtgcacattgtgcaggttagttacatatgtatacatgtgccatgctggtgcgttgcaaccactaactcgtcatctagcattaggtatatctcccaatgctatccctccctcctccccccaacccacaacagtccccagagtgtgatgttccccttcctgtgtccatgtgatctcattgttcaattcccacctatgagtgagaatatgtggtgtttggttttttgttcttgcgatagtttactgagaatgatgatttccaatttcatccatgtccctacaaaggacatgatctcatcattttttatggctgcatagtattccatggggtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacttcacaaaagaagacatttatgcagccaaaaaacacatgaaaaaatgctcatcatcactggccatcagagaaatgcaaatcataaccacaatgagataccatctcacaccggttggaatggcaatcattaaaaagtcaggaaacaacaggttctggagaggatgtggagaaataggaacacttttacactgttggtgggactgtaaactagttcaaccattgtggaagtcagtgtggcgattcctcagggatctagaactagaaataccatttgagccagccatcccattactgggtatatacccaaaggactataaagcaactgctttctaagtgggatggctgaagcaagagaccttaaatcacttgaccgtcttcacaaaacagaactgaagcagaaccagaagtcccctgatagcctttcagggacaccacctacaaatacaccgtaatccctcatactccacacgccacttcagggaaagggacatgaggcaggaatacaaatatataccatctgtgacacttcctaagctcctggcttcagagtagccatcctgataattattttttaaagtccacattataaatgtgcaagttaagtgagttatggaaatcattccagatactggttcaccagtaacatcagtttagccctaaatattgtcataagttctctgataggctcatgtgatttaagctggtgctctgtcaagactagacttaggtgttttatcctttttatgacattatgtatgttgaagagaatatatgaatatatataaaaccttcattatcacattattctcaatccagcattttctcagcccctgattttcatgttagttcagcattcttacatctttacagattttcatctaagactacatttctattgttttatataatcagcccccctaagatcaacatgtccacattttttggcaaagacaaagcctactgatttcaggatcattattttcctttttcaaaagcacaaacccaaactgagaaataaatcaagagaaattctccttttttctatgctaatttagaagtagagtctttatttcttttcaaacccaaagagaatcagacatacaatatgaatttatctactttcgcttgctcagactgagaggaaagattaatattttcaggctgttagtcaaaactgttcattcaaatattatttaataaaatccaagaaacagctaaaaagtcgcttaagctaagaaaccttcaccagcctcatgggaaattgtgtacagttttccactagaatagcctataaatgcttactgaaaatgtctaagttcatatcttggtaactaacattttaattcaatctgcagaataatatatgcttctttagtgctaagatatgaatattagaggcattctttcttaaaatttctatttagttatactttcacaaataactatataatattaaaattctgcatgtggcataaaacatattttaatggagaaggtaatgtgtagggagtttatttctgtttgctattagaacttgtgtttattcttggttaaaaaaactgcagattacaacatagaaaaaaacaaaagtatgttgtatatctcttacagtagaagataaagagtagttctaaatttagaaaggaaaaataaatatacacagtgaaaatatgtgtcagtgagatgttaatcaaagatcaactattgctgagaccagcaatattaaatccctgcacaattactcatattataatgagaattttaaaaagaaaatatgaacacataacataatgaaggcagaagtcactctcatccttcatctttgtattcccaattcaggaagctggtatagtatcttcattataattactattcaacaaacatttgtaaaatgaatgaataaggaatgaatgatgagaaaaatgataaacatctccctctgtctcctgggagttaactgcactactttcttttaaatttaattaatcctccatgtccttgtaaaatagccaaagggaaaatgtatttacattactctaaatattgatgcaatctacaaaaagtgttaaacaacttcctcaaagtaaataaaatgttcacaatccagctaggataaaaggatttaaatcatttcctaggtagagggctttcaattagagcccctgctgcattaaccatgggaactcatctcactctcttcatgatggagccctgagtgttgctgctaatctgtactctaccattctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttaatcacacttgtatataagagatcatagaaaaacagtttactaacctgtgaaaataccattcattctctgtttacctctggtccacagctaagcaatcagcaggatataaatgtaccctatgttcactattcagtattcataagtatactacttatgaattggaaatctgacacaacatttacatgacctaattttgaaaatttaaaatagtgtaaggcccctaggcttaattttacaggggaaagattaaagggacacaagcaaacatatattctctctctgtgctgtgggacactggtaattttttgacttaaaatatttgatacttaaaatgccaaacttctacatttctgcagtaacaaggcagttatcatattgaataccatttctttctctccagtaagtagagttaatattagcacatgaactgaaaatattaagtgattataaaaacgtccaaataaattcattaaaatttagcttggcaaaatgttagtttcatgttcttggtagaagtccttttatatttatattcaaatgaaatgaacaatttacaagcaaaggaaatggcatcaaatatttcacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgcagtcaaacctgtaagtcaaaggatatgaaataatagtaactatacattaagcacagaagaaaatgaaacaaacaaaaaggttttaaaccaaccaaaaatatgtcttattttggatgttctatatgttcttacattctctcaggtcttttgtgtcattatgaacacaattctaacaagcttgattattttatttccattcacatattacaggcaacaagctgaaaaagtagaacggggtgtagagagacaggacaaagtacagattagggcttgaagtgcccctgaccagtcgacagcaaccacatggaataatgactcatgtgcattaatgatcacactaaatgatatttgttttttacctagtccttcaactgacagcttaaagaacttcaggttgttctgattcttgagcctcctctacagcttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatctaaaaaaaataatgctgggaagtcctaaccacatcaagaatgcctcagatcagtgacccaaggaaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttgtatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttatggaatgtgtgcaaaccatacacttaagcaagctctggggaatgagagttggggggaatcaactcttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttttgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaatggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatccaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcagacaatacaagaaaagccagtagaaattgccaaatgtatcagaatacacacaggctttctaaggatatggcccaagaggaaggctctagagcccaccctgaaacaggatttttgacttcacagataaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaggcaattaacgttggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtggcttctccataggcagaaaactagcgtagtttttttattagaaattgttattcaataatagtacatgttacaaataaataccattttaaactgaaaaaattgtagactttcaaatcagttagggtggtcaccctaaaaaagggcattttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatatgaagatatgtttatagcaattgcatataaatagagagatagtatgtagtaggaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatattttcctgattcaaatttatatgcccgtgtaatgttccggggttttttttttttaatttctgtaaatcagaatattcagatgttgaaaaagtctttgccttcagatttaaaagatacctttgaaatgtagcatatcccaaaatgcaacccagaggctggcaatgtcaacatttttctgttttaaaaaacctcttatgaaaactattgccatactaaattttttacttgctgatgacttacagctggaaaggattctgtacatataagacatcaaatattgaggatactggaacttttaaattaatggcaaagaaagtcaacaaaggaagttcatatgaaatcaaactagtaatatgattacaaaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaactaaaaataaaatctgactgttaactacagaaatcatttcaaattctgtggtgataataaagtaatgaccgcttttcagctggagggactaactttttttttttgctgcatatatagctgtggtacattttaatgtgaaatgatgactgcatcagcttatatccatggagcagattttagcattcagcttgggtctcccagtcaatatctacgagtctcttcttaaggagatcgatgacacagatacatacagactaacaaatgtgataccaataatcaagaattcactcagttaagattttgcccactgatttccacacaagaaacctagaatttactagattcttgtgcctgtgaggctccactcatttccctgaatcacaaaagctacagagtatttagatagaaatatacctactcttaacatgaaccattttaaatatatgtattactgtgtccacaggagtacactttaaagcagggacttcactcttcaatctctccaatcacgtgttacctaaagtggcatgtggttccctaaagcttaataactgacattgccttaaaaaaggggtttgcttcccgactaatgtggaaaaagtctgaaaaatgattttaaatctttcactaaatttctcatttggtcacgtggaggaaaatgatttcaccaaatagatactctcattaattttttaatgtaatttatcaaagaaatgaaatatttagataaattccagatttcccccaccatgagcttctccgaaagtatactccatcacagactgctcactaagaagctctactgcagtcaaagtgaccgaatttaaggggacataatgactacttctgctacacagaaacattatccatctctaacacttccctatgagacagaagacggacttctaatcaggtaccagagagggctctgccaacttcagggctttgatgaataagaatggttgagagcgctcatcataaatgaattcagtataactgagtgagaaagtgagagaaccagagaaataaatcctcatgtagaaaatttaggggtatgaaatgccaaatgccagttaaccaaagctttctttgtcataaagcaacttctataaaaattgctgaaaataaattcttcatggctcaatgtgaatcagtaatttccatctctattacactgttgtttacccaaaaactatttttaatgactaagactcagagtttgccagagtgttttccacaaaacaactgttttgagatactccagatctgtaatcaagtaagtctgaaaaaccccaaatacctcactcacctcttggatatgcataaagcacactaatatataacgttctaaaaagccaatcattaaaaccgttttatattgtttaagcatttcctagacatatttggctacaaatctaacatctaattaaacagtttgggaaatgccatcacataatgtaggaatattacttgtcatttaagaaactagaaaatatttactatattctaggcagttggctagcagttggagttctagtctctaaacaaaatactgacttatttctgtgacttttttcttttaagcagctctgtgcttcacaatttttttttcctggtttgttttccacttttgtctgtactttattccttcacagatgtgaaaggctaacaaatgtaaactagttatatgaatcagcctctgcctcagttctacacttcaaatacagtatatactccatcaacaattcttggataataacaacctgtacttgttttacaaacaataaaacaggccgggcaccgtggctggctcacgcccataatcccaacactttgggagaccgaggcgggccgatcacctgaggccaatatggtgaattctcgtctcgactaaaaatacaaaataattagctggccgtggtggtgtgtgcctgtaatcccagttacttgagagactgagacaagagaatcgcttgaacccagggggcagaggttgcagtgagccaagatcgcaccaactgcactccagcctgggcaacaagagcgaaaactccatcttaaaaataaaataaataataaaacaatgatgaaaacacaactaactacagcacttcagagttagttgacaaatccaccttttcaatctacatttcaaaatgttcagaaagacaccatcctaggggaagtcaaccagcagcaacctctctgctaatttttgtacacagaaacttgacctgactgcacaaaagtttcaatagatgtctccctctaaaattaatattgaatgatttgtcatcttccatttaataccaaaagggtatcagccacaaactgaaatatcactcatatgcaaataaataacattcaagacttttgtcgttgtggttattaatcttgtaatggatggacataaatctattcacattctcatcctatcctcaaatttcactattctctcctctcattcttactttgttctactcatattctcactctatcctcctatgcataaaatattatgtatcctaatgaacagagataccattcgtgggcaaggaaaaaacacaatgaactgctctttataataaaaaccatgatcttgacacagatgttatcaatcaataaactttacacagctttacactaaattaatacaaactgctgatgagtgggtggggggtggtcactaagcaaacagaagcatgtaggtgttaggaagcatgagaaacatatatcagtgggtagggaaggcagctctcaaaggccaagaatataagttttaggtctatatggaaaaagctgtggtcacattcgaaggcttctgaacagaagaatgattaatttcatgcttaaagagttcaggtgtaaataaactggatgggtaagaaactcaaaatcaagaattttaagacactgggttaaggtgattgagctaagtcaaagccaacagggcatgggctaaatattgacatgggatgggatgaagaggccaacaatgtttcaaagcagaggttgccggagcttcaggaaccagaagaggaagacttgaggtgaaatctgaaacagcaatccccatacctgtctcaaaagatgtgatactgactaggaaaaggctggagagagaagcttcttttaaagaggtaataagggattgttttgatgtgctgggttgaggtgaaaatgacaaatattcaggtggaagtgtccagcattcaagtaggataacttggaacagaaagcccaaattatgtcatggtgaaatgaggataatgtcttattaataaaaacacgtcttactagtctttcctggagaacatgaaagatagaatttcagaaatttagagaatgaaaaaggaaagattacaaggcaataagttgattaaaatagactaaactaatcagtggcagctatcttaaagcaagatataccttctacagcacgatctacccaaatgcaaatctgggcagagaaatacaaaatatttttaggactgacaaaatttcagctatatgtctttttaaaaatgctgcagagagaaatttagatggattggacaaatatttgcataaggattccacagccaacgtacacaattttccaactactatggttagcactgggctcaggcactacctttgccaaccagcagattttcagtattgcccctggcagacatcccattagcaatctctccccattcccaaacattcccaactattctagtcatgccaattcaaccaatgtcccttaagccttacataaacattgacttacaccgaaatgtatcctatggctcttactaactgtaacttacttaaatcacccaagcctctgttttccctgctataaaatgtaaaatagctgacaaaatacctatttgtattttttggaaacacgggataaagcaaggcaagcaaaaagaacagcagagacaatgcttaataaatatcctagtaggatcaccttaatccatgaagaaaatggagtttaatttttttaatacaaaaaaactcaatgaagttatacttacgttaaattggtggttattttaggtcagtggttttaaaactcaacaatgaaactgttttcaaaaagagttgttatacagaacagaaaaaagcagccacaattttaaaaaagatatgaagacccagattctcactaactcattcagctcccttcatactcactccccacagccaccccagctcctgaggcaggttcccagggctccaaggaacatacttttaaaaaatcagtattttgaatacataataagtgatgtaacttaaaagtatggtgagaaagtcccattgccaagagaaacatgttaattttttatttaaaaaatcatcactcttttcattgtgacatcttgaagaacgctgaatggcttcaaaataactgcatatgccaagatttctggagtgggcacgtttgatcttctttcataatgaaaactgacaaacatttttaagggcatagtattgtttcttcactctcccccctcctcacccctgcacacacatacatttctccttcctggggaactccaaagaaaacaaaggccctttagcaatcaagtagattgtctctcttgatggcatcccatgagttatggaattacatactgcaggcccaggtggattagggcccctagaaagtttgcttgatcaacagagtgctgttgattttttcaactgaattaattactcttggagtccaaactctccagtgtgccacagtcctcatcacttcctgtatcttaaatattgcattatctgtcccctaaaagtatttgaacatgtgacccagagaagaggacttacaacttgactaggcaacttctgtcacactggattcatatgaaattccactgcaagtgacatcaccagattgggaaccctgaagtgtttgagtatcttctccacatctggtcatttaggctaagaaattccttcttgtctaccaggtcttttagcattcattttgtaagtcattcaacacctacttactgagaaggaatactgggctagacagtgtgctaggggctggggaaaccgcaatgcataggagagaattcccatctccaagaggctcacagtcaaacagacataaataggtgattacaatatacactaacaacatagttttagaaacaactagcagaattatatagacgaagatgccaggaaaggcttctcagagaatctggcttggcaaatatctcaacaaagagggctgagcagggatgagccgaaggagaggatggaaagtaggttgtgggtgagttttccaggcagcatgtgcaaaggtccaggagaaagaggaaggagcctgtacttggaggaatattcgattactattatcagtgtcacacttgctattcatctagacagaagctcctgaaacaaaaaggatacacttcaaaagatgccaatatatccatgaccacacaaaagagtgtctagtcatataataaagggtgtacatatgcaggcaactcacatcctgccaaatattaaatttctaattttattataatttctaataaaacattagatttattattatacagagtcatactccttgattgggaaactctcaactcaataaacattctttagtctcatgtcttttctaaaggaaagaaattaatgttatattcttgggtgaaaaaaatgtgaggtctcaaaagagtataatacaatttggggatgcatatatattttacatgtatatagacacataaaaatctaaaagcataaattttaatatgttaacagaagacagaagtcatgtatttcttactttcttctttttggcatatctctttttctaacttttttttttctttttacaaaaaacaattgttatttgtgtacttttaaaacctcacagtaatattttcacactaccttcttggctgaaagttcacactcggaattccagagcagtccatggccaggcccactgggctccccttgctctctccttggctttggtaaccactggccccagggactcagcctgctttcctatccatcccctcagtagctgtcaccatgcaggttaccccttctgtttcttctaccactaactccatgtctgactgcaagtgaaaggaacagaagcccaaacctttgggttttaaggagtttattgctaatctgtaaaacagaaagagacaggagataagcatgacaaaatatagggaagaaatgacttttgcctaaacttcccaattgtgtacaattgaagcctctgctttatagctcttagcacacctctcaaataagaaggcagtactgggaaggctctgaacctgtggcagaaccactgatagctgtggagctattccaaggagtctgggaatcagggggattatcaagatcattgttagaataaattaatcttactgtatatatagcagaagttttcaagcatatgtaaatgctactaataaccaaataattacaccttgtttttctttaaactgtaactctcaagtatgtctctacataattttttgattggtagtgtctgcatgctcaaaaagcttgaaaacactactggagaagaaggtctcgggagtgtgatgaaatacgtttacatggcagcttcatcatttaattggtgaaagtgactatgtgtcttaaactctctgagcctcagtttgcacatccaaaagcaaggatataattccatgaacctttccacctcaagtccacaaggcagaatagcaagatgttaactgccactctgaggaccaccaaataaaaggacaatttattaggccacttgccagcatggacacaatcgactcttggcatttcttattatccacagaaaaattaaaagtataaatgtagaacaaaattatcgtgttttttttaatagtaacatgtaagatcaatctttgtctttaaaataccgtgtatctcattctcggaaagcgtcaaaatgaaaatggtatagtaagttttatctacaacttgaattaaaattattcttgaaatatgttctgaatggttagatgaaatggtaattaaatacaaatagagataatcatatactctctctccataaggctcccacctccttcaatgaagtctagttcacctaaaatgacactattaacattaattcaatattataagttgataagcacattaaatcaaaacacaacaagattattttaagagtctgactgaaatgtcaggatgagaaatagattaataaatattggcttctaatgtcggtaatgaaaacaaacacgttattttcagaaaataaaaggtcttcgccattaggtacaaatcataaagggattatctacggttactacactgtaacaactttttacatattgtattatagaacaagcttttgagaagacaaagcaacacatcagcagtttaaccaattgtctttctcttttaacaggctggtctacattagattagatataaaaggcccaggtattacttgtgttcgatcttagccacatggctgagaaacatccaggtacatttaaatcagtgacaaaagaaaacattatcccttagtaaaattacataaaataggaaacatctcttactttaagagcaaccatggtacttgttcctatggtgaaaactgatgttatctcgattagttaattattcatcccaacacctggtcttgctcccttttccacctctagctatgttaacactagagttcagtaatttgctgataaagaatcttaactgcagtatctaacagatcttagtgattaagcatatgacttaccctttgtacagataagtaaactgaggccaaaagaactgaggtatcttattaaaaatcagagagctagttagttgaaaagtccacctgtccttcctttccacatgtctcaccagaaaaacagcaatggtgaaaagtcaactctgtttttaatgggccactttgtatattttaactgttaaaataatccaagaaggtagtagtcatatacgaagatcctttagatataatgtgtaggaccagcattaatttaatcaaccaagtctcctctcattgaattgttaattcataattacaaagatgacattacagtaaattaagaaatactgtaatttcattctctccaaaaagtatacattgaagtttggtgaatactgttatattttcaactagtaaatcaatgtgccaattctgggtcttaggcatattgtatatactggaatgatattcactttaattaaatttgttttgagatgtagaatgtaatacagatcctacgtgtttttaaaagttcacatcaatttcaagcttttaaaaatgtatgtacacaagaaagcttcttttgcaatttatatgtttacaaatgttgccattagctaagctatattttggaatgtgatcaaacaatattgaatgtcaagtcttaacagcagggctggtctaaggaattccctctaagctaaatctgatcctttcatatgtggctactgctcttttaaactactgtatccctaaagggctaaaaggaagaaaatcctaacttaataagtgaaggcagcaaggcatagtatttgaatggctacctttcattttaactctacttcttaaattcaaaattggatttgggtttgtttcaagttgttcacaatttactaacgaaatgtgcatctctcattcttcccccaaaagaaagaagtcatccactccagctacatataagtctccaatttctgtcttacaactaaacgtgaaaaccgaaataccactcattgaaaaaaaaaatgtacagagaattggcaggctgcatgtttatgtgaaccttcagaaaacatggaaacacgcagccccaactcaccaggaaaatcaacacttgtgatcaaactattttgtgacattttatgtcttttatacatttcacttcatatccagtattccagttttgcaccggcttgcctgtatcaaccccaaatcgcctgagagccatctagtactgtagcagaaccgtttcaacatgaagagttctgctcatcgcctgtagcgtggtcttcgaaacacctgaatcaaacattgattcccctccccctgctatttaaaaccgagggacgtcaggcttgggttgtaggtaaagaaaagccacagtaatcaaacaagcaaccaaaatacccgaacacggaacacgctaagaacaaaggaaacacaagagtgtgaacaggaaatgaagcaactctacacccataaataccttctggggccgccaacataggtaaaagtaaaggtggagtctgagtatctgaaatctgaaacagaaagtcctgtcaaaagctacccctggagtggatttgttttaaccccgatcaggacttgggccctccatttggtggagtcaggggaggcctggccgggcgggaggcgagggctagagggcggcgaggtctctccgcgcagcgtcccaggggatgcggcgcgcccccgactgggtgcagcggcaggccgcccccggcagcaagtgccgggtgccatggcaacggcgggaatttcccggtcggggaggccggaagcagccccgccgggctcgcggcagcgaacgcaaaatccgatctctctcccgggggagcaaaatggacgaaaggcgaccccccaggcaggggcgctgggtgccttgggaatccgaggaatcccttctctttgccagtcggaggggactagatggagccgaaggggccggaaatgggccgagcgctgccccccgggggtcctcggcgccgggcgcagcttacgagctcagcgcagcaggctccattcccggccgccgccgctcagcccattacgcaaacctggcgggtccaaccaaccccgctctgccgccgctgctggaacccaggaggcgtgcttgcaggcttcgggcactacgcggggctggaaataccacgcactgccccttcgcctagacccccgctcgggccacgcgggttctgccctcaaagctggtagctgccccagacttgggggtggggggaggggaaggggcgaggctggcaccccctctggcttttggctcccgcgttcgttgcagcagctgttgccaaatgaaccccggaatgcggacgtgcaaaccctccaccccacccccagccacacacgtcgcggtcagagaactgggaagggggcgcggggtccgaggttctggaaaagcaagaactcacctgcaaacaggcagtcctcagctctggacttctggatcacgacgtcgatatccttctgaattcggtcttgccttgaacacatccccattaaataagtccttggaaaagaagcagccgctatttccaccccaaccccctcgcacgctttcagctttcgtaaatattcagttaaaaatgaaacctctggccgaggcaggggctgaaggccaactggtttcggaagtgatcctgggtgagaggaggagaaggaggaggaggaggtggaggtcggctttccatttccagatgtgactgcccagctgctgctcgccgctgctggattccaatttcctccccttctggcgatggattggtgatgacaccgagtctcactttctccttcccccgcccggaccaaccgccgtgggggccgagggtgctggggacggccggagagcgatcaccggctgggcggcgggagtcgacgaggggcgagccccgctccggctcaagcgcgcacacccctcacggcccgcactccggccttccacacccgtgcacactctcgcccgcgggcggcggcagccgtgcccaggctgctgcagcgccacccgcccgccgcggaccctccgcgccctccgcctagtcacccggcccggccacgggccgccggggcttgcagagtgtcagccatcccgggcaggagtcgcgtctccccacaccgacctccactcgcgccgggagctgagcggcagtgtaggtagtgaagactccctggggctcccagccttccctctccgcgctctccccccatcacttttatgaattcgactccactttctaaaggaattatgagtcttgtggcaaacacaaaccggagtggccgggagggggaaaaggggggaaaagaacacctttaaaaattaaaaaaataataaaacgaacaaatctttacttgttgccacctcagataacacggaaaaagccttgaaattaccccagatgtgcaccctccccttccctcagtgcctgagtctttttcctccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaac

SEQ ID NO: 1116 - DNA, 213852 bp, Homo sapiens
  misc_feature (7456)..(57455): n is a, c, g, or t
  misc_feature (95767)..(195766): n is a, c, g, or t
aaagtgctgtgggagtgatcacatttttcacaacagtaaggtaagaatttcagttactgacatccctcagtcctgattaaacctatttgatttcaccagtttttaacccatcatatgtttgagtttcttctccccagtccctgactccacctcttctgccacaaacgtcagcatggtggtatcagccggcccttggtccagcgagaaggcagagatgaacattctagaaatcaacgagaaattgcgcccccagttggcagagaacaaacagcagttcgtaaacctcaaagagatgttttctaactcaactggccggcttcctggccaaccgacagaagaaatacagtaagatctataggctcaccgtcatgaaagtgatgaatgatgtcctgtcttctctctgagacactaaatgctctctccatcaaaaataatttcatccttcctgtacttctaggaaaacagaaatgggtattttaacattttgttaaagttggaagacagaggtaccaaagtatttagcaactttccatgtttgcaatcagatgggggtgggactagagttaaactcacagttattgatttctaacacaggcacagaacgacctgttttctccaagaggctcaatcatgttttcaagaatcctctctgtaccatataagatcctgcagacaaataacatgtagtctgttgttctaaatgtctaggactagtgaacttttattcagttcaagtttctgttgaggcccaacaggcaaagctctgttctagtgactctgaggggaacttggtgatagtacccagtacctgctctgaggggcttcaagaggagtctgctcctaatagaacctgtgctatctataagtgacagcatcaagagcagggagtaggggccgtgcaacatggctcactcctgtaatctcagcactttgggaggctgaggcgggcagagcacgaggtcagcagtttgagactagcctgggcaacatggagaaaccccatctccactaaaaatacaaaaagtagatgggcgtcgtggcgggcaactgtaatcaccactaatcgggaggctgaggcagaagaatcctttgaacccagcaggcagatgttgcagtgagccaagattgcactattgcactccagcatgggtgacagggcaagactcgtcaaaaaacaaacaaaacaaaaagataaataaatcaaaaataaaaataaaaagcagagagtagcttggtgagagtgaagtcctgcttcctggtgcacaggctcttgttcctaaagaggaagaaagatcacacccgagaatgtgtggaagcagcagtgcagtgtgcaaagcagggaccctcagcctgtctcctgggctccatccaagttccttgtcttgtctgtccctcagtttcctcatctgttcagagggtactacaataatacctacctctgtaaattgctgcaatgaattacatgaggcatttcctgtcaatctccttgaacattaattggcacagtgtaaacactatctattagttcttcattctgatgtttctaaattaacacaaactaatcttatgctgtttctaaattaacacaacgaatctaaatcttaatgctgcctctcatactaataaagtatttgggcatatttccttcatggccttattgtcttatgtctcacactttatgcttcagatatgattcttaaaaccatatctgaatattgatttaaaaatgaaatatttttaaagtccttgacatatttgtccttgaaatacccagtaaaagggaaaccatcagtcccatagtcctagggaccttcccgactgtacaagaaatcactacttcatgccccagtgcagtgttttagaggagaggctgcaaggcttgggaaagtggccccgcattcggagtcagacctcaggggctgtgagttctgactccgcttcgttgtggttgaatcatcttgtcaacttccttgacacgcccttgagtttctctttcttcgtctttaaattttggaggatcagatgccagaaagtcaggagactgaagagtaaagatgtggaaatccctgtctagaccctggtactggggagagttttgtccttgggatggacctggctcctgccctgtaggcagtgaccacagcagcatgtccagccttcaactgaggcaggcgtgtctgtcttttctcagagtatgaagagtgtaaagacctcataagatttatgctgaggaatgagcgacagttcaaggaggagaagcttgcagagcagctcaagcaagctgaggagctcaggtgaggggaacccgtagggggaggcaggcgggtaggtgtgtagatctctgaagtacagcagctcggcggggagaagtaagaatgaagctgggccaggggaagggcagaaattgccatggcaggctcatgacacacaaatatttatcagagaacaaggataataataagttctgtgttgcagttgtttcttagagccttgttttctctttttcaaacaagtaattgttgaggtgaaatttacataacacaaaattcaccaaaggagtgggaaccacccagcagcattcagtataatcaaaatggtgtgctatcgccaccccacttacccttagtgagaatcaccttctgactgactgcgtcttctcattctttcactcaatcaatgttgccttcttgaccctgtcattcttttcttctttcatcttttcaattcgccccatctgcacctggcctcatttctgtacatgactttgtatctagtggccgcaagatgcactatgtgtattttcacatggaaatgcccatggccagagtgaggaactgaaaggatgtctttgaaacggaattaggaagacacctacttttgtttacagaagagaaagatgaatggaacatcatcgaggatcttgcaggagccctctctgatacagggaaagcctgtagaccattttctgttctttctcttggccacagacattcctttcaacatgtgctgaccttctgcttgaaggtctccttgtgaacattgtctcagaaatctctgttgcaatatttgaacggatcactcaaccctttctactcttaaattttctctaccgtctcaccttaggcaatataaagtcctggttcactctcaggaacgagagctgacgcagttaaaggagaagttacaggaagggagagatgcctcccgctcattgaatgagcatctccaggccctcctcactctggatgagccggacaagtcccaggggcaggacctccaagaacagctggctgaggggtgtagactggcacagcaccttgtccaaaagctcagcccaggtaaggtggccataggccctgatgacccaaaaccccaggcttatgagaggctccagatctccatactttcacaatgacagttgtatcagtggggtttttttctgctacacctatgtggccatgacatgaccaggacttcctgggtaagaacagagatgggaaacccatggtttggaggtcacagtattgcaagtgtccctccttccttgatggaaggtggtctttggagcaagaggcagcatctatctagttttaaaggacaagaaggaggctgtgatgggagggcgcttgttggagtgaaaagagctctgggctaagaatgaaggttcccaggctgtctttttggcaatgttcttagtaagtgtcggtgagtgagtgatttatctttccagagtttctctctctccatctgcaaaggcagacaaattgtctcttgcaagggtctgaagcatccaaatatgggaacacttacgaatgcttttcaaaatgagatgaagcccctctccatgtggtgttggagaaggcacttgatgtgggggcatttggtggtaggaagtgcttcagactggagcactccccatggatagaatgtccctgaataacacagcagaagccacatggagggcctgtgcagtctcatgacgcatagaggactgtgggacaagtttgtcctctcctaagagaaagaatgaggtttgaaatgcgaactgtgacaggacaccaagcctgttcctgggaatcagatctgtggcaggatgggggagacagctgccaaagtccagagagaggctacacaagcctccagtgatatgggaagcaaaaggtcttttcagtatttggccacatcttgatggtggccctccacatcagaaatgcattgcccgatggaccaggaaaccatgccagggcattttgtgaaagataaaacatgagagttttcagtacaatgctgaaccatacatagatgttcatgtctctgtgcacgttgggctgactgtgcttgcagaatgtgaagtgggaagtatctgaacgaacattttgtatttatagaaaatgacgaagatgaggatgaagatgttcaagttgaggaggatgagaaagtgcagaaatcatctgcccccaggtaacactgaatactcaggagcaagtaatgggtggtaacatatgaaaatgtctaggaggcacaacctctctggcatctatggtggaccaaaagcccgcatccccttggccacagtatgtgaaattgaacccagcttagacacagggtgcggcagctgtcgtgtttctctatgtgtgccaagtgtcatgtctgtaccatacagggatagctgagtcttcatcctcctcagctcctatctgtccagtgcactgaataccagctgctctcttcctctctggctcccatggcagccatggtctgttgcagagagaagaggattgcctgtttcctctttaagggaacctccattttgctttctggaaccactctcttaatgccacctgtcaaaaccagctaggactccctggggtccaatccctctgtgtttaatcttctgtcatctctgtcccacctggctcatcagggaggtgcagaaggctgaagtgagcaaagtccctgaggactcactggaggaatgtgccatcacttgttcaaatagccacggcccttgtgactccaaccagcctcacaagaacatcaaaatcacatttgaggaagacgaagtcaactcaactctggttgtagacagagaatcctctcatgatgaatgtcaggatgctctaaacattctcccaggtagcctctattttccttgtgtctcatacctctgtctaggctatggaagattaattctgaggacaggctgtatatacacatattgttattgttttagtcagaaactaggatggagctaggtgctgtgactcacacatataatcacagcactttggaaggcccaagtgggacgatgacttgagttcaggagttgaagaccagcctggacaatatggtgaaacccatctttacaaagaatacaaaaaattaggcaggcatggtgctgcatgcctatagtcccaactgctcaggagacttaggtgggaggatcggctgagacgatcctcccacgctcgttcactcctctcaggctagactctctctccttttcattggcttgtcttagctattaataagaagtctcggcctggcgcggtggctcacacatgtaatccgagcactttgggaggccggggcgggtggatcacgaggtcaggagatcgagaccatcctggctaacacggtgaaacgccgtctttactaaaaatacaaaaaaaaaaaaaaaaattagctgggcgcggtggtgggcgcctgtagtcccagctactcaggaggctgagacaggagaatggcatgaacccaggaaccggagcttgcagtgagccgagattgtgccactgcactccagcctgggagacagagcgagactccatctcaaaaaaaaaagtaagtctctgaccaggggcgctggctcacatcttaatcccagcactttgggaggctgaggtgggcagaacacctgagatcaggagttcgaaaccagcctgtccaagatggcgaaaccccatctctactaaaaatacaaaaattagctggcatgttacttggcgcttgtaatcccagatgcttggcaggctgagggatgagaatcgcttgaacccgggcggcagaggtggcagtgagctgagattgtgcctctgcactgcagcctgcacgacagagtgagactccgtctcaaacaaaaaacaaaaaaccaaaaaagaaaaaaattaaaaaagcaaaatgaaatcttttgtgctacacagaaacattggccactcatggggtaaaaatctcagggccaagccttgctttatagaaacttataagcaagaaaagtgtagaagtgtttatgtcctggtttcaaggtgactgcatagctgagacaagttgacttaaaggagatcaagactggagatgacaagagtgaaaccagggaaacatcatcttcaaataagtaaacaaggctgccagtgacatccctcagtcctgattaagcctatttgatttcaccagtttttaacccatcatgtgtttgcctttcttctccccagtccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagaaatgttttctaactcaactggccggcttcctggccaaccagcagaacaaatacagtaagatctacaggctcaccatcatgaaagtgatgaatgatatcctgtcttctctctgagacactaaatgctctctccatcaaaaataatttcatccttcctgtacttctaggaaaacagaaatgggtattttaacattttgtcaaagttggaagacagaggtaccaaagtatttagcaactttccatgttttcaatcaggtgggggtgggactagagttaaactgccatttattgatttctgacacaggcacagaatgacctgttttctccaagaggctcaatcgtgttttcaagaatcctctctaccatataagatcctgcagacaaataacatctagtctgttgttctaaatgtctgagactagtgaacttttattcagttcaagtttctgttgaggcccaacagacaaagctctgttctagtgactctgagggaaacttggtgatagtagccagtacctgctctgagggcttaaagaggagtctattcctaatagaacctgtgctgtctataagtgacagcatcaagagcagggagtaggggccgtgcatggtggctcactcctgtaatcccagcactttgggaggctgaggcgggcagatcatgaggtcaggagtttgggaccagcctgggcaacatggagaaaccccatcttcactaaaaatacaaaaagtagatgggcgtggtggcaggtgactgtaatcacccctgctcaggaggctgaggcaagagaatcctttgaacccaggaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaagaatgctgaactaacatgaaaatcaggggctgggaaaatgctggattgagaataatgtgataatgaaggttttatatatattcatatattctcttcaacatacataatgccataaaaaggataaaacgcctaagtctagtcttgacagagcaccagcttaaatcacatgcgcctatcagagaacttataacaatatttagggctaaactgatgttactggtgaaccagtatctggaatgatttccataactcacttaacttgcacatttataatgtggactttaaataataattatcaggatggctactctgaagccaggagcttaggaagtgtcacagatggtatatatttgtattcctgcctcatgtccctttccctgaagtggcgtgtggagtatgagggattacggtgtatttgtaggtggtgtccctgaaaggctatcaggggacttctggttctgcttcagttctgttttgtgaagacggtcaagtgatttaaggtctcttgcttcagccatcccacttagaaagcagttgctttatagtcctttgggtatatacccagtaatgggatggctggctcaaatggtatttctagttctagatccctgaggaatcgccacactgacttccacaatggttgaactagtttacagtcccaccaacagtgtaaaagtgttcctatttctccacatcctctccagaacctgttgtttcctgactttttaatgattgccattctaaccggtgtgagatggtatctcattgtggttttgatttgcatttctctgatggccagtgatgatgagcattttttcatgtgttttttggctgcataaatgtcttcttttgcgaagtatatacccaaaggactataaatcatgctgctataaagacacatgcacacgtatgtttattgcggcactattcacaatagcaaagacttggaaccaacccaaatgtccaacaatgatagactggattaagaaaatgtggcacatataccccgtggaatactatgcagccataaaaaatgatgagttcatgtcctttgtagggacgtggatgaaattggaaatcattctcagtaaactatcgcaagaacaaaaaaccaaacaccacatattctcactcataggtgggaattgaacaatgagatcacatggacacaggaaggggaacatcacactctggggacggttgtggggtggggagaggggggagggatagcattgggagatatacctaatgctagatgatgagttagtgggtgcaacgcaccagcatggcacatgtatacatatgtaactaacctgcacaatgtgcacatgtaccctaaaacttaaagtataataataaaagaaaaaaaagaaaaaataaataaacttattgatcatctatgtgctaggcatattctctgtttgtatatattggaacatgaaccttccaggtccttgaaaatgtggtgggtactaaatgaaatgtttccagttgtgattcttttttttttgagacggagtcttgctctgttgccagactggagtgcagtggcacaatcttggctcactgcaacctccacctccctggttcaagcgattctcctgcctcagcctcccgagtagctgggactacaggcatgcgccaccatgcccaaccaatttttgtatttttagttgagatggggtttcaccatgttggccaggatggtcttaatctcgttatccgcccgcctcggcctcccaaagtgctaggattacaggtgtgagccatgactcccaggagaaataactttaaaaacttaaaaacattgggctgggtatggtggctcatgcctgtaatccctgtaatcccagcactttgggaggctgaggcaggcggatcacctgaggtcaggagtttgagatcagcctgaccaacatagtgaaaccctgtctctactaaaaatacaaaaattagctgggcgtggtggtgcacgcctgtaatcccagctactcgggaggctgaggcaggaaaatcggttgaacccaggaggcagaggttgcagtgagccgagatcttgccactgtactccaccctgggcaacagagcgagactccatctcaaaacaaaaacaaaaacagaaacaaaaaattaaaaacattatacaaatgtaaactgcaatgatgacaagaaagaagaatgtggactccatatgaaattccctcttggtatctgcactagaacatctctacttttcttaagcctcaaactttgctcatctctttgacccttagtctctacagaggatctgttctcctactctccaaaattgttcaaggtcatctgatgagtggcctcaatttattttcagatgtgcatgtgctttacttggggttttgttttgttttggtttttagttcagttttttttattggggttcaaatatgagacagtcttggggaacctagtagggaaaatctgaaagcaaatacagtgccatactgagaattgtacaatatgtgtgtgtgtatatatatatatatatataaaagaaacaatacagaaacttcattctgctatcacaaagccttcaaagaaatgacgattgatgccttagtgaggttcactagaagggaaaaagttggcagatgtttcccacagaaggaaaagcatgagcaaaattctggagacttgccatagcttcttatgcttctggaggcagtatggcttcagggtttggatgtcagcaatccctgaaaccatgtttcacaagtctccagatgccaattttttcattaataaagtataataattcatatctcatggggctgttaaacaagaacataaagtactcagctgtatggtaagagctcaacaaagcttagccatcattattattactagcctggcatgaatgaagttaaggaatggtggtgggtgatgagtgtgggagaaatcagaggttacatcataaaaggctttgatggccacattaggagtatggatcttatctcctaaaggtattgcaaagcttcttaaatggctctgccatggtgcgattaaatttatgtcttggaaaggtcacattggtcatggtatgcacatgtggtttttgcctattcagttaaaagctccttaaagctttttatgccaccacagtcttatgcacctaagaggctacattatttgccaatttgttgttgttgaattatctatttcagaactactctgaattattaggttgagattgaatgagaggagcaggactggaagtggagaggacatttagaaagtttcctcggtaatccagacagtagatggtggtgacctcaacaattgcccagttaccttcaggacaaagtccaagttccttataatggtatacaaagctggcacaatcagacacctattctcaaaacagcttacctctcacttgtcttctcacttgctccagttatgtacaattatttaaagttcttgaaatactcctttccctgtgtcttccctccatagtttctccttctgcatagaatatttcctttccctatccactttctacctatttattctacctcctattcatccttcaaagctcagctcagatttcacttcctctaggaaaccttcaatggcattatcttagtctttttgggctgctataacaaaacaccataaactgggtggcttataaacaacggaaatgtatttctcacagttttggaggctgggaagtcctagatcaaatcactgacaggttcaatgtctggtgaaggttcacactctggctcataacggtgcattcccactatatcctcacatggtagaaggggctaactagctctctggggtctcttttacaagcgtattaatcccatttatgagggctccatctccaatgtctatgatttaatcacctcctaatggctccacctcataatacttctggaggcagaagtattaaccttaagggttaagatttcaacatataaactggtgggggagggaggtggggatgggacacaaacattcagaccacagcagacaacttgctcttttaatgtggaatggatgaccctccaatatttccccagagcaccccatgctcttctatcagggaacttattaaaatcatgtaacatgtttcttggtgacaagatttaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatgattaccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcagcgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaacggggttatttgtttttcattgttcaattgttaaattccttatggattctggatattagacccttttcagatgctagttgcaaatttttttagattctagaggttgtctgtttactctgttgatagtttcttttgctgtgcaaaactctttagtttaaataaatccgacttgtctctttttgtttttgttgcaattgcttttgaggatttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgataggaatagtgttgaatctgtagattactttgggcagtatggccattttaatgatattgattcttccaatccatgagcatggaatgtttttccatttgtttgtgtcatttatgatttcttttagcagtgtttcatagttctccttgtagagatctttcacctccttggttagatgtattccagggtattttttttttagcggctattgtaaatgggattgcattcttgatttggctctcagcttgaatgttattggtgtgtagaaatgctactgatttatttattttttttttttgagacggagtctgcctctgtcgcccaggctggagtgcagtgatatgatctcggctcactgcaagctccgcctctcgggttcacgccattttcctgcctcagcctcccaagtagctgggactacaggcgactgccaccacacccggctaattttttttttttgtatttttagtagagacggggttcaccgtgttagccaggatggtctcgatctcctgacctcgtgatccacccacctcggcctcccaaagtgctgggattacaggcgtgagccaccgtgcctggtgaaatgctactgatttttgtacattaatttttgtattctgaaactttattgaagtctgaaaatatttttaataattttagtaatacttgtcatttaacactaagcttttaaaaaactgtaaattacaaaagtaaccattttagcaatataaatatatataaagaaaaatatcaagtcttatccctatcatggactgtgatctcactcttcctcaatatactataattatcactcagcaacttttcccccttactttaatcaaggaattcccactaggacaataatatagagctaacttattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctagggattgtttgatcaaaggaaatcctccttttttactataataggtagcatcacatactaaaaatgttgtcacaatttacactcactggtagtgtatgagagtgcccattttccccaaacgttatctcagctcttgatgttattataggctgactgatactttttgataaagcttatttgcatttgtctctactaaaagtggaaacattcactgtttcaatttagttgattgctgactaataggaagtttgcaatcttaggtctggtggatttaccaacttatgacaaggtccatctgacctagtaatagagagagagcccaagggaaacacagcatatgaaaatctattgtttcagttcctgaatcagacacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcagtgttctgaaaaacacacaggcattaatcgttattaactgccacagacactctttcctggatccaggttcctatttgagtcttgccttggtccacagcctctcacttcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcccgaaaacgaaattgctagaataatacttttaatagaattatagtaatagaacaatacttttaaatgcctggggattcaattatttaaagaaatttggttgtaaacatttttaaaaacaatgcttttatcataaaattggaattttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtccggtgcaggttaagtggcttagtgtgtggtaaggagtatagaaaatagtttgcaactagtttgtgaaaatcctgctaagacaactagataggccggccacggtggctcacacctatagtcccagcactttgggaggccaaggcaggcagatcacttgaggtcaggctttcgagaccagcctaaccaacatggtgaaacctcatctctgctaaaaatacaaaaattagctgggcgtggtgacatgcgcctgtaatcccagctacttgggaggctgaaacaggagaatcgcttgaacccaggaggtggaggttgcagtcagccaagatcatgctgctgcactccagcctgggtgacagagagagactctgtctcaaaataaaaaaaattaaaaaagtaaaaaactggataataatcagtagaaatcaaagacttatcagggagctttaagcaaagcattggcatgatcgggtccatgttgaagaaggaattatgaagaaggtgggtgggtcaggggcaactaaccagaatagggagggggactgtctaaggacaagaggtacagggagaaagactcaaaagacatttcagagacagaagccacaggccttgatgacttgtgagattcagattagactggagggaggaccaaagacaatgctgaaatttccagcatgtcagtgggaatgcattctattaactaaaataggggcaggtttgtaggggaacctaaggaggtttctgcaaaatgttaattgagggattactttatttcagcttaaacgttagcatgcaaagatggattagtcccttccctgatgaagtccataatacagtattaggcaagaagaatgttatttagtaaagaagtctttagatcagaggttgacagagagactgaaggtaaagtagctaaagtatgaaaagtagtattgtgggtactagaacagtagggaggattttactttactatcgccatataataaccaccaacacctagacttctagaagtccaaggcaacacacaatagcagcatattttctaccatacttgtgaaggcatttcataacccatgtttccatgcagggtggttgaaacacaaatactaattgggaaaagtagaaacctggtttagatatttgagagttacttagaattaaagaattttagagctggaaggcagttggactcaaggcattttagatcatattactagtacgtttttagtgacatactgagaagaatgtttgttcccctcataagtaggtaccttttgaccaaggttagaacatagattcagatccagtgagatgaaaatgtcctaatttcttcaaaagaagggaatgatagccctgtcttttcaggatatcctttaaagttattattttatgaacactaaatagcattaccagatttagcaaataaaaatataagatatctacttcaatttaaatttcagataaacaacaaataatttgtttcattagaagtatatcctttgtaatatttgagacataacttaaacgctaaaacattgtttgttgtttatctgaaatttaaattgaattgagtaccctgtattttattctgcaatacaaataccaaaagattaacaaatggaaacacgcatatttcaattttgtatgaagaacaagtctaagatctctatatcagttccatggcctggcactgcaagaataattcatctgtaccaattgatgaatcagtaaaatagaagatttgctaaacagttgctatgtccccagctttgtggtcaatacttaaaggaattcaaatgtcttcataaaaaatggtccctaagctactggcccttcatagaggtgaaggaatatgcattcaattatgtgggaaatgcaaagagggagcaatttcctaatctgtaataggcagataattgtattttcctcattcataaacctacctgagaggatcgtgaggcataaataaatcaatacatgtaaaggacttaggacagtgtttctaacacaggtataactataattttaattataataatattattatcaccatcatcatcaagaacaacagcattatcatttggaacagcagtttgctttccatgagaccataatgtttcaagtggattcagtgttcaggatatggtgctgagaaagaggactcctaagtttattattatttctgccaccaattgattcacttctgtgaccttgggtaaaattctgctaaggcttctccacctggaaaatgacaaagactgggcaaaaagctatttaaatctcatatgaaagaaaatggaatctataattatgaagtgttattatcaatgatattcctatgcctggctaatttatataaatcagaaaagtctggatatgctaaaccacctcagataagccaaaactgcttgagcagattttttaaaaatctcatatctaaaaatacgtgaggtctcaaatgactggagctatatggatgtcctctgcctagttcttagtctcatgatgtgacatagggaatctctatgaggtataaactgatcaacagaaagttccctgaaaagtcccttactattaatactatttttgcatgaggaatctttgaatattcaaataaaaataaacaaacaacagggaaagtgagaggcactatgaaaccaacctaaagccagaaagaattaggttcaaatcctggctctatcactttcctgctaggtgaccttgggcaggttaactaatcactatgagcctcagttttcttataagtatagtgtggttgctttgctttttaatgaagataagtattcacgagggattctgtgaggattgaatgagacaatgtgcatgataagcatagaacaatgccttgcacacagctgtgcaacaaccttgattcactttcccttcatgtccaggctaactagtgccagtcagagacctcagccttaccaggaaaaatacttagatctaaaaggaagaaaaacagaggacataaattagtacgttctatctgttctaaatcctactgaagaaaatgaagtcaatgctttgaccaatttgcccaaagattcacagatttgaagacctcagcatttctgtgttctagttctcttagtttaaagacaaggaaattgaaatccagaagggttacctccaaggtaaaagccgtaactgaaaccaacactccactcttgctttagccttttatcagagagaccagcttagcaaacactgcccagttttgtctgattttgtagaatgtggtaaattatagaattagagaatgtgctgcatttagtcttgaaagaatatatggaggcagtaagtatagtggtcaagagcataggctctgaaggcgagaagggggcttgacaagtcacctgccctctctaagagcctcattcacctcatctatcaaggagataacaatgataccaatctacaaaggatgttagggagactaaatgaaattatgcacaaaaatcacatcgcacagtgcctggcatgcagtcagtattcagaaaatgataactattattaactataaaaacaataacaatttaccctctctaactaggatagctgaaatccagaagggttttcaaggttaaaagcaataatcttacatcaaagtctaacctttttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgtccaaaaagcatttaatatgtgatgcaggtccagctaaagaagaaaaaggaaagaaagaaaaaaccttttaacgatttttaactgtacagcgattaaattatacacaactggcctgataatagagtctattcaaaatttgacctcaatctacctctccagctttatcttccattattatctgctagcctaactggatttcccaaacatgccctatgcttcttggtgccacatcattgtgtgcccttcagcttcatggttaaatgctacgtcccctgtgaagccttactttatctctccaaattaaaagtaatttctcatgatgacattatgagctttcaaatattcttttcatactgcaacattggcatcctgtgtaaatgcttcatatttctacacctgtcttatttacccttttaaattgcaaactccctaaggacagaggaaatgatggtgtggcagaactacccaggtgcgctggttattaagatactgcctctcagcgttgtcatgctggggcaggaatttcaggataagtaaacctaggttcacatacctttctgccacttcctaactgggggaccttttttgtgtaaattactgcaacttttacaacctaatttcctcatttataaaataggggttgcaaaaattacctcaaagtttgtagtgaggaataaatgaatttatgtaaagtacccagcacaatgtctgatacaaataaccgcagctcgggcgcggtggctcacgcctgtaatcccagcacttcgggaggccgaggcgggcggatcacgaggtcgggagatcgagaccatcctgcctaacacggtgaaaccccgtctctactaaaaatacaaaaaaaattagccgagcgtggtggcaggtgcctgtagttccagctactcggaggctgaggcaggagaatggcgtgaacccgggaggcggagcttgcagtgagccgagatcgcgccactgcactccagcctgggcgacagagtaagactccgtctcaaaaacaacaacaacaaaaacaaataaccggcagctgtgactaatctgaggtcctcgcagtgtctctcacctcttggtgcagtaaaagcattgaaagagtgaaccaacaagagaacaaagaaggaatagttgacaagaggcggaagtggactaacaatgatatgtttgttgaatgagtgagaaggtaatagataatgctgtgagattatgtggaaaactttttatctgaagtctttaaaagacattctcacttttggctgggcgcgggggctcacacctgtaattccagcactttgggaggctgaggtgggcggatcacttgaggtcaggagttccagaccagcctggacaaactggtgaaacgctgtctctactaaaaatacaaaaattagccaggcgtggtggtgggtgcctgtaatcccagctactcgggaggctaaggcaggataatcgcttgaacccaggaggcagaggttgcagtgggccgagattgtgccactgtactccagccggggtgacagagcgaaactccatctcgaaaaaataaaaaatgtactccagctggggtgacagagagaaactccacctcaaaaaaataaaaaataagggctgggcacggtggctcacgcctgtaatctcagcactttgggaggctgaggcaggcggatcacaaggtcaggaaatgagaccatcctggctaacacggtgaaaccccgtctctactaaaaatacaaaaaattagccgggtgtggtggcgggcacctgtagtcccagctactcgggaggctgaggcaggagaacggtgtgaacccaggagtcggagcttgcaatgcgctgagatcgcgccactgcactccagcccgggtgacagagcgagactccatctcaaataagtagataaataaagactttctcaggtttttgttttgtttttgtttttttgacagtcttgctctgtcgcccaggctggagtacagtggcgcaatctcggctcactgcaagctctgcctcctgggttcatgccattctcctgcctcagtctccgagtagctgggactacaggcgcctgccaccacgcccggataatttttttgtattttttgtagagacagggtttcaccgtgttaggcaggatggtctcgatctcctgacctcgtgatccgcccgcctcggcctcccaaagtgttgggattacaggcgtgagccaccgcgcctggctgactttttcagttttaagctaagaatattctctaataggtatattattgacccattgacaatagaagattgaatacactttaggattccagcctcctcttctactgctcatgctctccgtaagaagggctaaacatcctactcctgtgcactacattggagctcagaaatactgacttaaaatctccagatcttaacacggacttttaaagggaagattgagtatggacccagtattagatggtattatggaattatttttaagctttttgggtacaataatagtattgtggttatgtttaaaaacaaagccttctctgtgagagttatattctgatatcttcccaaataaaattatatgatgtcagagagttgctgtaaggggtggaagaggacaagatggagaacgaacagtgcagggagatcactgaaaagaacagcaaaatgttgggaaccgttaaagctgagtgatgggaacatggctccctggtaaatgggacacatacatcgggaggtactattttcgtagtctttgtttatatttgaaaattttcaaacttacataatgagaagtcaaaaggggcattttcatcccaaaaaggcaaatgtccatattcttttttattttttcattttcatttctggaattacctaaactcaggttatagatagcaatgaaaattcggctccctgtggcagcttctttcagccaccagacttacatagactcagtggtgcagagtccgtttcccaatactgagggataaagaaaattaaacctgcctctaggcacgtctcaaacttgggagactcagaatacaacagagtatgggatatagggaggaaagaagagatgcagaaataaattaaaaacaagatttgtttaaagaggaactgcaacttctttaattgggcagattgaaccaataaaagcacagttctctcccttcacctcttatcctttagtctcttcaactttcacattgcttcactcactctcttcctctccctttcacctgctcaccttagccaacttgaactgtgccctctgatctgacacaggatgacaatgacatcagtcattacccagcagccattttttctgataactagagttctgagtgatgatagttcatggtgagataatttccaagacctcgctagccattggtggtactactctccattaaagacaagggcatttgctgattgagaaatcaatcatacaagtgtccttggaggccaccaaggctttgcctgaactgttctcagcctatgatggtttctctttctaaacctgttcttctaggttcagctcaaacatcctctcctatagaaacctttccccaacctcccagtcagaactaataatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttacctctagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcaagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccgtctcaaaaaaataaataaataaataaaaacaaaaaagaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaatcagagttgtgttaaggtcagtgagtgaaggaaatgggtactgcacctttgcaagatagtaggaagcaagccagagaagagctggcattccacaaaagagtctttatttgggacaaaaatcaatatgaccaaatcccatcctaatcaattctgtaaactaaaggaatttttaaaaaataatttagcaggaggaagagtttcaaaatcttgtagggaaaccctgatgtaactcctgattattcacccaaagtgaaaagtaactattagtgaatgggttttattttaaaacgtttcatttttagaatcttatctcttctaggaaaagtgtagtacatacatcttttttgtatgcagagtgaatttcttctccaggcttctctgacatcaatggggcaaggtcataactctataaaacagggagaagcactgagcattttcagaaaggactctatctgtcttgaccaaaagacaaaggactggtcattgcaggatccccagaaatacattttagtagcttccaagtgaattcttttgtaaatggagtttcactccattcataagttttagagcaaaaatgaagccttagtgggtctagatatctggctaacattaactccctgtgtgaccttaaactggtcgtccccagagctttatgcttttatacaattaacttgaattacagcctctccttcttgcccataagaatgataataccacctgcattactcatcttttacgcttatgtgagacacctagccacctatcagaaggtattcaaatgcaaagcattaagtttttacactttaatgtgaagtggaagaaagtcttgattcaaatgcacaatctctacctttctactgattccacatttgctgtcttttactagtgcagttaagtcccaaattagaaacataagtcgccccaacatgtgacaaatgtcctttgttgccagagaaaggacagtggggctgtgtcctcagccttagcaaccagaagattctgcaagaccaggacattctcctgccagagcctgctttagtgtccagtcctgttctccaaagagatggaaaaaaccaagtggaaaagtttcagtttattcaatataaggctccacattcaaatggcaaaactgctctgttcaggtcatatttcaagcccaacctatgtcagtccttagtaaaagcttcaaagcaataccagtcctttcccagcctggtttaccttgattagacaaacacagacacccatgtctgagtaagcactgagaccatggatgagtgctaaggagattaggtgtttggatagacacagctagggtgtgtgtatgtgtgtgtgtgtgtgtgtgtgtgtgtgtgtgtgtgtgtgtgtagagagagagagagagacagaggcaaagacagagacagtgctcattgggcagaggacagagtagctgagatagtatcatttgtttattcatttgctttttcataaaatacttagtaagcacctacttggtatgtgccgacactttaataggtactagaaagagcaagacagacagaatcacagtcttcagagaatttacagcctatggggttaattaaaccaatgattatcatagcatgtaacaaacaaaagagaacccagaatcagctgtatggaaatgcacacaggtggcagatataaatagcagcagatacacgaatcagtgcgggtccatcatataactcctagctttagtctctaaacttaggctcccactcaactcaactcctactctaactcaagatataccataccttggtttgctctttctctaagcatcgctgttctagtcttctaaggaacaggaatataaatctacatctatgtgaaactacagcacccccaagggaaaataaagaatccagtgctattctagtaattttagggtatagtacagtacaatgcaaagtataggcttttgaactaaattggcctgggttcaaatatgagccctcttacattctattaggttgaaccatataaaaatggagatattcaatcatttttttacagtttcacgtagttcatctctgtattctagaggtaaatcattttaacctaagtttcatttccttctgttgttagtttttttaatggtgctaatacccctacctttcagggttgtaaatgaaaagatgttaaaaaaaaaaatacctgacatatagtgggtgttcaataaatgttagttttcccaaagacagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgagaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatcttggtcgtgtcccagaggcctctgttgatgtggcccaactgagctggcaagtgagaaaacatacacataaatacccatgatctcagcgattctctcccctccccaggacattccttagcagaaccaatctctctcactcggctggagcctctctgttcacagataggcctggctgggcttaatttagcaaagggcaggccccctgcaaaagccaggggtaagtctggagcccctgtaatgccccaggacaccttgtgtggagacaggagcccagccctgccgaaggagctaaaggggatgttcagaatgtttgtttttctcagctatttaggaactggagctcacgggaaccaccctttacttccttaacttctcacataaatgttttctttgggcagcagctatagaactggaaactaagtaaaaccttactttggaatataaaaactatattaatttttctacagataaattgttgcataggaaacttgctaaatatttttaaattatctgtaacacctaacataatctgacatttatccccaaattcagctttcaattctggattgaaacatactttgatctgttctctaaaaaggacaaagccagtcactggtgttttgcaaagtctgggaccatttttcctacacagaatctcacacaataaacagacaagatattagaaactaagttctaatatctagcagtcactccttccctggaagcctggctgtgtcctgaagccaggtcctatgatcaggcaactcttctgaagctctgcttccactagggacagcacttaccctgtagactctacagatgtaccatccaggatggcaggcatgagccacatgtggctactgaacccttgagatgtgactagtccaaatcgaaatgtgctgtaaggatttcagacttagcacgcacaggagttcaaagactaactacaacaaaagaatgtgacatctcattaataattttaaaatgttgatttcatgttgaaatgataatgttttaaatgtattattaacattaatttcacatatttctttttactttttttaatgtggccatgagaaaaatttaaattacatgtatggcttatatttacgttggacagcactgttctataagatgttaggaaaaagatgtatttgctttaagtactttgcattaagacatagtctgacctgaatcacagttaatcctgtggtctcatagcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccattgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacgaggtcaggagttcaagaccagcttggtcaacatggtgaaaccccgtctctactaaagatacaaaaaaattagccaggtgtggtggtgtgtgcctgtaatcccagctacttgggaggctgaggcaggagaatcgcttgaacccaggaggcagaggttgtagtgagcggagattgcaccactgcactccagcctgggcaacagggacatactccgtctcaaacaaacaaacaaacaaaaaaaccagaagaaagcactggcagtctcttaccgccatatcaatccatctacacatctcgggttacattctctgtctttccacttataaccatagatcaactatccatgctcctatctaaagccaaaccttccacttatgtattaattaagtcctattccccctacctctcaaaggcaacacctagaaggtctcccctgcttctctttatcaatatttcactttctaatggaaaattatgttggcatacgaacatgctattattcatttatctttctagaaatcccctatggacctcatacccttatcaggtatgccccattcctttgctctcctttgaaacaaaactcaaagtaattattcatcctcattgactccaattcttctcctcacattgtttcttaaacccactgcaagcaggcttttgtcttcaccactccaccagaattactttaatcaagatcactaatgacatccatgttgttaaatccaaaggtcaattcttttttgagacagagtcttgctctgttgcccaggctggagtgcagtggtgcaatctcggctcactgcaacctccgcctcctgggttcaagtgattctcttgcctcagcctcctgagtagctgggattacaggcatgcgccaccatgtccagctaattttcgtattttcagtagagaccaggtttcaccatgttggtcaggctggtctcaaactcctgacctcaagtgattggcccaccttggcctcccaaagtgctgggattacaggcgtgagccaccacgtctggcgggccaaaggtcaattcttaatcatcgtattactcaagctctcagcaggatttcaaaaggtggatcctgtcctcttcactacacacattcttcatttggcttccgggactccagactttttctcctacttcactggtttgtaccttctctatcttccttttctgattcttcctcttttctccaaattactaatgttggagctatacaggaccagtctctggtccttttctcttccacctggaaaggtctaactccaactcctttggtgatctcctatggtttcatggctttaaatatttaaatttaatatttaatgatctatttgctgataactcccaaatttatgtctctagccctactctatttcctgaactttagacttatgtattcaactgcttacttaatgctgccacataaaatgtctagcaaatagcttacacaccaaatttccaaaactgaacccctactctccaccttcaaatctgctccatccatagccttccctatctcagttatggcaactccatccttccagttgcttactccaaaaaccctggaattttccttgattcctttatttctctcccattctgtatccaatccattgacaaaatccttttagatttgctaccttcaccacttgttcccacatgcatcactattacctaagtctgatcactatcagcccctacatacattactgcagtgtcttcctaagagtcctcctggtgtctacttttgttctacagcctatttgcaatactgtaaccagatttatcatttcaacaagtcagacaggactggcatttgttagacccctcctctgctcaaaacccttcaataggttcccatgtcactctgagtaaaagctgaagtctttaaaatcatctacagggacttactacacaagccccataccctctggggcctcatcttccagcatgcttaatcttgattatgctgcatcagccacagtggctttcctgatgtttctctgcctggaatattcttcccccagttctctgtttggccaacttcgtcatctccttcaagttgctatttgaaaattattttctatggcatagccactttgaaaaatagttagacagtatctattcagaaaataggcagaaataccgactgggcatccctaatctaaaaattcaaaatccagcatgttccaaaatccaaaactttttgaggaccaacatgatacctcaggtggaaagctccatgcctgacctcatgaaaggttgcagcaaaaatgcaggcacaacacccagtttattcagcatccccaagagaaaaacataattaccttcaggctatgtgtacaaggtgtatatgaaacataaataaatttcatgtttagacttgggtcccagccccaagatatctcattatgtatatgcaaatatttcaaaatctgaacacatctgaaaatcttctggttcaagcatttcagataagagatatttaatctatatatacttattatataacctaacagttccactactgggcatttacccaaaagaaataaaacaaagacttgttacatgaatattcatagcagcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttgaaacatgtggcaccagtaggacatatggaaacttttttggtgtgatggaagtatttttttatcttgattgtgtggtgtttgttatacagtggtatacatttgttaaaatttatctaactgcatacttaataaagtttatttaaacaaaacatgaaaggaaaaactaaaatgacatagcaagtggcaatgcaaactgccaagtgcaaagaatgagtaaagagcttggttggcatggagactaccagtctaggatgctttcattgcctcaggtcagcttggaaggccataaaggctgtgaaggtaaacctagaaacaaatcttcctgcactggtaactgtcatgtttatttgcttccctttccatcccatcctttcaaaaaaaaaaaagtaaaaggtagtgtggtccacaaactacagtgtggctccccatgatccccgcctcttggtgtttgtgcccttgtgtaactccttctctttgggtatgagcaggccctgcgacttacttctaaccaatagaatatggcaaaggtgaaagaatgtcactcctgtgattatattaaatttcaaggctctcttgcttgcagatttgctctagagcctctccttgctgacttgaagtggccatatggggaaagctcacatggcaaggaacactaggtgacttcaaggaaccctggacagcctctagccaacctctggcaagaagtcaaggccctcagtcctactgctacaaagaaatggattctgttgacagcccaagtgagctctgagtcagattcctcagtcaagcctctagaggagaatgcagcctggccaataccttggctgtagcctagggagaccctaagcagacaacccagctaagcggtgcctggattcctgacccacacacactgtgagataataaatgtgttggggggtgaaggagggataggggtaggggtggctgtgcatttgggtatggaagggtgttttaaatcactttctaaacacggcctctcctggccactccttaatactgcaacctgctctccactcctgtaatttttttctcaacatttgttttaggttcagggggtacatgtgcaggtttgttacatgggtaacttgcatgttgcggaggtttggtgtatgaatgaacccatcacgcaggtagtaagtatagtacccaatagttagcttttcaaccctctccccccttctaccttccactggggtaggccccagtgcttattgttcccatctttgtgtccatgtctcaaagttttgctctcacttataagtgagaacatgcagtatttggttttctgtgcctgtgttaattagcttaggataatggcctccagctgcatctcttttgctgcagaagacatgatttcattcttttaatggatgcatagtattccgtgctttatatgtaccgtatttttcctccccagtctactgttgatgtgtatctaggttgattccatgcctttgctattgtggatagtgctgcagtgaacatgtaagtgcatgtgtctttttggtagaacaatttattttcctttgggtatatatccagtaatgggattgctgggtcaaatggtagttctcttttaaattctttgagaaatcaccaaactgctttccgcagtgactgaactaatttacattctcaccaacagcgtataagcacttttctctacaaccttgccaacaccttattttttgtttttcacagtaggcattctgactggtgtgcaatggtgtctcattgtggttttgacttgcatttctctaatgattagtgatattgagcatgagaattttttcaaatatttgttggccccatgtatgtcttccgttcatgtcctttgcccattttttagttgggacaaggtctcgatctgttgcccaggagtgcagtctgatcactggagttcagtgatgcaaacacagctcactgcagccttgacctcctaggctctagcaatccttccaccactgcctcccaaagtgctggagtttcagatttgagccaccacacctttgctcatttttgaagtggggcaagacccccacttcgtaggactattacttgattgagattaaatatgtgtaaaatgcataacatggtgcctggcttatagtaaacactaaatggatttcttcttccataggatttaaatagggagcaattttttttctatcaagagctgatcagaaataaatgggaagcatttaaatgctctccttccgttgccccaagaggactttcactttccaacattctacatactttatgtataatatttattgtttattttctgtctactcatgacagactataagttctatgaggatgggaatgcctgtatgtgcttattatatgacctaacagttccactactgggtatttacccaaaagaaataaaacaaagacttatacatgaatatattgatatatactccagtcacctccaatagaatctagaacacagtaggggcttagtacatatttttaaatgaatgaagactaatgtttagtttaaactaggattgacctattcttatcctcggcagggacagagaataactaattaccacttgtcacatattgagacttcagtacctaaaaggcactattaggtcacctgtaagtctgttttcccccaaagtaaaaatcccaattccattgcccttttcacataagcctcattttctaacctttttagtttggtttaacgaatttcctatttcctctgaattctagagttccaaaccagactcagcacaagcctaacagggcaacctatacagataaggacagcccaggcacattgcacacggcaagttgcacctgttttaagagtaaaaatgaggtcaatgccaccttgtactgcaggtacctcaatgagacaatgccaccccttcctgccacaatcttggcaaaagtcactacgaaagtaaatatcattttactagagtcctttctttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaagatgcataacatggtgcctggcacacagtaaacacaaaacagatttcttcctctatagcatttaaatgggaagtgtttagcgtttacttgccatgtgcatgagtgaatttgggaaaagtggggggaggatatggggcaaagaaggacagaaagggcctaagagtaggaagaatttaataccagaagatgggacaagacctgggtctagaaacctcttctgcagataaagtagctgcaaattatagggaaggagtcctcaggctgctttccttataaccatttattttcctgcaccttacatcaagaacgttaggcactggttaagaccctgtccccttgcagcagtagagaaaacaggaggaaggagacgggaggtagaaatttggaagctagcagttgaaggccaactcagaaagcgtcaggtggaattccattcctaattgacatcaccatcctctaactgcagcaattctctccagcccttttatgtgctccctacagaaccaagcttccacacagctgaaggaacctgtctgctctcaccccagcttcacagaagatggcagggactggttattactaacctgcctcctagtcttctgaggctccaaatggttttgtcagcaagctgagcttccccacaatcccacagactagaaggggttggaaagaacaagccttagtacaatactgctccccacctctaagggatctgctcctctgagtcccagaagttcaccaccttcatttgatttctgctacaggaagactctgggaatccagctctggacccagcacttcctgatttttgaagtagagagttgacaaccctgttgtcatcaatacaactgtgctaggtgggtgggaaaggaaaatatcttgggctcccaaaatcactaagctaaaaggaaaactcaggatcatgctggatggaagtcaggactagattgcagctccgactcggatggacagagaagcatgtggaggctcgtatcatgaatttttgctccagaacgactggaggaataaattacaaaacctcagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagcttgaacacaaagtcttcaatttgacccaatccaacaaagacaaagaaaaacaaataagaaaatatgaacaaagcctccaaaaactctgggattatgttaaatgaccaaacctaagaataattggcattgctgaggaagaagagaaatctaaaagtttgaaaaacatatttgggggaataattgaggaaaatttccccaaccttgctagagacctaaacaaatacaagaagcacaaagaacacctgggaaatttattgcaaagagatcgtcacctaggcacattgtcatcaggttatctaaagttaagacaaaagaaagaatcttaagagctgtgagacaaaagaacccagtaacctatgaaggaaaacctgtcagattaacagcagatttctcagcaggaatcctacaagccagaagggattgggcccctatcttcagcatcctaaaacaaaacaattattagctgagaattttgtatccagtgaaactaagcttcatatacgaagagaagatacagtatttttcagacaaacaaatgctgagagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacggaattgcagaatggataagaattaaccgaccaactatctgctgcctttaagagactcacctaacacataagagacttatctgacacataaggactcacataaacttaaggtaaaggggtggaaaaagacatttcatgcaaatggacaccaaaagcaaaagcaagcagaagtaactattgtttttttggtttttttgagatggagtttcactcttgtagtccaggctggagtgcaatggcgcgatcttggctcactgcaacctccacctcccaggttcaagcaattctcctgtgtcagcttcccaagtagctggaactacaggtgtgcaccaccatgcccagctaatttttgtatttttagtacagataggtttagtacaggcaggggtgatctgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaagccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaagacatatatacagaacattccatccaacaactgcagaatatacattctattcaacagtgcctggaactttctccaagatagaccacatggtaggccacaaaacaagccgcaataaatttaagaaaattgaaattatatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaaggaaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccgggcgtggtggctcacgcctgtaatcccagcactttgggaggccaaggtgggtggatcacaaggtcaggagatcaagaccattctggctaacatggtgaagccccgtctctactaaaaatacaaaaaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttataggtgggaattgaacaatgagaacacatggacacaggagggggaacatcacactctagggactgttgtggggtggggggaggggggagggatagcattaggagatatacctaatgctaaatgacgagttaatgggtgcagcacaccagcatggcacatgtatacatatgtagctaacctgcacgttgtgcacatgtaccctaaaacttaaagtataataataataaaataaaataaataaaaaataaaaaataaaaataaaaatacaaaaaattagccggacgccatggtgggcacctgtagtcccagctactccggaggctgaggcaggagaatggcatgaacccgggaggcggagcttgtagtgagccgagatcgcaccactgcactccagcctaggcgacagagcaagactccatctcaaaaaaaaaaaaaaaaaaaaaaaaaaaacctagaagagatggataaattcctggaaagatacaaccctcctagcttaaatcaggaagaattagatactctgaacagaccaataacaagcaacaagattgaaatggtaatgtaaacattaccaacaaaaaaagtccaggaccggatggattcacagcagaatgtaaccaggcattcaaagaattggtaccaatcctattgacactatttcataggattgagaaagagggaaccctccctaaatcattctatgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccgtgatcaagtgggtttcataccagggatgcagggaggtttaacatacgcaagtcaataaatgtggtacaccacataaacaaaattaaaaacaaaaatcaccatgatcatctcaatagatgcagaataagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactcataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacatgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcatgaccaagaacccaaaagcaaatgcaataaaaacaaagacaaacagctgggacttaattaaactaaagagcttttgcacggcaaaaggaacagtcagcagagtaaacagacaacccacagagtgggagaaaatcttcacagtctgtacatctgacaaaggactaacatccagaatctacaacaagctcaaacaaatcagcaagaaaaaacaaacaatcccatcataaagtgggctaaggacatgaatagacagttctcaaaagaagatatacaaatggccaacaaacatatgaaaaaaggctcaacatcgctaataatcagggaaatgcaaatcaaaaccacaatgtgataccaccttactcctgcaagaatggccataatcaaaaaaataaaaaaatagtagatatggatgtggatgcagtgaacagggaacacttctacactgcttgtgggaatgtaaactagtacagccactatggaaaacaatgtggagattccttaaaaaactaaaagtagaactaccatttgatccagcaatcccactacagggtatctacctagaggaaaagaagtcattatacaaaaaagatacttgaacacgcatacgtatagcagcacagttcacaactgcaaaaacgtggaaccaacccaagtgcccaccaatcaatgagtggataaagtaactgtggtgtgtatacacacacatatatatatatatgatggatatatatatatatatatatgatagaatactactcagccaataaaaggaataaattaacgcattcacaatgatctggatgagattggagactatcattctaagtgaagtaaggcaggaaaggaaaaccaaacattgtatgttctcactcataagtgggagctaagctataaggatacaaaggcataagaatgacacagtggactttggggactcaaggggaaagggtgggaagtgggtgagggataaaagatcacaaatagggtgcagtatatactgcttgggtgatgggtgcaccaaaatctcacaaatcaccactaaagaaattactcatgtaaccaaacaccatctgttccccaataacctatggaaatgaaaatacaaaaaataaaaggaaaactcaagctggaaactgtttagggcaaacctgcctcccattctattcaaagttatctctctgctcactgagataaatgcatatctgattgcctcctttggaaaggctaattagaaactcaaaagaatgcaaccttttgtctctcttctgtgacctagaagccgcctcccccactgcaagttttcctgcctttgcttcaagttgtcccgcctttccagaccgaaccaatgtacttcttacatacattgattgatgtctcatgtctccctagaatgtacaaaaccaagctgtgccccaaacaccttggtcacatgtcataaagacttcctgaggctatgccaggggcacgtgtcctcaaccttggcaaaataaactttctaaatttactgagacctgtctcaaattttcggagttcacagtgggcaagactagatttacttttgtgttgagcagatactgagcttgactgataagaatctggagtgtgaggtctcacggagtaactctgatagaggaagctacctgtgtggtctcagggagaagatctgagacttaccaagaaaaagtgacctgaaagaactggctgacttcaggaccttgaacagtgcctagaccctctttctgcagctccagatcatagccatcatgctggcagcctccctgccgctcatccaggcaccttaaagaagggcttcctcttcccaagcctctgggtgggctttctaaagccctgtgtgcatgaagaggtggcttgtagccctttgcagcagcagggcttacatgaggctgggatatgaaaagctggcattacaatgcagcttgtgccttgcattcactccccacttcatcaagccaagtttctaaataacagggatagtaactgcccactgtggcccaatgtcacttctaaagttgcttggcaaaaagccacatgactattacttagctctccacagaacggcatgtaccaagtcggatcactgctgtcggtgtgtgggtggattagctgctattgaacatgatagggcgggcccctttccagtttgcaccagccccgctctgtgcctactccatgtatcatagagcctcctctctctgtgcagttgaacttgatcagatgagatggcaagagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttaggcaaattactattctgagctttagtcatcttatctttaaaatgaagggtttattctttagaggaagctgagtgaatggcatatgggaacactctgtactatttttataactttgctataagtctaaaattatttttaaataaatggttttcttaaaaagtgaaaggattatgtagattatcttcaagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcttacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacgggacttcagaactgggagggatgtgtgcgtcaatcctggtccagcccactcatttaaacacaaagaaccagaagcccagaaaaagtgacttgccttagcctggccttcctcttgattcctttccctcaattctcccatcctgatcaatcatcaagtcctacaaatattttacctcttaaatattttaaagatgagttgcctcccctctattcctactgccacagccctcattcgggccttcatcttctttggcttggcaagtctgttctcactcacttcctgccttgactctcttgaatccacctttcccatgcatcagagggatctagcaggttccctgcagcttaaagcccatcagtggtgccttgtcttcctcaggataaagtctacaatctttaaaatggcacaaaagactgtgtccgtcatatcagtctcattcttcgcctagtacttaaatccaccaacactaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagtttccttacactttgtacacagctctgttactgccttttactatactctagcacctgtggtttgctcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatacagaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaagagattgagaccagcctggctaacgtggtgaaaacccgtctctactaaaaatatgaaaaattagcgtatgtttcacagcatctgtaatcccagctactcaggaggctggggcaggagaatcgcttgaacctgggaggtggagattgcagcaagccaagatggcgccactgcactccagcctgggccacaaagtgagactccatctcaaaaaaaaaaaaaaaaaaagaagaaaaaagaaatgccttttcccatttcttgttatgttactaccttttaggattcaatgcaaacttcaaacacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcctcccaccctcattcacttctgtcaggctagactctctctccttttcattggcttgtcttagctattaataagtctcggctgggcgcagtgggtcacacctgtaatccgagcactttgggaggccgaggtgggtggatcaggaggtcaggagattgagaccatcctggctaacacggtgaaaccccgtctttactaaaaatgcaaaaaaaaaaaatagctgggcgtggtggtgggcgcctgtagtcccagctactcaggaggctgaggcaggagaatggcatgaacccaggaaccggagcttgcagtgagccgagattgtgccactgcactccagcctgggagacagagcgagactccatctcaaaaaaaaaaaaaaataaagtctctgaccaggggcgctggctcacatcttaatcccaacactttgggaggccgaggtgggcggaacacctgagctcaggagttcgaaaccagcctgtccaagatggcgaaaccccatctctactaaaaatacaaaaattagctggcatgttacttggcccttgtaatcccagatgcttggcaggctgagggatgagaatcacttgaacccgggcggcagaggtggcagtgagctgagattgtgcctctgcacttcagcctgcgtgacagagtgagactctgtctcaaacaaaaaaaccaaaaaagaaaaaaattaaaaaagcaaaatgaaatcttttgtgctacacagaaacattggccactcatggggtaaaaatctcagggccaagccttgctttatagaaacgtataagcaagaaaagtgtagaagtgtttatgtcttggtttcaaggtgactgcatagctaagacaagttgacttaaaggagatcaagactggagatgacaagagtgaaaccagggaaacaacatcttcaaataagtaaacaaggctgccagtgacatccctcagtcctgattaagcctatttgatttcaccagtttttaacccatcatgtgtttgcctttcttctccccagtccctggccccacctcttctgccacaaacgtcagcatggtggtatcagccggccctttgtccagcgagaaggcagagatgaacattctggaaatcaatgagaaattgcgcccccagctggcagagaagaaacagcagttcagaaacctcaaagagaaatgttttctaactcaactgtccggcttcctggccaaccagcagaacaaatacagtaagatctataggctcaccatcacgaaagtgatgaacgacgtcctgtcttctctctgaggaactaagtgctctctccatcaaaaataatgtcatcctccccatacttctaggaaaacagaaatgggtattttaacattttgtcaaagttggaagacagaggtaccaaagtatttagcaactttccatgtttgcaatcaggtgggggtgggactagagttaaactgccatttattgatttctgacacaggcacagaatgacctgttttctccaagaggctcaatcgtgttttcaagaatcctctctaccatataagatcctgcagacaaataacatctagtctgttgttctaaatgtctgagactagtgaacttttattcagttcaagtttctgttgaggcccaacaggcaaagctctgttctagtgactctgagggaaacttggtgatagtagccagtacctgctctgaggggcttcaagaggagtctactcctaatagaacctgtgctgtctataaatgacagcatcaagagcagggagtaggggccatgcatggtggctcactcctgtaatcccagcactttgggaggctgaggcgggcagatcatgaggtcaggagtttgagaccagcctgggcaacatggagaaaccccatctccactaaaaatacaaaaagtagatgggcgtggtggcaggtgactgtaatcacccctgctcaggaggctgaggcaggagaatcctttgaacccaggaggctgaggttgcagtgagccaaggttttgccattgcactccagcctgggcgacagggcaagactggtaaaaataataataataataataatgatgataaataaaaataagaataaaaagcagagagtagcttggtgagagtgaagtcctgcttcctggggcacagagtcttgttgctaaagaggaagaaagttcgcacccgagaatgtgtggagatagcagtgcagtgtacagagcagggaccgtgggcctgtctcctgggctccatccaagttgcttgtcttgtctgtccctcagttacctcacctgttcagagggtactacaataatacctacctctgtaaattgctgcagtgaattacatgagctgtttcttgtcagtctcctagaacatttattggcacagagtaaacactatctattagttcttcattctgctgtttctaaattaacacaaactttattagcatttgggcatatttccttcatggccttatggtcttatgtgtcacattttatgcttcagatatgattcttaaaatcataactgaagatatgatttaaaaatcaaagatttaaaaaatctttcgcatacttgtccttgaaattcccagtaaaagggaaaccatcagtcccatagtcctaggggccttcccgactgtacaagaaatcactacttcatgccccagtgcagtgttttagaggagaggctgcaaagcttgggaaagtggccccgcattcagagtcagacctcagggactgtgaattctgactccacttcgttgtggttgaatcatcttgtcaacttccttgatgtgtccttgaggttctctttcttcgtctttaaattttggaggatcagatgccagaaagtcaggagactgaagagtaaagatgtggaaatccctgtctagaccctggtactggggagagttttgtccttgggatggacctggctcctgccctgtaggcagtgaccacagcagcatgtccagccttccactgagacaggcgtgtctgtcttttctcagagtatgaagagtgtaaagacctcataaaatttatgctgaggaatgagcgacagttcaaggaggagaagcttgcagagcagctgaagcaagctgaggagctcaggtgaggggaccccatgggggcaggcaggggggcaggtgtgtaaatctctgaagtacagcagctcggtggggagacgtaagagctaagctgggccaggggaagggcaggaattgccatggcaggctcgctacacacaaatatttatcaaacagagaagaaggataataaaaatgtatgggttgcagttgtttctcagagccttgttttctctttttcaaacaagtaattgttgatgtgaaatttacataacacaaaattaaccaaaggagtgtgaaccacacagcagcattcagtatactcaaaatggtgtgccatcaccaccccacttacccttagtgacaatcacctcctgactgactgcggcttctcattctttcactcaatcaatgttgccttctcgaccctgtcattcttttcttctttcgtcttttcaattcgccccatctgcccctggcctcatttctgtacatggctttgtatctagtggccgcaagatgcactatgtgtattttcacatggaaatgtccatggccagagtgaggaactgaaaggatgtctttttgaaatggaattaggaaaacacctacttttgtttacagaagggaaagatgaatggaacatcatcgaggatcttgcaagagccctctctgatacagaggaagcctgtaaaccattttctattctttctcttggccacagacattcctttaaacatgtgctgaccttctgcttcgaggtctccttgaggacactgtttcagaaatctctgttgcaatatttgagcggatcactcaaccctttccactcttaatttttctctaccatctcaccttaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccaggtaaggtggccataggccctgttgacccaaaaccccaggcttatgagaggctccagacctccatactttcacaatgacagttgtatcaatggtgtttttttccactaagcttatgtggccatgacatgacaaggacttcttgggtaagaacggagatgggaaacccatggggttggaggtcacattattgcaagtgtccctcctcccttgatggaaggtggtctttggagcaagaggcagcatctatctagttttaaaggacaggaaggaggctgcgatgggagcaggcttgttagagtgaaaagagctctggactaagaatgaaggttcccaggctgtcttttcggcaatgttcttagttactgtcagagagtgaatgacttgtccttcctgagtttgtctctctccgtggcagacaaattgtctcttgcaagggtctgaagcattcaaatgtgggaacacttacaactgctttccaaaatgagatgaaggccctcgccgtgtgatgttggagaaggcactttatgtgggggcgttttgtggtaggaagtgcttcagactggagcactccccatggatagaatgtccctgaagaacacagcagaagccacttggaggcttgaaatcttctgatgcatagaggactgtgggacaagtttgtctgcttctaagagaaagaattaggtttgaaatgcaaaccgtgacaggacaccaagcctgtgcctgggaatcagatctggcaggatgggggagacagctgccaacgtccagagagaggctgcacaagcctccagtgatatgggaagcgaaaggtcttttcaatatttggccacatgttgatggtggccctccagatcagaaatgcattgcctgatggatcaggaaaccatgccagggcattctgttaaagataaaacatgagagttttcagttgaacggtgacccatgcctagatgttcatgtctctgttgcacattgggctgactgtgcttgcagactgtgaagtgggaaatatctgaacgaacacttctgtatttacagaaaatgacaacgatgacaatgaagatgttcaagttgaggtggctgagaaagtgcagaaatcgtctgcccccaggtaacactgaatactcaggaacaattaatggatggtaacatatgaggaatatctaggaggcacaccctctctggcatctatgatgggccaaaaacccgcattcgcttggccacagtatgtgaaattgaacccagcttagacacagggtgcggcagctgtcatgtttctctatgtgtgccgagtgtcatgtctgcaccgtacagggatagctgagtcttcatcctcctcagctcctatctgtccagtgcaatgaacagcagctgctctcttcctctctggttcccatggcagccatgctctgttgcagagagaagaggattacctgttccctcttaatgggaacctccattttgctttctgggaccactctcttaatgccgcctgtcaaaaccagctaggactccctggggtccaatccctctgtgtttaatcttctgtcatctctgtcccacctggctcatcagggagatgcagaaggctgaagaaaaggaagtccctgaggactcactggaggaatgtgccatcacttattcaaatagccatggcccttatgactccaaccagccacataggaaaaccaaaatcacatttgaggaagacaaagtcgactcaactctcattggctcatcctctcatgttgaacgggaagatgctgtacacattattccaggtagcctctgttttccttgtgtctcatacctctctctaggctgaggaagataaactctgaagacaggctctataaacacaaattcatttgaataaaaaactgtgatgggtttctaaacagatatcagggagttttttgtccttctcagctaatgtcatgcctttgtctgccagtccccagtatcaagttactcaaccccaggcaagtgtgacaatctcatagtcacctgagtgcaggaggtgcacaggcagtatctgtcaggcctcctagcttcgattcagtatctcttgtcatctgtgattaagtcatctgtccctgaacaatgtccatggagtttctatgcctgtttaaggaagctggcagccttgcctttgtttttggaaatatcgttccccaggcttcactgctctcagctttcatctggatctcctttaagtcagcttgcttagctgcacagtcaccctgaaatcaggacggaaacttttcttctttactttggtgatatatttccataaagcaaggctggaccctggttctccaccctgtcaatgcaatggctgatccaatgtttctttgtagcatcgtggattttttttttttttttttttttttgcgatggagtcttgctctgtcacccaggctggagtacagtggcaccatcttggcttggtgcaacctctgcctcccagattcaagtgattctcctgcctcagtctcctgagttgctaggaccacaggtgcacaacatcacatctggctaatttttgtatttttagtagagacagggtttccccatattggccagggtagtcctgaactcatgacctcaaatgattcacctgtcttggcctcccaaatcacagattctttttaaagcaagagttgttcaaatttatctatcagtcgtgtttcatgtatagatgcctctaaacatttaatgtccatgttacctggtgatataagtccgtatcgcagcaacactcttagaaaattgtttgaccaatttttggagatttttttggggaaaaaattttgtttaactttgactcaggcagggaatatggcattatggtctacacgtagagggagattttggcctgtgggtctggaaagcagggtcatctaattctcaccaaagttaatctaggacaccctagaatattcctgtcagaatccttattcttgcactgagaatagttatgtccttggctatgactggacagtgatttgttcatatgtgaagtatgaattgcttaatgtgacctgcttctctgaatttatttacagaaaatgaaagtgatgatgaggaagaggaagaaaaagggccagtgtctcccaggtaatgttgtggaattgttggctgttaattcagtagtgacatctggagattgtagatttagggaaaatgaggaagtgatgaatagaactatttcttccattcacccagctacaaattgtgctgatttacaatgttgtatgttatttgtggcacttgtattggttttaatttcatagtcctctcaagataggaacttgccatcagatgagccaggtgaactagccaaacagggttttcttgttgatcttttcaaaaaaccagccctggattcattgattttttgaagggttttttgcgtctctatctcctttagttctgctctgatcttagttacttcttgtcttctgctagcttttgaatttgtttgctttgcttctctagttattttaattgtgatgttagggtgtcaattttagatcttttctgctttctcttgtgggcatttagtgctataattttccctctacacattgctttaaatgtgtcccagagattctggtatgttttgtctttgttctcattggtttcaaagaacgtctttatttctgccttcattttgttattttcccagtagtcgttcaggagcaggttgttcagtttccatgtagttgtgcggttttgagtgagtttcttaatcctgagttctaatttgattgcactgtggtctgacagtttgttgtgatttccattcttttacatttgctgacaagtgctttacctccaactatgtggtcaattttggaataagtgtgatgtggtgctgagaagaatgtatattctgttgatttggggtggagagttctgtagatgtcttttaggtctgcttggtggagagctgagttcaagtcctggatatccttgttaagcttctgtctcattgatctgtctaatattgacagtggggtgttaaagtctcccatgatgattgtgtggagtctaaatctctttgtaggtctctcaggacttgctttatgaatctgggtgctcctgtatagggtgcatatatatttaggatagttaactcttcctgttgaattgatccctttaccattatgtagtggccttctttgtctcttttgatctttgttggtttaaagtctgttttatcagagactaggattgcaacacctgcctttttttgttttccatttgcttggtagatcttcctccatccctttattttgagcctttgtgtgtctctgcatgtgagatgggtttcctgaatacagcacactgatgggtcttgactctttatccaatttgccattctgtgttttttaactggggcatttagcccatttacatttaaggttaatattgttatgtgtgaatttgatcctgtcgttatgatgttagctggttatttcacccgttagttgatgcagtttcttcctagcgtcaatggtctttagagtttggcatgtttttgcagtggctggtaccggttgttcctttccatgtttagtgcttcctttaggagctcttgtaaggcaggcctggtggtgacaaaatctgtcagcatttgcttctctgtaaaggatttatttctccttcacttatgaagctttgtttggctggatatgaaattcttggttgaaaattcttttctttaagaatgttgaagatgctggagaggatgtggagaaataggaacacttttacactgttggtgggactgtaaactagttcaacgattgtggaaggcagtgtggcaattcctcaaggatctagaactagaaataccatttgacccagccatcccattactgggtgtatacccaaaggattataaatcatgctgctgtaaagacacatgcacacatatgtttattgcggcactattcacaatagcaaagacttggaaccaagccaaatatccagcaatgatagactggattaagaaaatgtggcacatatacaccatggaatactatgcagctataaaaaatgatgagttcatgtcctttgtagggacatggatgaagctggaaaccatcattctcagcaaactattgcaaggacaaaaaaccaaataccgcatgttcttactcacaggtgggaattgaacaatgagaacacatggacacagaaaggggaacatcacacactggggcctgttgtagggtgtggggagggaggaggggtagcattaggagatatacctaatgttaaatgatgagttaatgggtgaagcacaccaatgtggacatgtatacatatgtaactaacctgcacgttgtgcacatgtaccctaagacttaaagtattaaaaaaaatatatatatatatacatacacacaaaaaataataaaggaaaactatacatatggaaaaaaaaaagaatgttgaatattgctcccactctcttctggcttgtagggtttgtgccaagagatctgctgctagtctgatgggtttccctttgtgggtaatctgacctttctctctggctgcccttagcattttttccttcatttcaaccttggtgaatctgacaattacgtgttttggggttgctcttctcgaggagtatctttatggtgttctctgtgtttcctgaatttgaatgttggccttccttgctaggttggggaagtcctcctggataatatcctgaagaatgtttcccagcttggttccattctccccgtcactttcagtacaccaatcaaacgtagatttggtctttccacatagtcccatatttattggaggcttgttcatttctttttactcttttttctctaaacttctcttctcgcttcatttcactaatttgatcttgaatcactgataccgtttcttgcacttgatcgaattggctactgaagcttgtgcatgcatcacgtagttctcgtgccatggttttcagctccatcaggtcatttaaggtcttctctacactgttcattctggttagccattcgtctaatcttttttcaaggtttttagcttccttgcgatgagttcgcacatcctcctttagctcagagaagtttgttattaccgactttctgaagcctacttctgtcagctcatcaaagtcattctccatcctgctttgttccattgctggcgaggagctgcgatcctttggaggagaagggatgtcaggtttttggaattttcagcttttgtgctctggtttctccccacctttgtggttttatctacccttggtctttgatgatggcgacctacagatggggttttggggtggatgtcttttttgttgatgttgatgctattcctttctctgtgttagttttccttgtaacagtcaggtccctcagcttcaggtctgttggagtttgctggaagtccactccagaccctcaaacagggatttcttggtgttgcctattctctcccatgtgtctaaatccagggagaggtgtatatatgctttcttcctatttgttggtagtatgttggctagtatttttgcaagaaaagaaattgaaaaagtaaatatattatatcaaaatattgggaaaatggggcccttaatacacaagatctgtgtctgcactgcgtcaagaactctcttcacttgaatgctgcatgtaaaattcaacccaatttatgcaaagtagttgaagccctgtgtcagttctctgtgctgcaagacatgatggtagtttacagggagagtctgggtgccctgagttggctcatctgtggcaaatgtactgagcacacgctgcccatttttgctctgtccccagagcagtcaccctccaccctgtatttagaaggatagttttatttctcttgaaggaaaaatgcctttggtttctgtgaccactccattctgtctcccatcagatcatctgggaggttttgttgtctaatgtctgttggttaaatcttctatcatccctgtcctgcctggctcatcaggaatctgcaggagtctgaagaggaggaagtcccccaggagtcctgggatgaaggttattcgactccctcaattcctcctgaaatgttggcctcgtacaagtcttacagcagcacatttcactcattagaggaacagcaagtctgcatggctgttgacataggcagtgagtactccattgtgaaggtgataaagctccagttcatggcccaggtagaccccataatctttgggccttgtgccccttgttgggctgagatttgccatcactgtgggctgaacctatatatcaatgtagatttcaatcactctggagtcgagtctgaagcacaggcatggggtgggtcagtgagctttgctctcttcctagtctcaggccatgcccgtgccaacctggactgactgtcacgacattgaactcaaggcaggtgtggcaaactcacaccaaactatgtagcacatgcccaggagttgtctgtcagatcagctcatctgaattaaatgtctcttgccagctacaaaattccttatgagttttgttcccaaagcatgtctgtgtggttctttacctgcccaaggccagtgtcacccttgtctacctctcagtgaaagatgtgacccaggtttcactgaatttattcccattttctgtgtcttctaagttcgcttgttttagctcatctgtccgtcatgttcctggtatgttttctagataaatggctgacttttcacccacaaaagccataatagctgatgctactgtgtagaaccaagttacattttgactcaagagctggttcattgcaccccctcatcaaatctctgtgtccacaatctcataaactatcaaattctgggtatttgatgagagaaagcttaatattgaagtatctctcctatgaggtgttagaactatttgcctacaatttattggggaaaaaaatcgcgcatttgtgtacataaacctaggacagagcacatagggaagataacattccaacacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaaggactgcttaatgtaagagggcccatctgaatttatttgcaggacatcggtgggatcaagtgaaaaaggaggaccaagaggcaacaggtcccaggtgagtctgagaaattgtggacagttaatttgatgttgacacctggagatgccaagtccagggaaaacagtacatgctgaaaataatgattttgtcttgtcagacaagtctgaattatgcctactacattgctttttggttctcattagagtaaatgtttaggtttccatttcttcctacccttatcatttactaacctagtgaaagttgaccatacctcaaaagctgtattctcatggtaactgcagggaaacttgagcacattttacgcaaaattattgaggacatgcttttcatgatcactgttcactgtgtgtcctgagagcacaaatacagagtgtcctttgactccctcatcagtgtgtcacctgaccaattcactcagctcgctctgtttgtgtgtgtgtgtgtgtgtgtgtctgtgtctgtgtgtgtgtgtgtgtgtctttctctttcatccttttctacctggccctagtctatcccaacataaaggcaataatttgttacctcattaatggatctgtcctttttcttttcaaactcttccttatgttagccatgaaatctagctggggctgtgtggtttctgattccccctggcttattctttactttttcccacttttccaggctcagcagggagctgctggatgagaaagggcctgaagtcttgcaggactcactgtatagatgttattcaactccttcaggttgtcttgaactgactgactcatgccagccctacagaagtgccttttacgtattggagcaacagcgtgttggcttggctgttgacatggatggtgagtacctttctatgaaggtgataaggatccactgagtcttctggttagggtcatattcctactgcaagtggccgttactgagctgagagatgtcattgccacagggaggacctataggcacatgtacgttgaatgaaactctagttccacttggaagaccagacaagggatgggtcagtgagcaaggctctcttcctagtctcaggccatgcctgtggcgccctaatcctactctcatgacattggacctgggcagatgtgacaaattcacacaactctgattttgtctcaattttgtagatcttgtagatttcatccttcactctaatttcagcgtctaaaatcctcgctaccatgaacaatctgagtatttgatgagacagggctgaatagtgcagtttttctcctagcaaccatttggggacatttgctttaaatcgattggaaaaatatggcataaccatttgcacaaacttgggacaaatgatattgggataacggtctaccagaatagggaattttacccacagtttctgggacaaaaaccaaggaatctctatggagatcagccttcaggcctcctgaagaatatctctcacagtgtcctattctcatgctgaggagcctgaagtccctgtgtgaggattagacagtggattgttatgtgtgtaggagaaacagcttaatatgactgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttcaacggaggttgaattactcctactgccattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgatcactgttcgctgtgtgtcccgagggcactaactcagagtgtcctttgaccccttcatcagtgtgtcacccggccaattcgctgagctcactttctcctctctctctctctccctctccctgtctttctctttcattcttttccacctgaccctggtctatcccaacctaaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggatgagaaagagcctgaagtcttgcaggactcactgggtagatggtattcgactccttcaggttatcttgaactgcctgacttaggccagccctacagcagtgctgtttactcattggaggaacagtaccttggcttggctcttgacttggacagtgagtaccttactatgaaggtgataagcctccacctggtcttccagataggggtgatattcctgttccaagtggcccttactgacctgagagatgtcattgccacaggcaggacctatgggcgcatataggttgtaatgaaactgtagtctcagttggaagcctagacatgaaatgggtcagtgagcaaggctctattcctagtctccagccatgcctgtggcaacctgagcccgctctcagcacattggacccaggcagatgtaaaaaattcacagaagtatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatatctgtcacattgtcctgttctcatgctgaggagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacatctacttctgtgttgacatctggagactcctggttcagggaaaacagagcgggctgacattatcgattacatcttttcaagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatccctgtatgctgtgtgtcctgagggcactaactcagagtgtcctgttactccctcatcagtgtgtcacctggacaattcactgagctcgttctctctctctctctctctctgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaagtggccattactgagctgagagatgtcattgccacagggaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaagttgattggaaaaatatggcgtaactgtttgcacaaacttgggacaaatgatattgggataacgatctactagaatagggacattttacccacagtttctgggagaaaaaccgaggaatttctatcatgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaaggaaagaagaaggggaagaaaagaaggggaagaagatcaaaacccaccatgccccaggtgactttcagcaattgtggatgcttaattctgtgttaacacctggaggcaacagattcagggaaaccagattgtgtttgatgtcatgttttcaacgaaggctgaattactcctactgtcattgctgttggttttcattgcagtagatgtttaggtttccatttcttcctccccttatcatttcctaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactagctcactttctctctgtctctgtctctgtctttctctctctgtctttctctttcattgttttctacctggccctgttctatcccaacataaaggcaataattttttttttttacctcattaatggatctatcctttttcttttctaaccagttccttatgttacttctgaaatctagtggggctctgtggtgtctgattttccctggctgcttctttagttttgtctccttttccaggctcaacggcgtgctgatggaagtggaagagcctgaagtcttgcaggactcactggatggatgttattctactccgtcaatgtactttgaactacctgactcattccagcactacagaagtgtgttttactcatttgaggaacagcacatcagcttcgccctttacgtggacaataggttttttactttgacggtgacaagtctccacctggtgttccagatggaagtcatattcccacaataagcagcccttactaagccgagagatgt

SEQ ID NO: 1117 - DNA, 43273 bp, Homo sapiens
gcagacaacttgctcttttaatgtggaatggatgaccctccaatatttccccagagcaccccatgctcttctatcagggaacttattaaaatcatgtaacatgtttcttggtgacaagaattaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatggataccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcaccgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaatggggttatttgtttttcattgttcaattgttaaattccttatggattctggatattagacccttttcagatgctagttgcaaatttttttagattctacaggttgtctgtttactctgttgatagtttcttttgctgtgcaaaactctttagtttaaataaatccgacttgtctctttttgtttttgttgcaattgcttttgaggacttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgacaggaatagtgttgaatctgtagattaccttcggcaatatggccattttaatgatattgattcttccaatccatgagcatggaatgtttttccatttgtttgtgtcatctatgatttctttaagcagtgtttcatagttctccttgtagagatctttcacctccttggttagatgtattccaaggtatttttttttttttttagcagatattgtaaatgggattgcattcttgatttggctctcagcttgaatgttattggtgtgtagaaatgctactgattttttttttttgagacggagtctggctctgtcgcccaggctggagtgcagtggcatgatctcggctcactgcaagctccgcctcccgggttcacgccattctcctgcctcagcctcccaagtagctgggactacaggcgactgccaccacacccgcctaatttttttttttctatttttagaagagacggggttcaccgtgttagccaggatggtttcgatctcctgacctcgtgatccacccacctcggcctcccaaagtgctgggattacaggcgtgagccaccatgcctggtgaaatgctactgatttttgtacattaatttttgtattctgaaactttattgaagtctgaaaatatttttaataattttagtaatacttgtcatttaacactaagcttttaaaaaactgtaaattataaaagtaaccattttagcaatataaatgtatataaagaaaaatatcaagtcttctccctatcacggactgtgatctcactcttcctcagtatactataaatatcactcagcaacttttcccccttactttaatcaaggaattcccactaggacaataatatagagctaactcattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctcgggattgtttgatcaaaggaaatcctccttttttattataataggtagcatcccatactaaaaatgttgtcacaatttacactcactggtagtgtatgagagtgcccattttccccaaatgttatctcagctcttgatgttattataggctgactgatactttttgataaagcttatttgcatttgtctctactaaaagtggaaacattcactgtttcaatttagttgattgctgactgataggaagtttgcagtcttaggtctggtggatttaccaacttatgacaaggtccatctgacctagtaatagagaaagagcccaagggaaacacagcatatgaaaatctattgtttcagttcctgaatcagatacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcaatgttctgaaaaacacacaggcattaatcgttattaactgccacagacactctttcctggatccaggttcctatttgagtcttgccttggtccacagcctctcacctcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcctgaaaacgaaattgctggaataatacttttaatagaattatagtaatagaacaatacttttaaatgtctggggatttaattatttaaagaaatttggttgtaaacatttttaaaaacaatgcttttatcataaaattggaattttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtctggtgcaggttaagtggcttagtgtgtggtaaggagtatagaaaatagtttgcaactagtttgtgaaaatcctgctaagacaactagataggccggccacggtggctcacacctataatcccagcactttgggaggccaaggcaggcagatcactcgaggtcaggctttagagaccagcctaaccaacatggtgaaacctcatctctgctaaaaatacaaaaattagctgggcgtggtgacatgcgcctgtaatcccagctacttgggaggctgaaacaggagaatcgcttgaacccaggaggtggaggttgcagtcagccaagatcatgctgctgcactccagcctgggtgacagagagagactctgtctcaaaataaaaaaaattaaaaaagtaaaaaactggataataatcagtagaaatcaaagacttatcagggagctttaagcaaagtattggcatgatcgggtccatgttgaagaaggaattatgaagaaggtgggtgggtcaggggcaactaaccagaatagggagggggactgtctaaggacaagaggtacagggagaaagactcaaaagacatttcagagacagaagccacaggccttgatgacttgtgagattcagattagactggagggaggaccaaagacaatgctgaaatttccagcatgtcagtgggaatgcattctattaactaaaataggggcaggtttgtaggggaacctaaggaggtttctgcaaaatgttaattgagggattactttatttcagcttaaacgttagcatgcaaagatggattagtcccttccctgatgaagtccataatacagtattaggcaagaagaatgttatttagtaaagaagtctttagatcagaggttgacagagagactgaaggtaaagtagctaaagtatgaaaagtagtattgtgggtactagaacagtagggaggattttactttactatcgccatataataaccaccaacacctagacttctagaagtccaaggcaacatacaatagcagcatattttctaccatacttgtgaaggcatttcataacccatgtttccatgcagggtggtcgaaacacaaatactaattgggaaaagtagaaacctagtttagatatttgagagttacttagaattaaagaattttagagctggaaggcagttggactcaaggcattttagatcatattactagtatgtttttagtgacatactgagaagaatgtttgttcccctcataagtaggtaccttttgaccaaggttagaacatagattcagatccagtgagatgaaaatatcctaatttcttcaaaagaaggaatgatagccctgtcttttcaggatatactttaaagttattattttatgaacactaaatagcattaccagatttagcaaataaaaatataagatatctacttcaatttaaatttcagataaacaacaaataatttgtttcattagaagtatatcctttgcaatatttgagacataacttaaacgctaaaacattgtttgttgtttatctgaaatttaaattgaattgagtaccctgtattttattctgcaatacaaataccaaaagattaacaaatggaaacacgcatatttcaattttgtatgaagaacaagtctaagatctctatatcagttccatggcctggcactgcaagaataattcatctgtaccaattgatgaatcagtaaaatagaagatttgctaaacagttgctatgtccccagctttgtggtcaatacttaaaggaattcaaatgtcttcataaaaaatagtccctaagctagaggcccttcatagaggtgaaggaatatgcattcaattatgtgggaaatgcaaagagggagcaacttcctaatctgtaataggcagataattgtattttcctcattcataaacctacctgagaggatcgtgaggcataaataaatcaatacatgtaaaggacttaggacagtgtttctaacacaggtataactataattttaattataataatattattatcaccatcatcatcaagaacaacagcattatcatttggaacagcagtttgctttccatgagaccataatgtttcaagtggattcagtgttcaggatatggtgctgagaaagaggactcctaagtttattattatttctgccaccaattgattcacttctgtgaccttgggtaaaattctgctaaggcttctccacctggaaaatgacaaagagtgggcaaaaagctatttaaatctcatatgaaagaaaatggaatctataattatgaagtgttattatcaatgatattcctatgcctggctaatttatataaatcagaaaagtctggatatgctaaaccacctcagataagccaaaactgcttgagcagattttttaaaaatctcatatctaaaaatacgtgaggtctcaaatgactggagctatatggatgtcctctgcctagttcttagtctcatgatgtgacatagggaatctctatcaggtataaactgatcaacagaaagttccctgaaaagtcccttactattaatactatttttgcatgaggaatctttgaatattcaaataaaaataaacaaacaacagggaaagtgagaggcactatgaaaccaacctaaagccagaaagaattaggttcgaatcctggctctatcactttcctgctaggtgaccttgggcaggttaactaatcactatgagcctcagttttcttataagtatagtgtggttgctttgctttttaatgaagataagtattcacgagggattctgtgaggattgaatgagacaatgtgcatgataagcatagaacaatgccttgcacacagctgtgcaacaaccttgattcactttcccttcatgtccaggctgactagtgccagtcagagaccccagccttaccaggaaaaatacttagatctaaaaggaagaaaaacagaggacataaattagtacgttctatctgttctaaatcctactgaagaaaatgaagtcaatgctttgaccaatttggccaaagattcacagatttgaagacctcagcatttctgtgttctagttctcttagtttaaagacaaggaaattgaaatccagaagggttacctccaaggtaaaagccgtaactgaaaccaacactccactcttgctttagccttttatcagagagaccagcttagcaaacactgcccagttttgtctgattttgtagaatgtggtaaattatagaattagagaatgtgctgcatttagtcttgaaagaatatatggaggcagtaagtatagtggtcaagagcataggctctgaaggcgagaagggggcttgacaagtcacctgccctctctaagagcctcattcacctcatctatcaaggagataacaatgataccaatctacaaaggatgttagggagactaaatgaaattatgcacaaaaatcacatcgcacagtgcctggcatgcagtcagtattcagaaaatgataactattattaactataaaaacaataacaatttaccctctctaactaggatagctgaaatccagaagggttttcaaggtaaaagcaataatcttacatcaaagtctaaccttcttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgttcaaaaagcatttaatatgtgatgcaggtccagctaaagaagaaaaaggaaagaaagaaaaaaccttttaacgatttttaactgtacagcgattaaattatacacaactggcctgataatagagtctattcaaaatttgacctcaatctacctctccagctttatcttccattattatctgctagcctaactggatttcccaaacatgccctatgcttcttggtgccacatcattgtgtgcccttcagcttcatggttaaatgctccgtcccctgtgaagccttactttatctctccaaattaaaagtaatttctcatgatgacattatgagctttcaaatattcttttcatactgcaacattggcatcccgtgtaaatgcttcatatttctacacctgtcttatttacccttttaaattgcaaactccctaaggacagaggaaatgatggtgtggcagaactacccaggtgcgctggttattaagatactgcctctcagcgttgtcatgctggggcaggaatttcaggataagtaaacctaggttcacatacctttctgccacttcctaactgggggaccttttttgtgtaaattacttcaacttttacaacctaatttcctcatttataaaatagggtttgcaaaaattacctcaaagtttgtagtgaggaataaatgaatttatgtaaagtacccagcacaatgtctgatacaaataaccgcagctcgggcgcggtggctcacgcctgtaatcccagaactttgggaggccgaggcgggcagatcacgaggtcgggagatcgagaccatcctgcctaacacggtgaaaccccgtctctactaaaaatacaaaaaattagccgggagcggtggcgggctcctgtagtcccagctactcggaggctgaggcaggagaatggcgtgaacccgggaggcggagcttgcagtgagccgagatcgcgccactgcactccagcctgggcgacagagtaagactccgtctcaaaaacaacaacaacaaaaacaaataaccggcagctgtgactaatctgaggtctcgcagtgtctctcacctctttgtgcagtaaaagctttgaaagagtgaaccaacaagagaacaaagaaggaatagatgacaagaggcggaagtggactaacaatgatacgtttgttgaatgagtgagaaggtaatagataatgctgtgagattatgtggaaaactttttatctgaagtctttaaaagacattctcacttttggctgggcgcgggggctcacacctgtaattccagcactttgggaggctgaggcgggcggatcacttgaggtcaggagttccagaccagcctggacaaactggtgaaacgctgtctctactaaaaatacaaaaattagccaggcgtggtggtgggtgcctgtaatcccagctactcgggaggctaaggcaggataatcgcttgaacccaggaggcagaggttgcagtgggccgagattgtgccactgtactccagccggggtgacagagcgaaactccatctcgaaaaaataaaaaatgtactccagctggggtgacagagagaaactccacctcaaaaaaataaaaaataagggccgggcacggtggctcatgcctgtaatcccagcactttgggaggccgaggcgggcggatcacgaggtcaggaaatgagaccatcctggctaacacggtgaaaccccgtctctactaaaaatacaaaaaattagccgggtgtggtggcgggcacctgtagtcccagctactccggaggctgaggcaggagaacggtgtgaacccaggagtcggagcttgcaatgcgctgagatcgcgccactgcactccagcccgggtgacagagcgagactccatctcaaataagtagataaataaagactttctcaggtttttgttttgtttttgtttttttgacagtcttgctctgtcgcccaggctggagtacagtggcgcaatctcggctcactgcaagctctgcctcctgggttcatgccattctcctgcctcagtctccgagtagctgggactacaggcgcctgccaccacgcccggataatttttttgtattttttgtagagacagggtttcaccgtgttaggcagaatggtctcgatctcctgacctcgtgatccgcccgcctcggcctcccaaagtgttgggattacaggcgtgagccaccgcgcctggctgactttttcagttttaagctaagaatattctctaataggtatattattgacccattgacaatagaagattgaatacactttaggattccagcctcctcttctactgctcatgctctccgtaagaagggctaaacatcctactcctgtgcactacattggagctcagaaatactgacttaaaatctccagatcttaacacggacttttaaagggaagattgagtatggacccagtattagatggtattatggaattatttttaagctttttgggtacaataatagtattgtggttatgtttaaaaacaaagccttctctgtgagagttatattctgatatcttcccaaataaaattatatgatgtcagagagttgctgtaaggggtggaagaggacaagatggagaacgaacagtgcagggagatcactgaaaagaacagcaaaatgttgggaaccgttaaagctgagtgatgggaacatggctccctggtaaatgggacacatacatcgggaggtactattttcgtagtctttgtttatatttgaaaattttcaaacttacataatgagaagtcaaaaggggcattttcatcccaaaaaggtaaatgtccatattcttttttattttttcattttcatttctggaattacctaaactcaggtcatagatagcaatgaaaattcggctccctgtggcagcttctttcagccaccagacttacatagactcagtggtgcagagtccgtttcccaatactgagggataaagaaaattaagcctgcctctaggcacgtctcaaacttgggagactcagaatacaacagagtatgggatacagggaggaaagaagagatgcagaaataaattaaaaacaagatttgtttaaagaggaactgcaacttctttaattgggcagattgaaccaataaaagcacagttctctcccttcacctgttatcctttagtctcttcaactttcacattgcttcactcactctcttcctctccctttcacctgctcaccttacccaacttgaactgtgccctctgatctgacacaggatgacaatgacatcagtcattacctagcagccattttttctgataactagagttctgagtgatgatagttcatggtgagataatttccaagacctcgctagccattggtggtactactctccattaaagacaagggcatttgctgattgagaaatcaatcatacaagtgtccttggaggccaccaaggctttgcctgaactgttctcagcctatgatggtttctctttctaaacctgttcttctaggttcagctcaaacatcctctcctatagaaacctttccccatcctcccagtcagaactaatgatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcgagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccatctcaaataaataaataaataaataaaaaccaaaaaaaaaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaatcagagttgtgttaaggtcagtgagtgaaggaaatgggtactgcacctttgcaagatagtaggaagcaagccagagaagagctggcattccacaaaagagtctttatttgggacaaaaatcaatatgaccaaatcccatcctaatcaattctgtaaactaaaggaatttttaaaaaataatttagcaggaggaagagtttcaaaatcttgtagggaaaccctgatgtaactcctgattattcacccaaagtgaaaagtaactattagtgaatgggttttattttaaaacctttcatttttagaatcttatctcttctaggaaaagtgtagtacatacgaattttttgtatgcagagtgaatttttctccaggcttctctgacatcaatggggcaaggtcataactctataaaacagggagaagcactgagcattttcagaaaggactctatctgtcttgaccaaaagacaaaggactggtcattgcaggatccccagaaatacattttagtagtttccaagtgaattcttttgtaaatggagtttctctccattcataagttttagagcaaaaatgaagccttagtgggtctagatatctggctaacattaactccctgtgtgaccttaaactggtcgtccccaaagctttatgcttttatacaattaacttgatttacagcctctccttcttgcccataagaatgataataccacctgcattactcatcttttacgcttatgtgagacacctagccacctatcagaaggtattcaaatgcaaagcattaagtttttacactttaatgtgaagtggaagaaagtcttgattcaaatgcacaatctctacctttctactgattccacatttgctgtcttttactagtgcagttaagtcccaaattagaaacataagtcgccccaacatgtgacaaatgtcctttgttgccagagaaaggacagtggggctgtgtcctcagccttagcaaccagaagattctgcaagaccaggacattctcctgccagagcctgctttagtgtccagtcctgttctccaaagagatggaaaaaaccaagtggaaaagtttcagtttattcaatataaggctccacattcaaatggcaaaactgctctgttcaggtcatatttcaagcccaacctatgtcagtccttagtaaaagcttcaaagcaataccagtcctttcccagcctggtttaccttgattagacaaacacagacacccatgtctgagtaagcactgagaccatggatgagtgctaaggagattaggtgtttggatagacacagctagggtgtgtgcgtgtgtgtgtgtgtgtgtgtgtgtgtgtgtgtgtagagagagagagacagaggcaaagacagagacagtgctcattgggcagaggacagagtagctgagatagtatcatttgtttattcatttgctttttcataaaatacttagtaagcacctacttggtatgtgccaacactttaataggtactagaaagagcaaaacagacagaatcacagtcttcagagaatttacagcctatggggttaattaaaccaatgattatcatagcatgtaacaaacaaaagagaaccgagaatcagctgtatggaaatgcacacaggtggcagatataaatagcagcagatacacgaatcagtgcgggtccatcatataactcctagctttagtctctaaacttaggctcccactcaactcaactcctactctaactcaagatataccataccttggtttgctctttctctaagcatcgctgttctagtcttctaaggagcaggaatataaatctacatctatgtgaaactacagcacccccaagggaaaataaagaatccagtgctattctagtaattttagggcagtagtacagtacaatgcaaagtataggcttttgaactaaattggcctgggttcaaatatgagccctctcacattctattaggttgaaccatataaaaatggagatattcaatcatttttttacagtttcacgtagttcatctctgtattctagaggtaaatcattttaacctaagtttcatttccttctgttgttagtttttttaatggtgctaatacccctacctttcagggttgtaaatgaaaagatgttaaaaaaaaatacctgacatatagtgggtgttcaataaatgttagttttcccaaagatagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgacaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatagaatcttggtcgtgtcccagaggcctctgttgatgtggcccaactgagctggccagtgagaaaacatacacataaatacccatgatctcagcgattctctcccctccccaggacattccttagcagaaccaatctctctcactcggctggagcctctctgttcacagataggcctggctgggcttaatttagcaaagggcaggccccctgcaaaagccaggggtaagtctggagcccctgtaatgccccaggacaccttgtgtggagacaggagcccagccctgccgaaggagctaaaggggatgttcagaatgtttgtttttctcagctatttaggaactggagctcacaggaaccaccctttacttccttaacttctcacataaatgttttctttgggcagcagctatagaactggaaactaagtaaaaccttactttggaatataaaaactatattaatttttctatagataaattgttgcataggaaacttgctaaatatttttaaattatctgtaacatctaacataatctgacatttatccccaaattcagctttcaattctggattgaaacatactttgatctgttctctaaaaaggacaaagccagtcactggtgttttgcaaagtctgggaccatttttcctacacagaatctcacacaataaacagacaagatattagaaactaagttctaatatctagcagtcactccttccctggaagcctggctgtgtcctgaagccaggtcctatgatcaggcaactcttctgaagctctgcttccactagagacagcacttaccctgtagactctacagatgtaccatccaggatggcaggcatgagccacatgtggctactgaacccttgagatgtgactagtccaaatcgaaatgtgctgtaaggatttcagacttagcacgcacaggagttcaaagactaactacaacaaaagaatgtgacatctcattaataattttaaaatgttgatttcatgttgaaatgataatgttttaaatgtattattaacattaatttcacatatttctttttactttttttaatgtggccatcagaaaaatttaaattacatgtatggcttatatttacgttggacagcactgttctataagatgttaggaaaaagatgtatttgctttaagtactttgcattaagacatagtctgacctgaatcacagttaatcctgtggtctcatagcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccactgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacgaggtcaggagttcgagaccagcttggtcaacatggtgaaaccccgtctctactaaagatacaaaaaaattagccaggtgtggtggtgtgtgcctgtaatcccagctacttgggaggctgaggcaggaggatcgcttgaacccaggaggcagaggttgtagtgagccgagattgcaccactgcactccagcctgggcaacagggacatactctgtctcaaacaaacaaacaaacaaacaaacaaacaaaaaaaccagaagaaagcactggcagtctcttaccgccatatcaatccatctacacatctcgggttacattctctgtctttccacttataaccatagatcaactatccatgctcctatctaaagccaaaccttccacttatgtattaattaagtcctattccccctacctctcaaaggcaacacctagaaggtctcccctgcttctctttatcaatatttcactttctaatggaaaattctgttggcatacgaacatgctattattcatttatctttctagaaatcccctatggacctcatacccttatcaggtatgccccattcctttgctctcctttgaaacaaaactcaaagtaattattcatcctcattgactccaattcttctcctcacattgtttcttaaacccactgcaagcaggcttttgtcttcaccactccaccagaattactttaatcaagatcactaatgacatccatgttgttaaatccaaaggtcaattcttttttgagacagagtcttgctctgttgcccaggctggagtgcagtggtgcaatctcggctcactgcaacctccgcctcccgggttcaagtgattctcttgcctcagcctcctgagtagctgggattacaggcatgcgccaccatgtccagctaatttttgtattttcagtagagaccgggtttcaccatgttggtcaggctggtctcaaactcctgacctcaagtgattggcccaccttggcctcccaaagtgctgggattacaggcgtgagccaccacgtctggcgggccaaaggtcaattcttaatcatcgtattactcaagctctcagcaggatttcaaaaggtggatcctgtcctcttcactacacacattcttcatttggcttccgggactccagactttttctcctacttcactggtttgtaccttctctatcttccttttctgattcttcctcttttctccaaattactaatgttggagctatacaggaccagtctctggtccttttctcttccacctggaaaggtctaactccaactcctttggtcatctcctatggtttcatggctttaaatatttaaatttaatatttaatgatctatttgctgataactcccaaatttatgtctctagccctactctatttcctgaactttagacttacgtattcaactgcttacttaatactgccacataaaatgtctagcaaatagcttacacaccaaatttccaaaactgaacccctactctccaccttcaaatctgctccatccgtagccttccctatctcagttatggcaactccatccttccagttgcttactccaaaaaccctggaattttccttgattcctttatttctctcccattctgtatccaatccattggcaaaatccttttagatttgctaccttcaccacttgttcccacatgcatcactattacctaagtctgatcactatcagcccctacatacattactgcagtgtcttcctaagagtcctcctggtgtctacttttgttctacagcctatttgcaatactgtaaccagatttatcatttcaacaagtcagacaggactggcatttgttagacccctcctctgctcaaaacccttcaataggttcccatgtcactctgagtaaaagctgaagtctttaaaatcatctacagggacttactacacaagccccataccctctggggcctcatcttccagcatgcttaatcttgattatgctgcatcagccacagtggctttcctgatgtttctctgcctggaatattcttcccccagttctctgtttggccaacttcgtcatctccttcaagttgctatttgaaaattattttctatggcatagccactttgaaaaatagttagacagtatctattcagaaaataggcagaaataccgactgggcatccctaatctaaaaattcaaaatccagcatgttccaaaatccaaaactttttgaggaccaacatgatacctcaggtggaaagctccatacctgacctcatgaaaggttgcagcaaaaatgcaggcacaacacccagtttattcagcatccccaagagaaaaacataattaccttcaggctatgtgtacaaggtgtatatgaaacataaataaatttcatgtttagacttgggtcccatccccaagatatctcattatgtatatgcaaatatttcaaaatctgaacacatctgaaaatcttctggttcaagcatttcagataagagatatttaatctatatatacttattatataacctaacagttccactactgggcatttacccaaaagaaataaaacaaagacttgttacatgaatattcatagcagcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttgaaacacgtggcaccagtaggacatatggaaacttttttggtgtgatggaagtatttttttatcttgattgtgtggtgtttgttatacagtggtatacatttgttaaaatttatctaactgcatacttaataaagtttatttaaacaaaacatgaaaggaaaaactaaaatgacatagcaagtggcaatgcaaactgccaagtgcaaagaatgagtaaagagcttggttggcatggagactaccagtctaggatgcttttattgcctcaggtcagcttggaaggccataaatgctgtgaaggtaaacctagaaacaaatcttcctgcactggtaactgtcatgtttatttgcttccctttccatcccatcctttcaaaaaaaaaaagtaaaaggtagtgtggtccacaaactaccgtgtggctccccatgatccccgcctcttggtgtttgtgcccttgtgtaactccttctctttgggtatgagcaggccctgcgacttatttctaaccaatagaatatggcaaaggtgaaggaatgtcactcctgtgattatattaaatttcaaggctctcttgcttgcagatttgctctagagcctctccttgctgacttgaagtggccatatggggaaagctcacatggcaaggaacactaggtgacttcaaggaaccctggacagcctctagccaacctctggcaagaagtcaaggccctcagtcctactgctacaaagaaatggattctgttgacagcccaagtgagctctgagtcagattcctcagtcaagcctctagaggagaatgcagcctggccaataccttggctgtagcctagggagaccctaagcagacaacccagctaagcggtgcctggattcctgacccacacacactgtgagataataaatgtgttggggggtgaaggagggatgggggtaggggtggctgtgcatttgggtatggaagggtgttttaaatcgctttctaaacacggcctctcctggccactccttaatactgcaacctgctctccactcctgtaattttttttcaacatttgttttaggttcagggggtacatgtgcaggtttgttacatgggtaacttgcatgttgcggaggtttggtgtatgaatgaacccatcacgcaggtagtaagtatagtacccaatagttagcttttcaaccctcgccccccttctaccttccactggggtaggccccagtgcttattgttcccatctttgtgtccatgtctcaaagttttgctctcacttataagtgagaacatgcagtatttggttttctgtgcctgtgttaattagcttaggataatggcctccagctgcatctcttttgctgcagaagacatgatttcattcttttaatggatgcatagtattccgtgctttatatgtaccgtatttttcctccccagtctactgttgatgtgtatctaggttgattccatgcctttgctattgtggatagtgctgcagtgaacatgtaagtgcatgtgtctttttggtagaacaatttattttcctttgggtatatatccagtaatgggattgctgggtcaaatggtagttctcttttaaattctttgagaaatcaccaaactgctttccgcagtgactgaactaatttacattctcaccaacagcgtataagcacttttctctacaaccttgccaacaccttattttttgtttttcacagtaggcattctgactggtgtgcaatggtgtctcattgtggttttgacttgcatttctctaatgatcagtgatattgagcatgagaattttttcaaatatttgttggccccatgtatgtcttccgttcatgtcctttgcccattttttagttgggacaaggtctcgatctgttgcccaggagtgcagtctgatcactggagttcagtgatgcaaacacagctcactgcagccttgacctcctaggctctagcaatccttccaccactgcctcccaaagtgctggagtttcagatttgagccaccacacctttgctcatttttgaagtggggcaagacccccacttcgtaggactattacttgattgagattaaatatgtgtaaaatgcataacatggtgcctggcttatagtaaacactaaatggatttcttcttccataggatttaaatagggagcaattttttttctatcaagagctgatcagaaataaatgggaagcatttaaatgctctccttcccctgtcccaagaggactttcactttccaacattctacatactttatttataatatttattgtttattttctgtctactcatgacagactataagttctatgaggatgggaatgcctgtatgtgcttattatatgacctaacagttccactactgggtatttacccgaaagaaataaaacaaagacttatacatgaatatattgatatatactccagtcacctccaatagaatctagaacacagtaggggcttagtacatatttttaaatgaatgaagactaatgtttagtttaaactaggattgacctattcttatcttcggcagagacagagaataactaattaccacttgtcacatattgagacttcagtacctaaaaggcattattaggtcacctgtaagtctgttttcccccaaagtaaaaatcccaattccattgcccttttcacataagcctcattttctaacctttttagtttggtttaacgaatttcctatttcctctgaattctggagttccaaaccagactcagcacaagcctaacagggcaacctatacagataaggacagcccaggcacattgcacacggcaagttgcacctgttttaagagtaaaaatgaggtcaatgccaccttgtactgcaggtacctcaatgagacaatgccaccccttcctgccacaatcttggcaaaagtcactacgaaagtaaatatcattttactagagtcctttctttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaaaatgcataacatggtgcctggcacacagtaaacacaaaacagatttcttcctctatagcatttaaatgggaagtatttagcgtttacttgccatgtgcatgagtgaatttgggaaaagtggggggaggatatggggcaaagaaggacagaaagggcctaagagtaggaagaatttaataccagaagatgggacaagacctgggtctagaaacctcttctgcagataaagtagctgcaaattatagggaaggagtcctcaggctgctttccttataaccatttattttcctgcaccttatatcaagaacgttaggcactggttaagaccctgtccccttgcagcagtagagaaaacaggaggaaggagacgggaggtagaaatttggaagctagcagttgaaggccaactcagaaagcgtcaggtggaattccattcctaattgacatcaccatcctctaactgcagcaattctctccagcccttttatgtgctccctacagaaccaagcttccacacagctgaaggaacctgtctgctctcaccccagcttcacagaagatggcagggactggttattactaacctgcctcctagtcttctgaggctccaaatggttttgtcagcaagctgagcttccccacaatcccacagactagaaggggttggaaagaacaagccttagaacaatactgctccccacctctaagggatctgctcctctgagtcccagaagttcaccgccttcatttgatttctgctacaggaagactctgggaatccagctctggacccagcacttcctgatttttgaagtagagagttgacaaccctgttgtcatcaatacaactgtgctaggtgggtgggaaaggaaaatatcttgggctcccaaaatcactaagctaaaaggaaaactcaggatcatggtggatggaagtcaggactagattgcagctccgactcggatggacagagaagcatgtggaggctcatatcatgaatttttgctccagaacgactggaggaataaattacaaaacctgagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagctcgaacacaaagtcttcaatttgacccaatccaaccaagacaaagaaaaacaaataagaaaatatgaacaaagcctccaaaaactctgggattatgttaaatgaccaaacctaagaataattggcattgctgaggaagaagagaaatctaaaagtttgaaaaacatatttgggggaataattgaggaaaatttccccaaccttgctagagacctaaacaaatacaagaagcacaaagaacacctgggaaatttattgcaaagagatcgtcacctaggcacattgtcatcaggttatctaaagttaagacaaaagaaagaatcttaagagctgtgagacaaaagaacccagtaacctatgaaggaaaacctgtcagattaacagcagatttctcagcaggaatcctacaagccagaagggattgggcccctatcttcagcatcctaaaacaaaacaattattagccgagaattttgtatccagtgaaactaagcttcatatacgaagagaagatacagtatttttcagacaaacaaatgctgagagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacagaattgcagaatggataagaattaaccgaccaactatctgctgcctttaagagactcacctaacacataagagacttatctgacacataaggactcacataaacttaaggtaaaggggtggaaaaaagacatttcatgcaaatggacaccaaaagcaaaagcaagcagaagtaactattgtttttttgttttttttggtttttttgagatggagtttcactcttgtagtccaggctggagtgcaatggcgcgatcttggcacactgcaacctccgcctcccaggttcaagcaattctcctgtgtcagcttcccaagtagctggaactacaggtgtgcaccaccatgcccagctaatttttgtatttttagtacagataggtttagtacaggcaggggtgatccgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaggccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaacacatatatacagaacattccatccaacaactgcagaatatacattctattcaacagtgcatggaactttctccaagatagaccacatggtaggccacaaaacaagccgcaataaatttaagaaaattgaaattttatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaagggaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccgggcgtggtggctcacgtctgtaatcccagcactttgggaggccaaggtgggcggatcacaaggtcaggagatcaagaccattctggctaacatggtgaagccccgtctctactaaaaatacaaaaaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttataggtgggaattgaacaatgagaacacatggacacaggaaggggaacatcacactctagggactgttgtggggtggggggaggggggagggatagcattaggagatatacctaatgctaaatgacgagataatgggtgcagcacaccagcatggcacatgtatacatatgtagctaacctgcacgttgtgcacatgtaccctaaaacttaaagtataataataataaaataaaataaataaaaaataaaaaataaaaataaaaatacaaaaaattagccggacgccatggtgggcacctgtagtcccagctactcgggaggctgaggcaggagaatggcatgaacccgggaggcggagcttgtagtgagccgagatcgcaccactgcactccagcctaggcgacagagcaagactccatctcaaaaaaaaaaaaaaaaaaaaacctagaagagatggataaattcctggaaagatacaaccctcctagcttaaatcaggaagaattagatactctgaacagaccaataacaagcaacaagattgaaatgctaatttaaacattaccaacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccatgatcaagtgggtttcataccagggatgcagggaggtttaacatacgcaagtcaataaatgtggtacaccacataaacaaaattaaaaacaaaaatcaccatgatcatctcaatagatgcagaaaaagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacacgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcacgaccaagaacccaaaagcaaatgcaataaaaacaaagacaaacagctgggacttaattaaactaaagagcttttgcacggcaaaaggaacagtcagcagagtaaacagacaacccacagagtgggagaaaatcttcacagtctgtacatctgacaaaggactaacatccagaatctacaacaaactcaaacaaatcagcaagaaaaaaacaaacaatcccatcataaagtgggctaaggatatgaatagacagttctcaaaagaagatatacaaatggccaacaaacatatgaaaaaaggctcaacatcgctaataatcagggaaatgcaaatcaaaaccacaatgtgataccaccttactcctgcaagaatggccataatcaaaaaaataaaaaaatagtagatatggatgtggatgcagtgaacagggaacacttctacactgcttgtgggaatgtaaactagtacagccactatggaaaacaatgtggagattccttaaaaaactaaaagtagaactaccatttgatccagcaatcccactacagggtatctacctagaggaaaagaagtcattatacaaaaaagatacttgaacacgcatacgtatagcagcacagttcacaactgcaaaaacgtggaaccaacccaagtgcccaccaatcaatgagtggataaagaaactgtggtgtgtatatacacacatatatatatatatatgatggatatatatatatatatatatgatagaatactactcagccaataaaaggaataaattaacgcattcacaatgatctggatgagattggagactatcattctaagtgaagtaaggcaggaaaggaaaaccaaacattgtatgttctcactcataagtgggagctaagctataaggatacaaaggcataagaatgacacagtggactttggggactcaaggggaaagggggggaagtgggtgagggataaaagatcacaaatagggtgcagtatatactgcttgggtgatgggtgcaccaaaatctcacaaatcaccactaaagaaattactcatgtaaccaaacaccatctattccccaataacctatggaaatgaaaatacaaaaaataaaaggaaaactcaagctggaaactgtttagggcaaacctgcctcccattctattcaaagttatctctctgctcactgagataaatgcatatctgattgcctcctttggaaaggctaattagaaactcaaaagaatgcaaccttttgtctctcttctgtgacctagaagccgcctcccccactgcaagttttcctgcctttgcttcaagttgtcccgcctttccagacctaaccaatgtacttcttacatacattgattgatgtctcatgtctccctagaatgtacaaaaccaagctgtgccccaaacaccttggtcacatgtcataaagacttcctgaggctatgccaggggcacgtgtcctcaaccttggcaaaataaactttctaaatttactgagacctgtctcaaattttcggagttcacagtgggcaagactagatttacttttgtgttgagcagatactgagcttgactgatgagaatctggagtgtgaggtctgacggagtaactctgagagaggaagctacctgtgtggtctcagggagaagatctgagacttaccaagaaaaagtgacctgaaagaactggctgacttcaggcccttgaccagtgcctagaccctctttctgcagctccagatcatagccatcatgctggcagcctccctgccgctcatccaggcaccttaaagaagggcttcctcttcccaagcctctgggtgggctttctaaagccctgtgtgcatgaagaggtggcttgtagccctttgcagcagcagggcttacatgaggctgggatatgaaaagctggcattacaatgcagcttgtgccttgcattcactccccacttcatcaagccaagtttctaaataacagggatagtaactgcccactgtggcccaatgtcacttctaaagttgcttggcaaaaagccacatgactattacttagctctccacagaacggcatgtaccaagtcggatcactgctgtcggtgtgtgggtggattagctgctattgaacatgatagggcgggcccctttccagtttgcaccagccccgctctgtgcctactccatgtatcatagagcctcctctctctgtgcagttgaacttgatcagatgagatggcaaaagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtgaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttaggcaaattactattctgagctttagtcatcttatctttaaaatgaagggtttattctttagaggaagctgagtgaatggcatacgggaacactctgtactatttttataactttgctataagtctaaaattatttttaaataaatggttttcttaaaaagtgaaaggattatgtagattatcttcaagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcctacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacaggacttcagaactgggagggatgtgtgcgtcaatcctggtccagcccactcatttaaacacaaagaaccagaagcccagaaaaagtgacttgccttagcctggccttcctcttgattcctttccctcaattctcccgtcctgatcaatcatcaagtcctacaaatattttacctcttaaatattttaaagatgagttgcctcccctctattcctactgccacagccctcattcgggccttcatcttctttggcttggcaagtctgttctcactcacttcctgccttgactctcttgaatccacctttcccatgcatcagagggatctagcaggttccctgcagcttaaagcccatcagtggtgccttgtcttcttcaggataaagtctacactctttaaaatggcacaaaagactgtgtccgtcatatcagtctcattcttcgcctagtacttaaatccaccaacaccaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagttgccttacactttgtacacagctctgttactgccttttactatactctagcacctgtggtttactcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatactgaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaggagattgagaccagcctggctaacgtggtgaaaacccgtctctactaaaaatatgaaaaattagcgtatgtttcacagcatctgtaatcccagctactcaggaggctggggcaggagaatcgcttgaacctgggaggtggagattgcagcaagccaagatggcgccactgcactccagcctgggccacaaagtgagactccatctcaaaaaaaaaaaaaaaagaagaaaaaagaaatgccttttcccatttcttgttatgttactaccttttaggattcaatgcaaacttcaaacacttggcaaggcctttcctggtggattttattgcactatagcaaaatctgtccatacctctatggtagcccttattataccatttttatttatttgttgatgtcttctccaccagaatctagcacagtagctggcatatagtagataatcaatagacgtttgactgaatataccaatgcatatgcgcaaatatgagcaaaaaaatgactaaaatgatattgcaaacaagggaaacatttgagacagaaatttagaatgtctatttttttcaagtgtaacatgctacttctatcagtgcataaacctgaatgtacatacactatagaaagaagtggccttgtaataagttcatgcagaagtataaattatgtagacattgttagggggataactgaaagtggattagaattaaattagggcccagaatttagtctgggatttgttttccagtggttgaaagaaaaattcctaagtattcaaagggaagaagcatttctcaacaggcaagtattatgaattctaattaaaagctctgaaaaaatgagataagttgtgttaaggaaaagcagaaaacagagttgcctttggttaagagttccactatttttataagcaactgacttttttggggaaagttgctttaagcatttttttttctgtgtgtatgtgtgagatggggtctcactctgtcacccaggctagaatgcaggagcacaatcatggctcactgcagcctcaaccttctgggctcaagcaatcctcccacctcagcctcccaagtagctggtaccacagccacacaccactatgtcagctaattaaaaaaaaaaaaatttacagagatgcagtcttgctatgtttcccaggctggtctcaaactcctgggctcaagtgatcctcccaccttggccttgcgaagtgctgggattactgacatgcgccaacatgccaggcctaaacattttgtgtgtgtgtgttaaaatatacatataataaaatttgccattttaactattttaaagtatatagttctatggcattaagtacattcacatagttgttcaaatatcactatccatctccagaactttttcccaaatgaaactgtagccactaactccccattccctcctccccacaacccctggcaaccatagttccactttctgtcttcattatttgactactctaggtacttcatttaagtgaaataataaatatttgtcctttagggactgactttacttagcatgacatctttaaggttcactcatgttacagcacatgtcagagtttcatacctttctaaggctaaataatatccagtgtctatatagcccacattttgtttatccactcatttgtcaatgaacacttgagttgcttccacctgttggctactgtaaacaatgctcctatgaacacagaaatacaaatatctatttgagttcctgttttcatttattttgtgttatacccagagtagaattgctggattatacggtaagtctatgtttaattttttgagaaactccatactggttttcacagcacctgcaccatttcacattctttctagcaatgtgcaagggttccaatttctccacatctttactagtatttgttattttctgggttgtttgatttttagtataatagccatcctaatgagtgtgaagtttgaaaaaatatttaaccaaaatcataaatattggttacaaatatttaatggatggattccctctatttctgccaactttcattccctgaaagaagaaataggtaagcatgacctcacgaacctcagaaggctgagaatggggaattggcacacacagtgtgcgtagacacagacacacatggaccatgttcatactaggcttccagagaaccatttaaaaatagtttggctaatgtaatcttgtctgtctcttatgttcctcctttcccatcatacacatttcttaaagttcgtgtaagtaaaacataggagaaaaaaacatagccactaattaaataaggcatccaagtgtaaaagaagagcaaactctgctacatataagaagacaagcattaattctggcaacagcagccacacagccactttagacaataacctgagcaggtgcatgctttctagtatgtgtctccagctatgcaggatagaaatcacaatcctttctatttatctaacgtctaatacactaaaacatgtttacccatgggggagaagagcacgacaggaattgatgactctaatttaggaaactaaggttcacagaagttaagtgacttggccaagatcatgtagctagaaaaggcaggttaagaattcaggtttccttagagttcaaaacttttatcacaacatttttgataaccccccaagatactcatccttctctaatagccttcctttggttcaagtccagcttcctaaatcctaccgcctgatggagttcctgagcttccttgtaagtctgcaggtatattgttcctcatcatgttgcccaaagcctaaagaaatcaggctaggaccaaagaaaatcagtcaatgagccaaaaagaaatttaatcaacccagcctttcttatttattttctttgaatgaacatttgtatctgagaatgccaaggtaaatttgatgcaatagggacacttggattatattatgttatttacacacaagcaaacaaaaattgagaattgagacaaataggacaaatggtcccaagtccactattgaggaaaaagaaactgatttggaataaaaaatagtccagcatgaatgtgtcagtaattaagacttatctggataagtttgccgtctctcaatttgtcacaataatggcaaatatttattgagagcttactatgtgataggcattatgctgagttcagctaattgactcatttcatcctcctctagaccctataagataggtgttattactgcccttgctttagctcagagaaattatggtatttttcccaacacaaatagtaagtagaaaaatcaagatttcaccccaggtctcgccaatttatagctcttagccgttatgcccagcaataacagaatagtaaaaacaaggacaatttggtaggcaagtaaaatcagtaggctgtttaccatagctatagaagtatgctatgcataaacctcaaagattgcgcaggaaaagtatcatccaatctcaaagatgagaaaaccaaagaagtttcaatctcagagaagtcaggcagcttaagggtcataaaacaacgcaacacaactctctcaactcatatctaagggctaagtccactttaaccttccaatatcattacatcatatttaaacattgactctatctggtcaaggacgacaacattttatttctcctgacccttttgctatcagatctggccttgtcagtttttcaatttcattcttagaatggaaacttaattcacacaagttgaacaagtagtcatcagggggcaaaacccagtggatgatggttttgtgtgctgtttggagactgggtgtttaccacacagcagtggatttcataaattccagggtcagacaagattccagtagcgacacacttgactaatatgagaaaatgcaggattaggcaatcaacaatgaggaagtcagccaagttgccacccaaaaattacttaccacagcagctgcagtccagaaatgctaacaagccagtctccctaggagtgggccatactcagctgtggaccactcacaacattttctcactttattttgcttcagagtcagtgtactgcaatgatttctcctttgcttgctttatatgtttaaaattgtcttccctaaaagctgaacttaaaattaatgtttgctaccaaaagggggtagcagtgcctagtcatgtaggcatatgtcccactctgtcggtacagagggtaagcagcctcttcctttttaaaaaatttattacgatgatttacaaaaattgaagcttacaggataaacactcaacaaaaaagtagccagtctcaagaaaccaatttttatgtatgaattaatattattttattaatccatggccaggatgattcttaagattatttcttaattctctgaacagcttaaaagagagaaactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaaagagaaagatagcacccactctccagttctcttctcccaaagttgcccgtatttcccttccctgaagccaatcaaatactttattgtttctcgctaagagtaatttttcactcttaagtacaaacagctcaacaaaaattcccggtagcataaatatgcacatcaataaaataattactactcacaatagactttccattacatatgtttcacaagcattggttttcttaaaaagaaccacgcatacagcactcaaattattgcagattctaactcagtagagtttgatttaatgtttttacaatattttttttaaagaagtgtccttccaacgctaaggaaaaaaatcagaatcaagaaaattctgtttcttagcaacagaaaaatcaaacttctgttactaagtttggtaacagaacagtactctaaattatcctctgaaccacctgatttaccatgtgatgctgggcacattgctgctaattaatcttcctaatctcgtgggatcacaatatgaataacaagaatgaacatcagacacatctgtgggaattatgagggggagattataaagagtcaaaccttgtccccatatttaaattttataataactataactactagtagaaatataactactaccctctcatatatatgtgatgttattaagtttataaagtgttttgatatgtttcttatttcatcttcatggctgctatttattcatagaaaaataattctcagtatctgtagcattattgttaatgtcaatcctatagaggctggaacaggctcagagaggctaagtaacttgcctaactaagtctcctggttgacaataggtcttaatgcagtgttttccgaatccctcgttcttacatcaaaacagaactgtggctgggtgtggtggctcatgcctgtaatcccagcaatttaggaggccaaggtgggaagatcacttgagcccaggaatttgagaccagcctgggcaacatagtgagtgagacctcaatctctgccaaaaaaaaaaaaaaaaaaatacatacacacacacacacacacacacacacacacacagacacacacatatatatataaataattagccaggtgtggtggcacacctgtggtcccagctacttgggaggctggggtgggaggatcatttgagcccaggaggtcaaggctgcagtgagtcgtgacggtgccactgcactctagcctgggtgacagagcgagaccctgtctcaaaaaataaaataaaccagaacggctctagttcctatcaatcactcatcatgacatagtgtggtaaactaatttcaactctgaatgattgataatggctttatgtgttctgtttcccaagtaataagaacattttagcacaagcctttagcgcttttcaaataatcatagccaaatgagaaaattaatatgacaggcagattgaacaaacatttggtgagaaggaagaggaggggatacagtagtttgagatccctcaaatcatatgatgcagtagctgcctgacaactctgctaacacgtaagactagatagagacagggccatatctacttcctgtatgggacccatggcaatactagagtctagcaaaagggttgtcctctctgcatgtgacaataggctgtgttccactccccccacatacaccttgtgcagctcctataatctcatttatcacacttctccaggtgagaaatggtgccttctcacaccccacccaaagttgtttcctaaagatctttcgctagggcggagcagagagtgagatcaaatgattcagacagccatctgattcagctttaaaaaaaaaaaatcctggtgggggcgcagtggctcacgcctgtaatcccagtactttgggaggctgaggcgggtggatcgcctgaggtcaggagtttgagaccagcctggccaacatggtaaaaccccgcctctattaaaaatacaaaaattagccaggtgtggtagcaggcgtctgtagtcccagctactccggagaatcgcttgaacccaggaggcggaggttgcagtgagctgagatcgtgccactgcactctagcctgggcgacagagtgagactctgtctcagaacaacaacaacaacaacaaaatcctttccctcaaattacctaagaaattgtcctttccttctttgccctgaagacagttaatggggaaagttcctccctctgcacagtgaataaatccatccactattcctaccctaaccctaaggcaaaacctcccactcatcctctgtctctcgccatctctctgttaccaaccctcacttggcaatatccttcttgacacgtggcagctccaatgaggcacactcattacatagccacgtaaaagataaaaggtgaatctggaccaacttctggaaaatttggacttaaaacatggaaatgcaggagagacaggaaatagagttaaatcccccagatttagctatacacattaattgaattaactaaataatcatttgggtctcatagacaccagctatttccctgatccaagatgttatctagcagcctgtatcgcttcccagtcatccatcctcttgacaggacagagcacacatagaaaatggtatttgtatagtcctctggggtaaacagttggagagttagaatctctgataaggtcagaggcaaccagtccccggtcacttgggccacttcaggtcctgcttgtccagacacagagagggctgaggaaaccaatattgtggtgaccagctacgaggcttaatcctcataacccatagcccaatgtcctcttatcaaggtgctgtcctatctcacccacagctcagccaatccagtaggtcttccttccccaccctgatcactgacccatcaatcaagatagccctcccatccaaggaagaggccatttcccctcccactccacccaggccaactgctatcccacaggttactctcttcttcattttaaggcaagctattccaaagactaaaaatgcctaagattctgtcttaaaagcttatctgcatagtcatcttcaaaagcaaacatgaatttctcaaggaacggaaacacccttagcccctgcccttttctccatagcatcattctctgccccaccaagccggaactaggagggcactttctctaggagaggtatgacctggagatgatctgcttcagagccacctcagggatcttgcttaaaaatgcatattttcccaggcaaagtggctcatgcctataataccaacaacagtggaggctgaggtgggaggatctaaaggccaggagtttgagaccagcctggacaacatagtgccacccctttggtacgaattttttttttttttttttttgagacagactcttgctctgtcacctaggctggagtgtagcggcgcaatcccgtctcaccgcaacctccgcctcctgggttcaagcaattctcctgcctcagcctcccaagtagcttggactacaggcatatgccaccacacccgctaatttttgtactttttaagtagagatggagtttcaccatgttggccaggctggtctcgaactcctgacctcaagccttctgtcttccttggcttcccaaagtgctgggattacaggcatgagccactgtgccctgccaatttttttttttttaattatctgggcctggtgtcctgtgcctgtggtcccagctgctcaggaggctgagccagaaggcatcacttgagcccaagagttggtggctgcagtgctatgatggtgacactgcactccagcctgagcaacagggcaagaactgtttctaaaataaataaattttaaaaatgcaaatatccaccccagccccaccctctccccccaccttcccccacattactacatcggaatccctagggtgaggcatggaatctacattttaaaccagctcccaaggtgattgttccgcacagttccacgtcagtgtttgagagaggctctgatttattccagtcctctttctttacagagaaggaaagcagaaagcaggcaccagagaggtgaaatgagcttgtccaaggtcacaggttgttaaggtgaccagagctggacgaaaccccacctctctcgctgactagcacagcgccagctaggaagagcctagaatagcgaccaactggcaggccaaaccgtcccctgcccctgcccctgcctcggagaagcgggcccctgcactcacccgcttgtagatgtcctcccggctggcctcatacttctgttgcatgcgctcctccaggaagtagatgcgcagcttgaggctgaagttctccttcttcaggtcattgaggtgctgggacagagtgcgatatccattagacatgatgggcaacccatggggaggagcgtgcccgattgccccctcaacccaggaacatggtgcagctgcaccgcagcatgaagccagccggctgggacgctgctgaggctgcggaccgagaggctggggctacggcgacatggcccctattgctggagctctctccgggactcgggactgggctcactgctctgggtgctggagcgcagcacactttccttttttacctcagggagatatttgcggaatccctgacagaggaacatgctgcgtgaactcagacacaagtggtgtaacccgactcc

SEQ ID NO: 1118 - DNA, 41442 bp, Homo sapiens
gttatggcaaagtaagctttatttaattggtagcaggagagtcacaacttcaaactccagaaaagatgaagtaaatttgcaatgatttcatacaccaagattcctcctacccaaagctgaagatatattttcaaggaaaggtgatggaaagaaaaatggtgctcgcccaagagattcttccatccagcaggcatatactttgtctatcatgagtcaagccctgatccaaaggcttgttaacttataattacactaagcatctctcctatgccaagtaatgtggcaagtattgtgagggaaatacaaatgccctaatgtaaaaagttcattccagtgtaggctgaccttctcaaaatggggtctggtcagattctccatgctaggctacaggaaagaaggctgaagaagcaaatttacaaatcagtttgcctacaattgagaattagagcaaatgacttgcaataccaggagtacttcagaccatatcaatcagaaactttcttcatatctgtgtctcctgttcatttattctgaagttaatcctgtcccacagtcattataaccatcagtgaccagccaacctcccaatctagctgtcttagagtagacatttgttcatcctgcaggtccctctctctcacccaagatcctcaatgaaatcagagagtgaggacagagggatctgtctggagggacagagatgtatataattaaagtcacaaccatcggtaaggaggactcaggagaagctgttcaagcaaaaggaaaagtggagctcatgcaagcactcaagggagaagggaaggtcgggtacagctatagcaacaagaaggtgatcctattataagaaggtgatcctactactacaaagaaactgttgagaatatgacgtatcccagacaactactcatgtccccaagtgccaaatcccaaaagatttgaggatgcttatttgggctcttcttattggttgattcgatgtctcttctttgtcttatgcagaagacatacaggcagacccagaaagcctcatttcttgtttaattttcctaatagccccaagaaagctattactggaaagtccagctgcttgtgcaggatatctaccaatgattcactttctccttaagaatcataggcacagtccatttaggagatgagattgctaaatggcatggacaaagtggagacattataggagttccggtgagtgcttgtgagatcactattggtgacttaatctctgaagtccagattattcactcttgtaacatgctagttacatcttcactgatggtgggtggaagcaatgtttcagcctcaagttctgaggtttgacaggggattgctgttgaagtaccatctgctgatcactgagtcaccatgacctcagtggtttgtcaggttgcataaggttctctttgtataatgagatttcactgagaaagattcttgctttggaagcattccaatcttcttggagtttcttcccaagcaggtcctccgccctgccacctccccgagcagcccttcgatgactccctgtcttctgtggtgcgtttcagttacaaaaagcccaaggggaatgtgtccatcgtcttgcaagtaaaaatgcttctgaagctatagctacagagaataaataggggcaaaggtgggtaggagggggaaggaagcagaagaaagagatacaatacaaaccaaagggtggattggagagaaaaatggagtgaagatatgggttggaaaggcagctgggaagttcaaggagaacaggaagatgactgagaagtagtttatgtaaaaagatatcttctcactaagtccgcaagggctgcaggagactatcagacctcagaagggctgtgtgctgtccaccctggaagtcccagaccctgacactgacttacttgctggtgactatggtgtgcagcctcctcctcaatactgtcagtgaactcagtgcttgtatcttcggtgtcatcccctgcagctgcacctggaaacaagtccagaaaagaaaagtgattcccttcacagatggcttccagacagcaggttaaattatactctttttgcccgctgactctgatttcttcctttctccatatacatggggcagaaattctccctagccagcagggctggaaagaaaaatagaactttttgtatcacagacactttcttactcatactccagcctgagcctcacaacataagctgactttgcctgcacagacccatttctaaggagccgactgtcggatgcactggttaccccactcgaatgtcaagaaagcctgaattattccccactgcctggctacataaaaactttctcttccataatatgagtccaacatgcttaaccctttccccaccactgagtgcctggagattagagctgccctgaatctctcagaggtatctattgttgggatcagttgtgcatagggtgacaatctctctgaggaacttccctctgggggtcctgtgtcctagtaaggttcaggtctagtcaagattcaagacaccaaaggattcagttgttccctaatttcttcctctaacctcccttcctcctcacctctctcaaactcttattctatgcagacaccctttgcctgaagggtttcttgcactgctttatccccgtgggatttaacccatcctttcattctccagagatggacacagccactctagggcccaaacatctacaccttgctctaaggtacaagtagctgcagtttgtggtatgggcaaaggtctaaggcagcactgaccaagaggactttctgcaatgacagcaatgttctgtgccagtgttgcccagtacagtggacacagtcatatatggctattgagctttgaaatgtgggtagtatggctcacatttcaaagcattgaatcttaaattttatttaaatttacttatatttaaatgactgcatgtggctagtggctaccctattggacagcacaaatctagggtgtgtcttcctccttatattgattaaaattaagactgttcatacattttaagaccaagagctatgttttatatactgtatttttcaggaagtgtagaaatttattatggttaatttgtcaaagaaaatttactgtgacactcactgtgtcttatagaacctccccaacttaagaatcttgaaatcttgttctgatcctagcctcggcaaccaaccagttacaactccacttctgaccactgattaacctggacctctaagagattacgtggtgagtccaaggttacacaactagccctcactagagctgcgccagtaagtcaagactctggactcttagacagaagccactcacttttccttctggtgacaaatctgatctttatctttgcttcttcctccaagaccaaagaaccttctgttgagttcagacatccaggcatgaaaggctctgcttgaatcatgagcattcactacccaatacagataaggggcttaccttatctccgtaaggaattcgacggagacaaataaatgctcatctcatctcgacactgccacacaggggttttgtttcttccccttcattctctcttttttaagctagctcacagtcttcttccattatggcagctttaagggttgctcagccttttaccaatttgaattaaaatgctgaaactttttctcccatgtttgagggggcagttcacatctatatatttgcaatggcccaggctgatctcatggaagtgctaagaggtagtaagtatgctgtgataacagcttaggtttcctcatctacaccatgaactttatgttaactttggatcaaggaagggtcctgttcagtgaagcctctaccacctctaccacttagcatctttagaggtctgtggcagacagtgtacaagagttatttccaatacttactcattcaaaccaaccccagaaaccatctcactcaggatactagctgagtagaggtgtatggacacattccctaatctttggctgctttaaaaacttactgaaaaccaggatactaatttacctaggacacccacatcatgttatgcttactttggaaaatctttccctgtacaacagtagcgatcacaatcttttatgtttttccagcaaaggaaatgaattgtctcactcagtgacagaaaacagactgttcacattgtttctcttttgaacatggggctagagaaggatcctgtagttgaagaaagcacagctctatgaggtcaggatcctcatcccctaccattgttgctgggttgtggagtcaggctgggcccacatcccaggaccattcctgccaggttccagaagcgagaattggaaagggtgactatcactggtcttgaaggtttttatctgacactttctgccctccacttatctttggcagcctttctggtgccacgtctgcattcttggataatgctccatcttatttcacttaagagcaggatgctatggttctggcttcataaggaattcgacggagacaaataaatgctcatctcatctcgacactctgccacacaggggttttgtttcttccccttcattctctcttttttaagctagctcacagtcttcttccattatggcagctttaagggttgctcagccttttaccaatttgaattaaaatgctgaaactttttctcccatgtttgaggggtaaagctaaaaaatttatagaaaatatgggaataaaagagtaagttatctcatacaaggtccatacaagacattagacatcttttaccattttccatttttttaaataaatgagagaacttctcttgtgtgatacccttttctaaacttttactgcacaacgaaacactgtcttcagaactaacttggaatattttgaatttctaatttaaggtacctatgattttatattgatgactcgtctgcttattttttgataaaatataaaatagcctgccgcctttagattctctgggagctaagaatctgttcatttaacttgcttcttcgagattaagttttacatgttagactggcaattttataaaaaacttttatttgaggcttcaataaaagttctcaacttgtggttcttggaagtttctaggctctgaacaatacaaaatggaggtgataccaagatgtcccttatttagaaaagtattttctatcagctatctaattctacaaagtacacaaaaataaacctctaaaacataagaccataaaatccttgggtgaaaatgtaagcgttatgcaaatataaggtattcttatcactgaagcaaaaattcatacttttgtagaactttttaaattgagtatggcataataattaagaacaagaactatggagatagactgtcttgatttgaattgtgcttttattgttagttatgtcacttcaggcaagtcataacctttccataactaagtttcttcatttaataattagggttaagagtgttacccactccatactgttgtgaactttaaagggtttgctgattttgaagtgcttagaacagtgcttggtacacagtgtgtactcaataaataccatccttaaacaatattattattgttattgtaagtaaactgaagtagtccatgggcttataagttgaagactgagaaagttgaaggccacagaacctaaatagcatcagcagaaggaagttttatacttgatgttactatctgaatgatcttgattgattctacctgcacttcttcatttctgaatacttgtttccccagcaggaggcttgaaatgacactctttgctctctgcctcacaggacattgaaaaggtaaggagtgacaactctttggctgaactctttggaataggtgccttacaaaaaggactaatcatcattaaatgataactgtcttaaaactccaacatgcacaaataagccttagggggaacttcatgacctctttttttgttttattttgctttacagatgaggtctcattatgttgcccaggttggtcttgaactgctgggctcaagggatcttcccacctcagcctccaagtaactgtgactacaggtgcatgccaccacacctggctcatgacatgttctttagtaatgagtccaaactgggtggagtcaagaccatttccccccaattctactctgtagtcattatcttcctttaagccactaatatgggataaacagaaaaggagtgatgtttttccatatagttacttagaacatagcaagagatcatattttattaattttaaaaggtgatctgaagaactaaaactttaagcatgaataagttggcagtgccaagtgttctttccttcggtaccgggcccttgtgtctaatactctcagcccaatttcactctgactcccaggtacactgccatgcgttcattacaagaacgctcacattttcacgtcatgaaccaactattgctgactttaatgttatggtgctgtaatgttatggagagaatcaaggaaaagaggcctcctatcaaactacaatttcacctgcacacattcccttcaggatcataagaaaactattaagattccatatagtcctccatagtttctgctaagaaataaaattctctatctagacagattctgatcgtggaacagaagtggtagaaaactgctgtctgcagtcaaacccctttatggtgtatctttgtctttaaattgcaacatctcttaagtagccttagggctttccagctcacatgtttcagaaagtagctgttttaagttacttgaaaaggccaaatcataatctaaaatacttttgggggtatgaaatcccattaaaattctggaaagagtttctacttctccaaaagggtaattattcaatacaactacagtcttctatccttaggctaaccaaggcacatgtaaattaggactcccaggcagaccaggagatatgaccactgcacctattttgtgatgccataattctgtaatgtcaagaaattcttcctgctcatggtctcttttattcttcaaagaaaacgagaaataggtttttctaggaatgtttagagacagcactacccaccacagttggctcctgaaacctctgtcgtgctttctgctattctcctacagcaaagaaagcaaggagggtttttaaggtaaagtagcctatgtgacatttccggggaaagtataacactgtttctttagtctcacttcttcgagaggagaaaaattcgagtttcttcttccttcctttagttaaagactcattctacgagccttgctttgacttggaatttagtaaataatcaatagactgattctcccataaggaaaaaaaagatacaagctttctctactttttttataaatatcttaagaataaaaccaaatagtttctgttggcctttgataattttattggatcagtaacaactttttgtgtttcaactaagatagctaaaattctaacacttatatgtaaaaattacactccattttagcacaaatgttaacagaaattaacagcacagtgccatgaagaaatgaaaaatacacagctttggtagggaaatggtcctggaaataatgtaatgccaagtttctgatcatttaacatatcactcacctccttcttcatctgatgttatgaaccactttatttatttatttaagacagagtttcactcttgttgcccaggctggagtgcaatggcatgatctcggctcactgcaacctccacctcccaggttcaagcgtgaagttatgaatcactttaattcttcttaacaacccacaaaagtttaagtgaaaactagtaagacttcatggacacagatagaaactcataatttataaaacatgctggtataaatgcatgcctacaaaggttatagattgagaaagaggtcaatatcttggagctatgactttgattattgtaaaaagaagcactacatattcatgttatatactaaaagtaaacctacaaggaagccaatatggtttatgtacttaaaacccctattctccatattattttaaatacaacattttctgatgttgctgaactttctattttacccttccagttttagtaagaggaaaacagtatgataaagatttttacttctggaatttgactttaaacaaaaaaaagggagagtaacacaaaaataatcagtatatcactttataagtttaattattcttatttgaaaacgggtagaattagtattgtcaggaccacagttttgtgttcccttccatttcccattctttgttggagacaaattacaaagctattttttatttagaaaattgatcttggcccaggtgagaacagggagaagttgaagacttaccttctgttaatacttagattacttaaaagcaacaggcttgttatttgatcataataaaatgttttaacaaagctactggtgcaaagggtgagaaggtggcttaaatccacattctaaaacacattataactgaaataactgaaatatacactatataaaaaacattataactgaaatatacagaaatcactcgaatatattatcctactgactcattccttctgtttattactgtattgccacattggagttccatatttccagctattctttctacggtacaaatggttccacactaccaaagagaaaagaaaagctcactgagctttaaccctgagagaactcagagaaaatactctgtgctggtatctcacaggatatacctggaaaagaaaactaatttcatttgttctatctctagtacaatttctacaaggtaaaatggaaaactcacttcaagtgtgtgggttactaatatttcttcctaacttcacaggaagtttgtcacctttccttgcaggatactgactgtaaacctgcagaatactacatgataccctacttgaaaaggccacttgagcttttcagggatgccaaatgtcaagattttgtgactgttttctataaaaagaccatgaaacgagaaaacaagtttatcctatcaatgggaactagagttttctaatactacctcaagaaaagcaaaggtattattgttctctctaaggcttacagtccaaaggaaagtgactttaggtagctcagtcaacctttatttctcaatgaaaaggacaattttcagtataatgtgatctgctactcctttccacaatcagaagactccagattcaactggaagatcaacatagagagaactgaaatcagtcttcttgaacagtttttgaagctatgaaccaaacatctcatgacccagacactgaattaggaggatgaatgagcataaaagtgataggtttttttatgtacatcggccacagagtttacttatgcataaactgtgtaaatagaatatactaaagaaccctcaaggaaactaattcttatgatgaggaactcatatcctctacaggttaagattttctggatccttaatagatctcttgctatatataatgtaatagaaacatcttttaaaaatataaataaggaaaaatgtatttcctctaagaagcaaaggtcctgaaaaaattactgctgtccacaactgaatgaagagaagagggtgtggagaaggttgggtgacagataagagtacacactatcaaaggaaaaggctgacctactaacttagtccaataatgtcttttcaaaaaagttataacttggctatctaaaaagagaacatcagatgaatgttgatttatactaggtactaataatcatcaaattttcaatactataaactttcaatagaaaagagtttagggacaatatctatctaaggacatttatttcactcattaaataagtcctcttggaggttcttttcaactctatacttctaaaacctacagacttcatctaccctgaactcttagaaccattactctgcattatttgctattattcaaaagggaagcatgagaaaaacaaaatctatcatatggatttttttctcaatttaagttctatgcttccaattaagcatggcctaagtaaaaatttacttcattatttttatttgaagactatttttactcaagcacaggttctataagcacacgatgctttatttaaaattactgtcattgaaaaatgactgtcaaaggtaaaataatccagtatgagaaagagtctgtgctcctgtagagaaaatggaatattatatcatgctaaatattattaaatgatgtgtccaaccacagcatgatctctgtgtggattataaaatttatcagactcatgctctctaatcagatgccaaattatcacacaaagttgttagaccagcaagctctctccagataacactgtttgcaagcctcattccagctatctagacccgaaaaagttagtaccatattctagtcacatttatgacattaagatcagacttttaatttatcctgctatcaatttactcttgctggaggttgacagaagtaggagtgattattaacataaactgtaatcactatgagccattagaaatgaagaatcacccagagctgaatcttactagcgattcagaaggcttccttggttggtctattagtaaaattaaggaaagatgttccctaaatgccttgttgtaatgacacgacaaactagtctttgatgggttgacatttctacggctccattaccttcctctttacttatggaaagttacaaaaaattttgtgcaagaaagggtctcttaaaattgggagactaagaaaagtggatggatcggcctacacttcctatctccttccttaaatgactcctttttcctcaaaagccattgaaactgaaatggcagatccattaagagtaaggcttatggctattaatcttttgcaaatgacttaatcagaagattccagagtgcttccccagtagagcattttctccctgtccactctagtttgactgatgctctatctgttatagacacagctaaagttacagaaacagatgaaatttagaatgtaatacaagccatgtcaacatgtgaaagaaataaagtgtcatgtaaaaaaaaaatggaaggaaaaaaaatcattgtgccccacttagtttagaaagggtattcagtcacatttactgtgctagaaagcctcaatccctgttcccaaattccatatttaaagtaactgaaacctcagcttctaacctaggaaacttccaaccagaggaaatgaaaacaaattcatgatgttgatctcacaaagctgcaaagcaatcttggttacttttcacacttgacattcaagacatcagaaatacaatctccagtgcccctctccttatacctgtcacgctgccacaagaaagcactgaggcaatgattaaaactataaacatacatctgtaacatttctttctaaactattctagcacttcaaagcctgaagcctattactgttatatggagaaatgtatacatactaaatagtgaaaaacataggaccctatctagtgccacaaatgaaagaagcaataccctcttctggctataatgagttatttggtgaaacactgaatgtaaagagggatactacatttgaaattatctttgtaaacagagaattctgactctggaagaccattctagaagtcatgttctgactaaatagcatgagcttggtttaaagaaacctaaaggaatcaataaagaacaaattttaagtagaatttaatctgtacctaatctaatttcacttgtgtacaacagtcaactctgagacagtattggagataaaagttgactatgatcactttcatagttcttgcctctgttctttaacttggccttcccaatacttgcagtctactattacaagactactctcctggttttgattaccttctgataaggattatatcacttttgcaaagtcattcttatagactctcaatctctttcccgctctctcatcttaaaacttgcatgcttttgatttaaaaaatgctctcactcaaagaggagttgactgaatggcaaaaataatacacacacatgcatttatgatatgatatggaacatatgaaatggattgtgaaagttggggaagaataaactttattggcccacagaagggatgagggaacgagaaggggctagggataagaatgaataaaagtggaaaaactaaaacagaatgatttaaaatgtgcaaatacactttgcaacctccaccattcaatttagggattgatatgtatgtacagtgagatccatgtaggctaaagtgagtttcactttgtagttgatgctacttgtaccagttctatcattagtaagtcaccgtttaattctgccaaaatcagacaaggatctttctggttagtgcaaacaaggttttccatcctgggctgcagtctgacccgccagtgctcagtaggcatgcttgtgatgaattcgcacactttccagttccccacctccaatggcggccagggtctccagcctgtttaagcgctccaagcttcttccaagaacttcttctagccgactgcgtaacacctgagccccttccagttccacctgcagagttcggtctctctcagagctgattaaacatgccacatggaaggaaagtggattagccatcaactgtagtgagtccacatttgtttccaaagaaccatcaataccactttgagccacacgactttgtaaagtaattgttctccaggacacaataaatgaatgtagtctttgtgtggcatttgtgttcactgctgatagattagtaaggactgttgctttttttaaaagcttgccccttatgctagattctgggccaatttcacataaaattatagctcctaagacttatctcacacccctatagcccaaacaagagaaatttcattatttggctaaaagcttttgtttctgaaaaactaaaacccaggacaaactaaatataaactggagcaagactgagccaagtagaaccactactgaagatatttgttttctcatttgttaccaaacttgacggtgggatggtgtgctgaaaaggaatctggttcataaaaactaaagctccagaggttctttaaaaagtaacacaatcaactggtcctatcatacctttcctctgccttcattttcctggtagaaagaaaacatttttaaagcccaacaataaattacaagaaactgaatagcaaaaataataataataataaaaattgaaaaagaataaaaggggctagtagggaaggcaaaatgagaaaacaaaaatgaagagaatataaaatgatccagagaggtatcatatatgtgaccaaaaatcaagaggtagaagaaaaatatattcatcatgatagctattggtggtcccaggatgatattagccatcccaattaatatattttctttgatgatattaaatgaatatcagtgcccattatagccttactctttttctttttttttgagacggagtctcgctctgttgcccaggatggagtgcagtggtgtgaacccagctcactgcaacctctgcctcccaggttcaagtgtgtctcctgcctcagcttcccgagtagctgggactacaggcgcgcgctacctcacccagctaatttttgtatttttagtagagacagggcatagccttacgtttataatagaacagcctttaacaggacatggatcacagaaaagaaatgaacatacattgagtgcttactacatgcaaggcattgttttagacacaaaagctgtcttcttatttaatctctgcaatagctgtgtgaaacaggcactaatcccaacttaagattttgacactgaggctcagagcaatccataaaacaaatgacaaagtgggtagccccggtaattgtccctcttttttctcccctcttcagtatcataagcatctgcacttaatgaagaataaaaggcataaatacaatagtaaaagaaataaaaatttcaataaagaataaaagaaaaaacagcctctctcttacctctctggatgggcatggaacttcaccagactgctatagagctgtctctctgcttgtaaggcctcattgagccgactccgttcatctactagtccttctagcatcagcagcaactgagtaaagaagagagaggaagcaatacgcaaatggcacagtgagacatgaataagaaacaagaaaatgcattagcatgtactatgacttaaaaagcccactatcttagtacttaagcttttgatactattttatagttttcaaatcaatgtcatattatcttttttttatctttaaaacctgtaaggtggaattcaaacatgggagcaaaaagaagaaaaagcagagagaagctggaagcacaggaaagcagctaagaaaaaggagtaagagggaaacaggatggacaagagggaaatgtatataataggacttactagtattcttcattcattcaattaatatttactgagcacgttctacgggacagactctgttctaggttctaggggaaagcttactatctagtggaggaaaaagacattcattaatcatagatgtgtgtcattgtgagtgtaataagtgctataaagataatgagctatgacaatgtataatcaacagagttgtttaaggtacagttaaaagccagaatgcagtggggtgagtagttagtgagacagatgataatggagacagggagtacaggcaagtaagtcttttggaaaagtctggcattgaagaaaggttaaatggggctgtagctacagagaaatttggggcaaatgtaggggtttctttctcttttttttttttttttaactgggagagatctgaacatggttaaatgcagataaaagagaaagattcagttgagggaggtgacttaggtatgagtgtgagggataactattggtatgtgtccaaaagaactgctgctcttttcagaactacaaatgtcagaaaggggcatctatagctgctaccgaccaaagtaggaaattttagagcacagtttctctaggaaataccatcaactaaccctccacaaatagctgagattgacagctttaccatggtttatttcacagtagaaaaataaggtttgagccgggcgtggtggtgtgcacctgcagctccagctactcaggaggctgaggcaggaagattccttgagccccagagtttgaggctgcagtgagctgtgatcataccactgcactcctgcctgggtgacacagtgagaccttgtctcaatgtggtgactcatgcttgtatgtaattccagcactttgaggggccgaggaggatggatcacttgcagtcaggagttcaagactagcctgaccaacatggtgaaactccatctctactaaaaaaaaaaaaaagaatacaaaaaaatgtaaataaataaataaggtttatattccagtaacttacctgttgtcttcggtttcctgaaatttcttgaccctgggattctactgaagcaactttttcccgaagaagtaagacttcctgggtcaggcgttccatagctggtatgtcttcaggatcaaccagttgcatttgcaggtcctagaagtcaaaaaataagtatggatgtgaaaatagtaataaaaggattattcagcagagtagcacgggaacaaatgtcttgaaatattctgcctatactttcaagtgggatatggataatcactggccaagggattcgatgtgtgcaaatattgtctgaagaggccctacaggtattctgagctgtgaacatttccagtggtctttaaaaagttttgaaagacctttatgagatcttctttaatctgtatgttcctggtcagagactccatatcagcagcctgcacctgcagctcttcttcctgcacagccatcatggactgtagagcagaaagttccatctgtgaaaagaggaaacaatgtctgccatgtttacattttaacactgaggcaaatgcttttgcatatcctattactatcagccagtaatggaaaagaaaatgagaacatgaatagggctctacagcatcaaaccaataatccatgcagtatagtaacaaaggaagttttatgggaagatgtcatagttgttcttaatgatgtcttctactttagctggcactataaaacacatcaaatttgtttaacaagcttattatgatactgaaaaagaatggttaccattagcagaagcaagaagagatgaagtttttatgtaagtaaaacttcacctaacagatgaaaaaatgatagcattaggatatctccattttgcaacccttaatgaattaagggataaggcatcaaacagcaacagctgctaacatcacgagagatcaccaaacattacatgactcctgatggaagaacacgccaccacctgtgaagaaatactgccaaaagttggcactacatgccctaaactttcagtgttctcatcagaaaatgacaagtacttggttatgacaaacttcattaaaaatcataataggccaggcgtggtagctcacacctgtaatcccagcactttgggaggctgaggtgggcggatcatgaggtcaggagttcgagaccagcctgaccaacatggtgaaacccatctctactaaaaatacaaaaactagccgagcgtggtggtgtgtgtctgtaatcctagctactcaggaggctgaggcaagagaatcgcttgaacccaggaggcagaggttgcaatgagccaagatcgtgccactgcactccagcctggcaacagagcgagactccatctcaaaaaaaaaatcatgataacaaccatagctgctaacacttactatgccctgggctctctaataaatgctttgtatagatttaatccttttaacaaacctagtgatctggctcctgcctacttttcctactttaatatctgccattttactgctcactcatgactctgtaggcacattagactttttctgttccaggaacaccagactttctcttgactcggcctttacaactactccctttgcctgaaatatctttctcagggctgcctccttttcatccttaggtcccagcttacgtgtcatctgctcagagaagccttctttggccaccctatttaagatggtctccatccatgttgctttctatcatttccctcatatcacttactatactctataactataatgtttatttatttattgtctgtatctccccaatagaaattaactacacagagccacagaccttactgatttcattcactacctacctcatccccagcactagcccaagcttagagaaggtccccatatagctaatgaatgaatgagtgaatcctcacaacaatcctatgagataactactcttttatttatacataaggtgacttcttctactcttcaacttacagacaaggtgatttgagtctgagagaaattaagaaacttgttcaaaaatcacagggctggctagtaagtggtaaatccagaacgtgaactcagggaagctgactcagagccactaggctataatatctttcctgtagataccacatatccatacaatctttatggtaagacaagttattttaaataaaacctttaaaggaatttagcaatagctaaatatcacccaaaatacccattcataggcattacaatttcatgatcctgaaaacaggacagaaccaaaaagtaacattactctggatttgataaatgtgagaaaaacaggaagaggatgtggaaactaaaatatctgacatgaataatcagataacggctaaggtagaaccacaaaaaggaagggggactaggggatttttaaaactggtatttcttaaatgccacacattctcatatcctgaaaactaattgagtcataaaacatgagtctgtttgtaagcagaaatatgacaatgaaatcaaaagataaaatatgataattctgtcacaaatacaaacacaggttttatattatagatctagctatggcaaaaggtagaaaaaaactaagagctatttggactagctagctaaactgaatttaggaagccatgacattgagtgatcttctaaaagagatgccagcatagtaacaaacaagcttttagtttcagtctgtaactctgagctgtggtcctagtatttcttcaacatcatagttgaatatgcaactagctgtggaggaaaggcagggggaagggaatctctaaggctgaaaggcctcttccaaaaaaaattgaagagaactctatgctagagcgagttaaagcataaggtgggaaaaatgtgctctaggaaatgaatcttcttaggaagtatgtgaagtcacaaaaggcttgagtttgaatcatagctctggcatttattagttacatgactattctccactcccattttaaaagagaaatcagtgtttcagcttcttcgtctataataattgggccgacaccacttactttgtgtagagttgtgagcattagtgctaatttaaatacctagcacagtacattgcacatgaatacttgataaacactgattatactcaaatttctcgtttcatgtttctaaatctaatttcacggatctaatgtcataactctaagcagcaatcacacagcgcttccttttttcaccagtgctttacaattattattattattattattatcttggaggcggagttttgctcttgttgcccaggctggagtgtgatggcacgatctcagctcactgcaacctctgcctcccgggttcaagtgattctcctgcctgaggctcccgagtagctgggattacaggcgcccgccactacacctggctaatttttgtatttttagtaaagacagggtttcgtcatattggccaggctggtctcgaactcctgttcgagcggatcaagtgatccgcccacctcggcctcccaaagtgctgtgattacaggcatgagccactgcacccggcctttacaattattttattccagttagcaatggggagagagggttacgtttttccagcatttaataagttttaatggtcccaatctaaaaacaggagcatctttttgagataatgtatatataaaataacttatatttttctccaaaaagaaaaaagtcatacctggcatttggactcagatattatacatggagaattatatgcttttaaatataaactattttgaaagaaaaaaataatagggattttggaattaagacttaactaaaaaactcacctgactttctctttcttttttagccatgagttcaagttcctctttggcattactcagttctttttccagccctgcaactgtgtccaagtctcctaaaatgaaaatatagcactagttttaattgctattaacataatgtggtatctgctgcctcctttgagtaatttacagaggacacattccaataataagaaaaaagaaaacatacacacaagttgttctttatagcattatttataatagcaaaatactgcaatcatcctagatgctataaagaaaagattgaataaactatagtatattcacagatggcactatatactgatgtaaaaaaagaataaggatgatctttatgaatttatatggagtgattttgagattttaagaatatgttaagtaaaaacaagctatgtgcttaagaatacatctaaagtagtaggttttctattaggaaaaaggggaaataagaatgtacatatatacattacatatacgcagatgattcatttgcttatttttgcaaaaagatatacaggaagaataacccagaaatgaaactgattacctgcaggagatgagtggaaacaggagagaaggaacaggaaaatattggacatctgagtatatcattttatatactagagttttgaactgtgtaaatgtttaatttttaatgtgtaagtcagtttgacaatgaatgagagagaaaaggtctaaaattgaatactaatataaataaataaatctatatagcaaatagataacaaaaccatccagaagataataaaaaaattaatccaaataatttttgaactcactactactctaactgaacactgtcagtgcaaaatatcctaaggataaaaagaattacaaaaaaatcttaaacattacttaatacatttattgttgatggtgatatttatgtaacaattccaaaaatacttttgcatattatagtattctgcaactgtgtaaatattttgaaatatattgatgctataagtaaccagggctctcaaggagatacaaatatgaaatgagggaaaaaagaacctatattgttaaattggaattaaggaaatcagtatcaaatcttcacatatatacaaatacacacatacatacttaaaaatattcattgctagttctgttctcttaaaagggcctagaagcggctgggcgcagtggctcacatctgtaatctcagtactttgggaggccgaggagggcggatcacgaggtcaggagattgagaccatcctggctaacacggtgaaaccccgtctctactaaaaatacaaaaaaattagctgggtgtggtggctggcgcctgtagtcccagctactcgagaggtgagcagagagatcgtgccactgcactcccacctgggtgacagagcgagactccgtctcaaaaaaaaaaaaggtcctagaagcaaaaggcattcatgtagcaatgaacacatcttgtgtccagatcatagtttctgaatgccattacccaccaaaaggaaccagggagctctttaggataatggctgattctgggactgaggcaggtaaagcaaaaggtaatcatagaacatcttattgtgccagaaactatcaaactatgctaacattatatatatatataacattagtaggtgatgtcaagttacagtgagtggccccagacttgaaacgatacccaggaaaaggtgtcagctcatggccctgctgtgcaggattggaacaattacctcctgcatttctgaatccctgcaaagctatctgaaaaggagagtaaggatagaatttctctgggccgaattgtgaacccagagcaatcagctcaactcaacataaggtaaggacagttcttcagcctttcagaggaattccaaacttatttgttctattaaggtaggaagagaaaagagtcttggccaaacctataatacagagattactagaagaaaaaacaagagaaaaacaaagtcccttaatgaaatgaaatttgatacttacctaatgtggatctgggtatgctgacatcctctttggcagtcaatgaagtgctatcatctctggaaggtatctgcattgaaccctaaaaaattgcaaaagtcaggggacttaggaagatgcaggaactatgatcacaatgacagtactgagaatattctcagaatttggtattaaaattatcaaacttacacctcaaatgtaaaaaggaaatggaatcagcatgaattatgtaagtctatagttcttacttgatcagtctgttttccaagacagccagtgggggtaacttcagcttgttggttagagatgggtgcttgggacatcagggagtctctccctcctaaatattggcgcagggcctgtaattctgaatttctttccattaaggcttgcaccaacttctctgcagcagcctagtaagaggaaatcacaaataacattataaagatattctagtaaaacaaattttttgttctggtattatttcttcaaagtcaaccatttgtaaaaaacaaacaacaatgacaacaacaaaaaacagtgggtccttaggaaatagtttccttgctttcagtttacagggaaaaacagagttaagtgaatggaaagaaagtctcataggcagaatattgggaaaaaaaaactgaatttaacacatctgtaacagataagagaatctgaaataggttctgctacaactatcaggctaaggtgttaagattctggtttgaattagtataacaaatgtctttattctcggatagttgcttcttaggggtggattccttttcactcaaacatttgtgtggtttgctcccttcaggtctttgccaaatgtcaccttatcaggttggtctttcctgcgtatcctatccaaaacagcaatcttgctggccaaagtataagatgaatatgttttggggatccaatgatagcatggtgactttagttaataatactgtattatttacttgaaatttgctaagagagtagatcttaagtggtttcaccatacacgcataaaatgtgtagtgacggatgtgttaatttgtggcaatcacttcaaaatgtatatgtatatcaacacatcatgctgtacaccttgagtatatacaatatttgtcaattatactttaataaagctgggaaaaaaatttttttaaaacccagcaatctcttctctatctccaacacttcttactgtgcttaattttttttcgatgcacttaccattatctaatagatctctctctctgcttcccctacatggaatgtaagtttcctaaaggcaatttggtgctgaatctcaagcacccagtacggtgtctggcacataataggcacacactacatatttactgaatgaatcaattacgcacataaacatgtttatcagaccacatgattaggataatctcaacctcaaaatcacccaactcagcttgtttcatttcaaatcccagttttctaagacagatgatgacacactaagggaaagatctagaacatttttaactattaatgcacaggaagtctgcatttaaacagaaaatctggaaataataaattgatattaaaattactgagggtctaagatgatgaatcataacaccaactgtctctgaggaaaagtactattgttttagggcagaagctgagctcttgtcacaatttctaggggaaatatgaaaaaaccttccacttttcagtaagtaaaatttgggctctttggagatttgaatttaactattttagacgtatcagaatattattaaagtaccttaataaaaatatctgtgaaaactgtggggaaaaaacataataaataatatacaagatatatactgtgctctatctgccttggcactccttttctcgtagtatttaagagtttttagcagtgctcctccaatgcagtccccgaacctgcagcatcactatcacctggaaacttgttagaaatgcaaattcttaagtcccacctatacctcgtaatttctttctctggagttgagctccacaatctacatctttaaaaagctattcaggtgatttcttttgcacgtaaatttagagaagcagatctagaagaatacaaccattaatcttcttgagttgaaaaatctcctgtaatttccatcatctccattattctattaccagcagtgcataattttttttctgaggtataataaagaccaattgtcccaaatcacaaagaagttaaaaagaaaactcaaagatcctagcctcttgccaaagatttaaataatttagaataattttgttaggtctattttagaaacaatttctgaagcacacagcaggacctttctagaaagatgtgtatttacttcagtgggcctaacaattagaatagtggagtataatcctttcacaacataagaaaacataagaaaatattatggggtcaaataacataggcaaaaaagagtctatcttcctctaaaaactgactacggggattctgagctactggtatctgaaatgcagcacaagtcaactaagagtttttagccttgaggagaaaacacatagaaatgaggaaaaattaacactttactatgggcagggcatggtggctcacgcctgtaatcccagcactttgggaggctgagatgggtggatcacttgaggccaggaatcgtaagccagcctggccaacatggtgaaaccccatctctactaaaaatacaaaacttagcgggcatggtggtgcatgcctgtaatcccagctacttgggaggctgaagcagaagaattgcttgaacccaggaggcagaggttgcagtgagccaagattgcgccatcgcactccagctgggtgacagagggagatgccatctcaaaaaaaaaaaaaaaaaagaatttacttcttaaatattgtgaaattaatataccctgtactattatgagattgtttattctcaccatgacctctgaaaaatgcgatcttttttccctcttaactcagattttacaaaaactaagagtaaacatgttgagtgtaagttttcccataccttgactggaaatgcaaaatatcactcaagtcttaacaatttagaatcaaaatcgaaacactcacaacccctactcctttctctcaaaattatcagattattaaggaaaagaaaatgtatgtaatgaagttaatggatacatgtattgtttaggcacccttccaaatgcaaggttttcaagaaatgtgtcatactttgatgattaatgtaaaactgtggtctaaggccaggcgcagcagctcacacgtatagtcccagcactttgggaagccaaggcaggatgattgcttgagcccaggagtttgagaccagcctgtgcaacacagcgaaacccccatctctaaataagtaagtaaataaataaaactgtggtttaggtaataaatagaaggaaagaaactaacagagttgacggtaaaatatataaatatacacacatctatagtctgcaaatgcttcctatttgcagactataaatgcactacatgacacttgtctgatctgtgcattaatccttacttggctttcctgctccctggtgctcacagactgaagcaggccttgaatctccatttcatgttccagcacttgtttatttcgatcacttagaaggtcctgcagcatcctttcctttcgctgtagacgctggcacagctcctctgctatctcactctgccctggtccaagtttgcagagcagtgttgcactaagatcctaatgcagaaaggacactgtaagcttctggaggaaagaaatgcctctgctaaatatcaaagggcttataagaatctatcatagaagaaggaggtgtgagattcttgagaataagtatcatgttttactcatttttgttttaccagatctagcacaggcctgctacacagaagtctctaaatacatgtcccaggaatgaatacaaaccatacagaaaactatctctggtggccacttacatacatattgttttctgaaataagtctttttcctatttgttcagggcatgtaacaattaatgttagatgaggataaatggacactcagttcatttatttgttttctccccagtgtaacttaacagggggaagcataaaacgataagctgaaaggaatactaaacactatatttgctatcatagcgatggtttctatttctgtactaactgatggcacatggtggaggaatggagccatactgcctaggttgatactggatctgctacttattagctatgttagcttggacaagttacttagcttcagaagtctgtttcctcctctataaaaaggaataatagaaagtacctcatggacttgtgaggatccaatgagttaatatccattaggatcttaaaacagtacctgacccagcatgaagactataactaataaaggttagctatcatgttaaagatgcaatttttgggtctcattaattctcacataagttctttgagaaagttaattgccaacttaagtttctagacgtggggaaaaaaaaaatcccagtgaaagtcaatgacttgcccaggcacagaatgaaattaaagacttgggtcacagtcctcccaatctgaagagtcctaatccaaggctgagattacataatcactgaaccaactgccttaaagttaactgaagtcttgcctccacttctttgttcctatcatgaagagacgtctgtaactgctgaatgatactctcttgttccttctgccaacggctaaatttggtttccatttcttctttcagccactggaggttttgacaggtagtagataactgttccacttccaggcctttggccctcaggagactctccatactctacagccataaagagagcaataatcagtcaaaatgattaccccatactcctcaggataaacaagaaattagatccacttttaaataatctcccatcaatttttttttatttgcaagatgagaacattgatctaacaatgccatactaatctatttttttggtttttagaaacttttatctagtttgtggagagattaaatatagaatatatgataaaaggaagtattttggaggaagtgcactaagctataaaggatttctcgaaaaagtggcagatagatacataagctctaaaataaatatgcaaaaaagtccacagtaaatatagataaacaagtgttctaattatggcaattcatggacatgtagataatattaatgtagaagacacaatttaataattgcaccctggtaatgcttcagtaaaagtaagagagagagagaagagcgtgtgtgtatgtatacttatgtatgaacaagaattggaaataaatcagaactatgtaaacagaaatcaatatttactggctctcctcacaaagttcatattacaaaagaaaagtagaagcgctaaaatctctcacttgctaattgacaatgatggaactagtaactgctctttttggttttcttcccccttataaagcaaaatccctggttttcagaaaatgatggaagggggtcatgcttcaggctcaggatacaagtgggagaggaacaccaagtcagagataggttttgctcttacttgcatagtagcttcattggaggagaggacatcgcgcagtctctctaagtcatgatctcgctctctcacagcaagacgaagctggcgcagttctttttctttctcttctagagcagagaatttttcatctatagcccgctgcaaggaaaggaagactcctaaagctctgtaagatttactatcctgatcactcttattcaacaagatggcagaatagaaaaccaaatcccaaagcagcaaatttaagcaaacacaaatttctataatacctatgtagatagaataatccatagcatagtgggcgaaatgatgatacatacctccagagcaacagctttatcatgtattcgctggcgaagtttctcaagcaacatttcatttgcttcaagggttttgtctgagttatctcgatactgtaggagctcccgaaattcctgagaccaaaaatagtttcttttattcttttatccaatattaactaaattaccaagtaatttgctagttattcaggataaaaaaaaaacaagatgtgatcactctcctcaaaagtaacaagtttagcagagataacagacatataaactgtaaactattctgcaacatacaacagacacaacacatagaattaactgttctgcaacatacgctagccaccaggggaacacaggatgcactgcctaactctgcctgaaggtgtcagtaaagacctcacagaggaggtaatatttgcagtgagtcttaattaaaggactaggatttcctaagtgaagaagggagaggaggatacgttagagaaaaaaaaatatgcacactatgcatacaatgaaaaaattgtacattcagtgaaatgtagtggattcaatgtgactgaagcttagagtaggtggcagaacagatcagtctcttcttaatgctccatcttcccctcaaacttttattctatcatcaaaattactctgtggaagtttctgtacagtttgtcttcatctattaaactgagatcagtagccaaatcttttgtcttcccaacacccagaaaagtgtttgattcacagaggtgcttaataactattttctgaatattaagtctttataaaagacttcataaaagactgcttaagtcagggctatatgtactgtttcttatacttgttagtaagcatcttaattcacaaattatattttctatttattttaaatcctcctgattcccacctctctcaatgttttccatatggcagggactcagcacaggtggattaatatcttaaaattatataaacaaatttcagagttctatgagcccagttttcattgaaatcatgtaaactcacctgaagcaactgctccttgtgactcagactatggtttaggtgctggatgttttgttcctgggttcgaatctcattgtatttttcagcctcccaggcacgaagctgttggctcttattctgcaattcttcttgtagctgctgcaaggcttttcgcaattcctgaattaaacatattacctttttaaagagatctaaaattgtcacatggttattagatacagaggccttaaaattttcaaggtatataaactgaaagaggagcagagggtgccattattaaaattgctatagaagtattatacatgaattgaataggatatggaaaattgtaaaagttgtgaatggggtaggaagtaagcttgatattatagttcaatacttattttttggcttaaaaagaatacatctatagaaccattaagtgagaatctgtcctacggtaaacctggattatttacaataagctcaaggataaactattcctatcatccttttttctaaagatctcatagagaccatcactcttctttcttagtttgccatatttatttttctaataataaagtcagtaatctttaaatcatctgttactttagaaagctaccaaatacatattctcaactaaacaaatcttggggaaatgtttcctttagctaaataacaaaaagttaagaattatttctacctccatccctccaccactccccgaccctgcccagacatctgaaattttaatatttcttttttttgagatggagtctcactctgttgcccatgctgaagtgcagtggtacaatctcggctcactgcaacctccgccttccgggttcaagcatttctgtgcctcagcctcccaagtagctgggattaaaggctcctgccaccacgctgggctaatttttgtatttttagtagagacggggtttcaccatcttggccaggctggtcttgaactactgaccacatgatccacccacctcggcctcccaaagtgctgggattacaggcgtgagccactgtgcccagccaaaattttaatatttcaaaaggaaattcagggctaatatttgatctccaaaccactaaaccagggagatccttcaaaaattacttttaaacctgagtgttaaagagcttaagaagagaccacacacaaaaaaatcttttaaatcttaaacaaacacatacactctgacctaacaagataaaggaaccatttaagagttgtgtattttggcccagcgtggtggctcacgcctgtaatctcaccactttggaaggccaaggtgggcagatcaccagaggtcgggagtttgagaccaacctgaccaacatggagaaaccctgtctctactaaaaatacaaaattagccaggcgtggtggcgcatgcctgtaatcccagctaccaggaggctgaagcaggagaatcgcttgaacccgggaggtggaggttgcagtgagccgagattgtgtcgttgcactccagcctgggcaacaagagcaaaactctgtctcaaaaaaaaaaaaaatgaaagaaagaaagaaaagaaaagaaagagagagagagaaagaaggaaagaaagaggccgggcgcagtggctcacgcctgtaatctcagcactttgggaggctgaggcgggcggatcacgaggtcaggacatcgagaccatcctggctaacacgatgaaaccctgtctctactaaaaatgcaaaaaaaattagccgggcatggtggcggccagtgcctgtagtcccagctacttgggaggctgaggcaggagaatggcgtgaacccgagaggcggagcttgcagcgagccgagatcgcgccactgcactccagcctgggcgacagagcgagactctgtctcaaaaaaaaaaaaaaaaaaaaaaagaaggaaagaaagagagaggaaagaaagaaaagaaaagaaaagaaaagaatcgtatatttattattcaaaaataaaaaataaaaaacagggctgattattatgcatgtcattcctctgaccttagtggttcttccccacttttctgcctggttttacccatccttcaagaataacctcagatgtctcctccttcatgaagttttccttgattccttttccttgactcctttcctagatattcctgtaggaccccatatatacatccccttcagaatttaccacactgaaactcagcttatgtgactgtctctcttactgaactataagtaacttaaaagaaaggagcctgtgctattcatccttgtatttccagggtacaactcaatacggcagtcgccccttacccacaggggatacattctaagacgcccagtggatgcctgaaaccagatagcactgaagcctgtgtatactgttttttcctgtgcatagataactatgataaaggtttacatacaaattacacatactgacagattaacaataacaataaaatagaagaattataacaacatgctgtaacaaaagttacgtgagggaggccaaggtgggcagatcacgaggtcaggagatcgagaccatcctaacacgatgaaaacctgtctctaccaaaaatacaaaaacaacattagccaggcatggtggcgggcgcctgtagtcccagctactctggaggctgaagtgggagaatggcatgaatacaggaggcggaggttgcagtgagcggagatcgcgccactgcactccaaccttggcgacagagcgagactctgtctcaaaaaagaaaagttacgtgaatgtggtctctcttaaaatatcttaatgttttttgtctgtggttgaccccagataactgaaaccatggaaagtgaaactgtggataaagagggactactgtaactagcatatggtacaagggcagcaagtgttgaactgaaatacttagattatgcaactgactcaagggttcaacacaaactgtcctgctaaaaagttatgatcagggcaaagtcagcatttagggcaataaaatagttaatgatttacctggttatgtttccaagaagcctctttctgctgttcactctcgtgtgctgcagcctctacaaattgcacacattgtttggcatcagccagttggcgctctttctgtcgtaccaccctctggagcttctgtatttcaagttggctgcagaataaagcactctgaagatcaagcagagctacctgttgctgagctggagaagtaccctctgagctctgaaaagagagtagaaatcacaatcacaaggagggcaagcactgagctcccacaaagactaaaaataaaatcaagactgcaaccaaaatggcacatccccaactgaagtctctcctgtcctacgtgaccctcacatacgtgaagttgtccaagctggctttggtgcagcatttctcgaagctttgccattgtgtcattttgaccttcaattacctggtacaactcctcagtctgaaaatgagagagggaatatcaaatatgttagtaaactaattataaattccattatatcacctgtacacattttagtaacaggactattccaaaatatcaattgagattaagctacaacttctccaggctaagacatgctagtctgacaatatccattttgacaaaatataaaatacttgtctactttgaagggaccaattgtttccacacaggtccttgattggtaaatatgttacctcacgttccctgcttttcagagtttccttgaggttctgaattgtaccatcttgcttttgagacgactcctgagcacactttagttcatagctcatttcattaagtttctcttgaagaatctgaattcagcaaagaaaaacagttttttaggtcaatgatgtcttttagcctcaaatgaataaagcctttcctcaaatctaggatttaaagaatttcttaggggatattaccttgttatttttcctacatagagtaaccattaaagtggtaagtcaatcagcaacaaaaagtagcaggagaaatgaaatacttccttcaatactaaattgtctcaattttcacgcactgtgatctctctatgatggcagccatactaggaacttgtccacatggaccaagtaggcaagtggtttctaatatggatcccttatacaaggaccaaagagcttctgctatctagcataggagagggcactataagggcacccaggccacaagttcagcatcccaaattgtagcaattttcttctaagccagacattaaaattcatgggctagaaagtagtaacaagttaagctaaaataaaaaacacagacctcctatctcagtgccttttacagtggaagactgcatgcaagtgtttttttgagacagagtctctctctgttgcccaggcctgagtgcagtggcatggtcctggctcactgcaacatccacctcctgcgttcaagcgattgtcttgcctcagcctcccgagtaggtgggattacaggtgtctgccacaacgcctggctaatttttttttattttttagtagagacagggtttcaccatgttggccaggctggtctcgaactcctgacctcgtgatccgcctgccttggcctcccaaagcactggcattacaggcatgagccactgcgccggcctgcatgcaagttttaattacacacctgaaaagcaccagaaattatgatctgtacagaacaagctaaaatcttcataagaataaagagaagaactacacttttacatgaaatattccctagagcacaaggagtacacagtattcatctcccaagtcctacaaaggttgacagactcaggctagagccagtcacatcctcaggaaaaccttgtcatctcctagggcatagtactaatcataccttgttggtggcctctgtttgctggattttttcctggagttctgccaagtgggaatcagatacagactgctgagttatagtggtctcatgtgaattcagcttttgttgtttcagcaactcttcagtcatgggctaggaagaaacggcaaggaagaaacggcaaaacgagtaaggtgagttaaacatggccaacaaaattttttttttgtcttcaaaaatgtctgttgcatcttttgccagagatttagagaatcagatttgttgcataaattatcagtatgaattcctaaagacaggtctgttccttattaagaacactgattcacctccatttgtactatgctccccagcttccctctccacttttctgtaccaattcacacaaacactacatgtttattcagcgaaagcaagtaattcagagttcaatgagaaggggaggatttaataaaggaaatgcttacaatgaccaaatatttgctttattctatttttaatcaaggagttgaaaaggcatactcatcaaacttacacttcctgagagaagttacattccggctacctttcttacaacatgcttgtttcacattattggaaaaaattggcagattttgatatggactatatattaggtaacagtattttatcaatgtctaattttctaaatttgataattgtactgtaattatataagagatgtccttgtccttaagaaataatgcttaagtatttagggtaaaggagtatactatctacaactaattctcaaatggttcaagaatttttaaaaaatactgtgcaaatacagacagtgggagagtttataaagcaaatgtgacaaaatatttgcaactggtaaatctgggtaaagggtatatgggagttcttggtatttctcttataacatctctgtacgtttgaaattatttcaaaataaaaagagaaaaattaaaataaatttaaaatagatgtgcctaaaggcagatttatagcataagcacagataaataatccatagtgaaatgggaaagagatatattttataggaatatcaattcacttaaaagattcaggagaaaaaagtatgattttatatatgggacaatttatatatggaacaatgatttatatatgggacaataagataaacttattgaactattcttagtaatcattacaagctaaggatgttaaaataaaactacaaatttactgcggcaattaaatttgatcttcccgcctccatacctgcttccattccaattaggaatataaactcattaagagagaaaaggcaactgctattcattttttgtttccctcacactttcagacttgattaccactttcaaggcagtggagttacagcttaccttaaatcccttcctgccagcaactgactggaagcataaaaattgcagaagaaaaatctcttctattcctccagtgctatttatcaacttttctaacacctactaaatgctataataagcaaagcaccatgtgaggcactgtgaggaatacaatgctgacataacatatatctgttgcacactaactatgtgctaggcactgtcttgaagatagagtatcatgcaagacaaagtccctgtgctcttgaaacttatattttgcaggggttggagtggggagtacatgataaacaaacaaggaaatgcaaaaaatattatggacaagccctgtgcggcaaaacaggaaagcataatacagagtgggtggttaaattaccctaaattgtttgatcagagaaaggtctttatgaggcagcatttaaatagatatctgaaggaaaaagaatcagtcctgcaaagatcagcagaacaatccaggcagaaagaacagctaatggaatatgagcctggaaaagagaaaggcctctgtggctagaatagcactctccagtagaaatataatgtgagccatgtatgtaatttttaattttctagtagcttcaatgaacaaagtacaaaataaataggtaaacttaattttaacaaaatattttatttaacccaatatatccaaaatgttatcataaacatgtaaataatataaaaattattaatgagataacattattatctgagataatattacatgatttttcataagtctgaaattcaaggtatattttatactcacagcacatctcaatttggactagccacatttcaagggttcaacagctcctaagactagtggctagcttactggatagcacagggctagagcatagtgggcaaaggggacagggaaactcaatgaggtggagaggcaggcaggcaccaggtcacatccagcttcagacaacaaagttaatgaactggatttcattttaattgaaatgagaatagactgcagttttttaacaggtaatcatacagaagttttgaaaagatcatgctgtggtgaatgaattattggggagcaccaagagaagcagagagaccaggtaggaggctgctgcggtagtgcaggtgaaagacaatagtagcttggatcctggtggttagtaaagggagggggaaataaatggatagatatggatatgttttgaaagtatagctaacaggacttgctggtggactggatagagggagagggaaaaaagcagcaaggataatgacttctggaaaaattatttgagatatttgttgttgtgggtataacaggaagccttcacctgaggcaatatgaactatgtcacaccatgggcaaagtaaccacattaatagatgtttacaatgattctaactaataaataaattcatcatttacttaatgataaaaccatctctataaaatttggcttcttacttcttcagcgtaaaacaacagtaacacctacagtaagatactttgaaattcaaactacaacaggcagaattaaagaaaatagcttcaagtttaaaatggcaaggaaggtggtcatatttatttactttaaaccaaacaatcttacagtggtgaaggaaactttataaactaaccatctgatccaatcctattttacatacaaggaaatggaaacttagagaagtaattagtccaaggtttcatgggaaatcaggaaaaagatccaattaaactgaactggatttccactcaggttgggaatgtatctctcatttctataaacccattgcctaccataatgccgggaatactgcagagatcaaaagtttttgtttaatgaacaaataagaacaataaaaacaaacaaaaacgagcctttagtggctctcttagaaataagactgtatataacatatattcgaacagcaactttaaagccaaagaatgccacaggaaaatacataatgtatttgaatctcatatgaatcaatcttgacatgaataataataagaaacctctttttctataaataatgtactgacctaaaagttggaagatatttgtttcttctttatttgtaataatttactattttgcatctcagaaaaatgtccttgcaggtaacagtctgctgaaagagcacttagcaagtcccactaagccaacaacataatgaattcttgtgaagtatcaagtacataaaacagtcactcctacaatgatagtgtagcccatgaaataagtaatacctgatttggtagaatcagtgttactctctagacactcaggtactaaaatcatgtggaaatgataatataattttaaattaagtcacttttgactcagaattaggacaaaggctttccagtatcagaaaagagaaccgcttccaggcctagtgttgcacaatatgagacttttttttaggctaaggccagtttttagactttttgtgttaacagcagttttcttggcactttctagtcctcacagtagtgagttatagatctcaaactgctataattgtcaaccctattgttaataataggagacagacaagaaccattgactaccataaaattaaaggcctaatcttttaccagcatctaatgccaacatcttccaaagggcctgatccacttcacataactaaaataagagtgggataaatttaccatagtcacaaaggagcagaccttggcattgcaaggtttaaggcaaagatcttctgttctttgaatttagatagaaagggaaattgcacatgggccagagctcattgctgtttactaagggaccacatccctcccatcatagcttttctagttcagggccagacaataaagaagggaattaccagctagaagaaggcttcaaacctttctttagatatctgaacagccttaggtcctcatacataaattctgtagaagggaaataaattactttgtataatatcagaatatcagtaagcagaactacactgttgctatttttctttaataaataagaaaggaacaaagaaaaagacggaaagaaggaaagaaaaaaaagaggaaaagcaatcaggaggaatcctgatgtcaatatttaatagtgcataaaatatggtaagtggaggattaaacaaaggaatcaaaataaccttacagaacaatcttgctctttaagataaaaggttttctccatatttgtggcagaactgaactaaaggaaacatttttttctttcatggtttcgtgtttctacaaactaaaaaagagaactaccaaaaaaaattatattatttctattctttccatatttgttcagagaaatagacaaaaaccagtctgccattgtcccatctagcactggttttgtcataaggctcttaaggagcttaaaagtaaccagatttaaacaatagatacaccgcccattttatttacaaacatgttgggcccaattcatctattttccctgacatcctaaattattagagaaaatggcataataattaaatgccacatttcttgaagctgaatgacattttctcccacctcctaatttttgtttttctagaaacagtaaacaatgtaagtcaagtcacagcagaaaggtcatacactaccatcttaaagctctaatgtccaaatttagtgaagtaaagggacttgacctgaagatacagttaccatagtttatatgtgttcattcagatgacaatttttttcacataatctctaaagaatcctccgagcatccttaggttagagaaagagggctcctggtttaaaataagtacttacttaaattaatatacttcagacaatggggtttaatgtatagaattaaagtgtcttgcctgagaatggtcagaaatctttgtctctgcatgggctacgttagttaaacaaggaactttccatatctccaaattgagagactgcctgaagatgatctttaaaatccttctccactccaaaatccagtcaccaaaatatagtattttatttaaatacggagaaaaaaagatcttgttttggctgttattttctcagtctttatgtaacgttctacaatattggtcatatttggtggcgggctggggggacgagtttatttcccatccatcctggcccaactaattttagaccctaatatgaaaacaccatgtttaatttgtaacacctatgtctagtcacagaaatactgtaaagcccaaatttagctgcgaggctccactgaaagaaaaagcaaaagaaaagaagtacacagtgttaagcatacagtgcttaacattttatacaaaatgaaaatgcactgactttttacctttcatgacactttcatctatgctgtttctcatctatgctgcttctcataattttgtgtaaatttaaaaacttttctcctgttttctgcttaggttcttattgtgatagacagtatacataccatagaactactttccaaaaatttcaagtggccatcaacaatgtcacttatcaagctctaaatttctggaatgacgttgaccagtagcaggctttctaaaaaatgccttctagatcacatctacctttgtgacagtattgttaaataagttgtatcaagtggaacatgccagaatgtttcacaaagtttattgaagctagcatttactgttgctatagaaacaaactaccatagttgaatttaaaaggttggtacagaatcaattgggcagacacgaatagctcaaattaagcaattaagaattcaagactataatgaatgaaactctcctctgatccaataatgggttaatcctttcttaatatcaaatatcttccagtagaactcagtagagttctggctgtgaacagtttatgccttaatcttttgactgacaatactgtacttgaatacttgaattcctgtctcttttatgaatgagtcatcactaatcctcaaatgaactattaattctaattaatatggtccagatgttataatactttactggtggattaataggctttccccaaaccttttaccttatgctctaatcatttacaggcattttgcggatgaaggctttaatgctccaggaagaactaactagagaactaactgccttacagaaaaccattgggaggaaacgtctataaatctgaaaacaagaacaaattttaaaagttggaaaaaaaaaagaggtaagaggaaaagttctagtgccagaaatgagattaaatgtcttctttttataggaaaaaagtgaagtaggaatctttacctttttgttttaaaaggtatacaattttgataatgggaaagtcaacagattttacaaaaaggattgtgaaaatcaaattatctgagtgcaaatcacgtttactaaatgagacagagcaaaaggtgcagcaaaaatggggtcatgactaattttctcaagtccagaatatttctaacctccacctagaccgaaatcacgtgaagccagaggccagctagctataatcagaaaggcactatgtagccgttttgtatacctggacccggagcggcaaataatcttcacagagatcatcccacagctcctgcaggtctgaaagctccaagggataactcacaggtgtcttgtaaaggggtttcaaagacctgttaaggaaaccggaactaactccatctgtcatgctagggccaggcttggctccaggtaggctggatttcactggaatcggaagcctgctccctcgggggctctggatgggcttataatcaagacctttaatcatgctaagagctaattccagcttgtgattacacccatgctgcggagcctgatcatctgaacaacagtcacactttccaagttcctttgcacttctctcagtctcctcatctttctgttgtggagggctagcctggacgcttgcatccaaagattccacagaggaaccaggcgtctcttcctccatgctttctccatctgggggtacctttgtgcttgctaagtcgggtggcccaacctcagacaacgctggttcttcagtgcaaatgctggtcgaccacctgctagaagggccgcaggagatacttctggccacctttcgaggtaccttacaaatggcttcatagtcagaatcagcaacccgcaaagcggcacaaccacggcatctcctgggtcggtttccagggccttctgaaccatggcagctgtgtggctcctggatctgatcctcattctccacccagcactcaaaccctgaataggcgaagtcctcctggagcagtgcagagtatctcgcatcgggtaagacggacatgtcaaccgtcccattccccgccttgatctccgcgccagagtcatcgttattcttccgatacatactggcaatgcagaacttgaggcgatccttctccagtagcagcttttgcaagcgctcaatagaaagcgcttcaatccgggcaataactgtgtcgaatcgatagattcgatcaagcatgaaagcacacttgctgcaagcgaactcggctttgccatcgcgggggacatccttgcccaagacgtgcgaaagcagaacctggagattgagcttggacgccgtgtggaagatccagcgccgctggtttccacacagctctcgggcacagatcctgcaaatctccttcatcttccctcctagcgggtggcaagcttcccgaggcggcggcggcggcggctactgggtgaccactcaatggctcttcgccgcgctctgtctcccgcctcggtggtctccggtcagcatggcacagcccagtggggtccccactctgcaggggcgcgcccctgccccgcgcgccgactccgggtaccagagccgtcagccccgcccctcgggcagggggcgggcgtggaaacgcctaagaggatgctgagtgacagaggcgcaggccgcgctccgaccctgccatgtctctccccagctgtctctcccgccagccgccgcgtcctc

SEQ ID NO: 1119 - DNA, 104432 bp, Homo sapiens
gttatggcaaagtaagctttatttaattggtagcaggagagtcacaacttcaaactccagaaaagatgaagtaaatttgcaatgatttcatacaccaagattcctcctacccaaagctgaagatatattttcaaggaaaggtgatggaaagaaaaatggtgctcgcccaagagattcttccatccagcaggcatatactttgtctatcatgagtcaagccctgatccaaaggcttgttaacttataattacactaagcatctctcctatgccaagtaatgtggcaagtattgtgagggaaatacaaatgccctaatgtaaaaagttcattccagtgtaggctgaccttctcaaaatggggtctggtcagattctccatgctaggctacaggaaagaaggctgaagaagcaaatttacaaatcagtttgcctacaattgagaattagagcaaatgacttgcaataccaggagtacttcagaccatatcaatcagaaactttcttcatatctgtgtctcctgttcatttattctgaagttaatcctgtcccacagtcattataaccatcagtgaccagccaacctcccaatctagctgtcttagagtagacatttgttcatcctgcaggtccctctctctcacccaagatcctcaatgaaatcagagagtgaggacagagggatctgtctggagggacagagatgtatataattaaagtcacaaccatcggtaaggaggactcaggagaagctgttcaagcaaaaggaaaagtggagctcatgcaagcactcaagggagaagggaaggtcgggtacagctatagcaacaagaaggtgatcctattataagaaggtgatcctactactacaaagaaactgttgagaatatgacgtatcccagacaactactcatgtccccaagtgccaaatcccaaaagatttgaggatgcttatttgggctcttcttattggttgattcgatgtctcttctttgtcttatgcagaagacatacaggcagacccagaaagcctcatttcttgtttaattttcctaatagccccaagaaagctattactggaaagtccagctgcttgtgcaggatatctaccaatgattcactttctccttaagaatcataggcacagtccatttaggagatgagattgctaaatggcatggacaaagtggagacattataggagttccggtgagtgcttgtgagatcactattggtgacttaatctctgaagtccagattattcactcttgtaacatgctagttacatcttcactgatggtgggtggaagcaatgtttcagcctcaagttctgaggtttgacaggggattgctgttgaagtaccatctgctgatcactgagtcaccatgacctcagtggtttgtcaggttgcataaggttctctttgtataatgagatttcactgagaaagattcttgctttggaagcattccaatcttcttggagtttcttcccaagcaggtcctccgccctgccacctccccgagcagcccttcgatgactccctgtcttctgtggtgcgtttcagttacaaaaagcccaaggggaatgtgtccatcgtcttgcaagtaaaaatgcttctgaagctatagctacagagaataaataggggcaaaggtgggtaggagggggaaggaagcagaagaaagagatacaatacaaaccaaagggtggattggagagaaaaatggagtgaagatatgggttggaaaggcagctgggaagttcaaggagaacaggaagatgactgagaagtagtttatgtaaaaagatatcttctcactaagtccgcaagggctgcaggagactatcagacctcagaagggctgtgtgctgtccaccctggaagtcccagaccctgacactgacttacttgctggtgactatggtgtgcagcctcctcctcaatactgtcagtgaactcagtgcttgtatcttcggtgtcatcccctgcagctgcacctggaaacaagtccagaaaagaaaagtgattcccttcacagatggcttccagacagcaggttaaattatactctttttgcccgctgactctgatttcttcctttctccatatacatggggcagaaattctccctagccagcagggctggaaagaaaaatagaactttttgtatcacagacactttcttactcatactccagcctgagcctcacaacataagctgactttgcctgcacagacccatttctaaggagccgactgtcggatgcactggttaccccactcgaatgtcaagaaagcctgaattattccccactgcctggctacataaaaactttctcttccataatatgagtccaacatgcttaaccctttccccaccactgagtgcctggagattagagctgccctgaatctctcagaggtatctattgttgggatcagttgtgcatagggtgacaatctctctgaggaacttccctctgggggtcctgtgtcctagtaaggttcaggtctagtcaagattcaagacaccaaaggattcagttgttccctaatttcttcctctaacctcccttcctcctcacctctctcaaactcttattctatgcagacaccctttgcctgaagggtttcttgcactgctttatccccgtgggatttaacccatcctttcattctccagagatggacacagccactctagggcccaaacatctacaccttgctctaaggtacaagtagctgcagtttgtggtatgggcaaaggtctaaggcagcactgaccaagaggactttctgcaatgacagcaatgttctgtgccagtgttgcccagtacagtggacacagtcatatatggctattgagctttgaaatgtgggtagtatggctcacatttcaaagcattgaatcttaaattttatttaaatttacttatatttaaatgactgcatgtggctagtggctaccctattggacagcacaaatctagggtgtgtcttcctccttatattgattaaaattaagactgttcatacattttaagaccaagagctatgttttatatactgtatttttcaggaagtgtagaaatttattatggttaatttgtcaaagaaaatttactgtgacactcactgtgtcttatagaacctccccaacttaagaatcttgaaatcttgttctgatcctagcctcggcaaccaaccagttacaactccacttctgaccactgattaacctggacctctaagagattacgtggtgagtccaaggttacacaactagccctcactagagctgcgccagtaagtcaagactctggactcttagacagaagccactcacttttccttctggtgacaaatctgatctttatctttgcttcttcctccaagaccaaagaaccttctgttgagttcagacatccaggcatgaaaggctctgcttgaatcatgagcattcactacccaatacagataaggggcttaccttatctccgtaaggaattcgacggagacaaataaatgctcatctcatctcgacactgccacacaggggttttgtttcttccccttcattctctcttttttaagctagctcacagtcttcttccattatggcagctttaagggttgctcagccttttaccaatttgaattaaaatgctgaaactttttctcccatgtttgagggggcagttcacatctatatatttgcaatggcccaggctgatctcatggaagtgctaagaggtagtaagtatgctgtgataacagcttaggtttcctcatctacaccatgaactttatgttaactttggatcaaggaagggtcctgttcagtgaagcctctaccacctctaccacttagcatctttagaggtctgtggcagacagtgtacaagagttatttccaatacttactcattcaaaccaaccccagaaaccatctcactcaggatactagctgagtagaggtgtatggacacattccctaatctttggctgctttaaaaacttactgaaaaccaggatactaatttacctaggacacccacatcatgttatgcttactttggaaaatctttccctgtacaacagtagcgatcacaatcttttatgtttttccagcaaaggaaatgaattgtctcactcagtgacagaaaacagactgttcacattgtttctcttttgaacatggggctagagaaggatcctgtagttgaagaaagcacagctctatgaggtcaggatcctcatcccctaccattgttgctgggttgtggagtcaggctgggcccacatcccaggaccattcctgccaggttccagaagcgagaattggaaagggtgactatcactggtcttgaaggtttttatctgacactttctgccctccacttatctttggcagcctttctggtgccacgtctgcattcttggataatgctccatcttatttcacttaagagcaggatgctatggttctggcttcataaggaattcgacggagacaaataaatgctcatctcatctcgacactctgccacacaggggttttgtttcttccccttcattctctcttttttaagctagctcacagtcttcttccattatggcagctttaagggttgctcagccttttaccaatttgaattaaaatgctgaaactttttctcccatgtttgaggggtaaagctaaaaaatttatagaaaatatgggaataaaagagtaagttatctcatacaaggtccatacaagacattagacatcttttaccattttccatttttttaaataaatgagagaacttctcttgtgtgatacccttttctaaacttttactgcacaacgaaacactgtcttcagaactaacttggaatattttgaatttctaatttaaggtacctatgattttatattgatgactcgtctgcttattttttgataaaatataaaatagcctgccgcctttagattctctgggagctaagaatctgttcatttaacttgcttcttcgagattaagttttacatgttagactggcaattttataaaaaacttttatttgaggcttcaataaaagttctcaacttgtggttcttggaagtttctaggctctgaacaatacaaaatggaggtgataccaagatgtcccttatttagaaaagtattttctatcagctatctaattctacaaagtacacaaaaataaacctctaaaacataagaccataaaatccttgggtgaaaatgtaagcgttatgcaaatataaggtattcttatcactgaagcaaaaattcatacttttgtagaactttttaaattgagtatggcataataattaagaacaagaactatggagatagactgtcttgatttgaattgtgcttttattgttagttatgtcacttcaggcaagtcataacctttccataactaagtttcttcatttaataattagggttaagagtgttacccactccatactgttgtgaactttaaagggtttgctgattttgaagtgcttagaacagtgcttggtacacagtgtgtactcaataaataccatccttaaacaatattattattgttattgtaagtaaactgaagtagtccatgggcttataagttgaagactgagaaagttgaaggccacagaacctaaatagcatcagcagaaggaagttttatacttgatgttactatctgaatgatcttgattgattctacctgcacttcttcatttctgaatacttgtttccccagcaggaggcttgaaatgacactctttgctctctgcctcacaggacattgaaaaggtaaggagtgacaactctttggctgaactctttggaataggtgccttacaaaaaggactaatcatcattaaatgataactgtcttaaaactccaacatgcacaaataagccttagggggaacttcatgacctctttttttgttttattttgctttacagatgaggtctcattatgttgcccaggttggtcttgaactgctgggctcaagggatcttcccacctcagcctccaagtaactgtgactacaggtgcatgccaccacacctggctcatgacatgttctttagtaatgagtccaaactgggtggagtcaagaccatttccccccaattctactctgtagtcattatcttcctttaagccactaatatgggataaacagaaaaggagtgatgtttttccatatagttacttagaacatagcaagagatcatattttattaattttaaaaggtgatctgaagaactaaaactttaagcatgaataagttggcagtgccaagtgttctttccttcggtaccgggcccttgtgtctaatactctcagcccaatttcactctgactcccaggtacactgccatgcgttcattacaagaacgctcacattttcacgtcatgaaccaactattgctgactttaatgttatggtgctgtaatgttatggagagaatcaaggaaaagaggcctcctatcaaactacaatttcacctgcacacattcccttcaggatcataagaaaactattaagattccatatagtcctccatagtttctgctaagaaataaaattctctatctagacagattctgatcgtggaacagaagtggtagaaaactgctgtctgcagtcaaacccctttatggtgtatctttgtctttaaattgcaacatctcttaagtagccttagggctttccagctcacatgtttcagaaagtagctgttttaagttacttgaaaaggccaaatcataatctaaaatacttttgggggtatgaaatcccattaaaattctggaaagagtttctacttctccaaaagggtaattattcaatacaactacagtcttctatccttaggctaaccaaggcacatgtaaattaggactcccaggcagaccaggagatatgaccactgcacctattttgtgatgccataattctgtaatgtcaagaaattcttcctgctcatggtctcttttattcttcaaagaaaacgagaaataggtttttctaggaatgtttagagacagcactacccaccacagttggctcctgaaacctctgtcgtgctttctgctattctcctacagcaaagaaagcaaggagggtttttaaggtaaagtagcctatgtgacatttccggggaaagtataacactgtttctttagtctcacttcttcgagaggagaaaaattcgagtttcttcttccttcctttagttaaagactcattctacgagccttgctttgacttggaatttagtaaataatcaatagactgattctcccataaggaaaaaaaagatacaagctttctctactttttttataaatatcttaagaataaaaccaaatagtttctgttggcctttgataattttattggatcagtaacaactttttgtgtttcaactaagatagctaaaattctaacacttatatgtaaaaattacactccattttagcacaaatgttaacagaaattaacagcacagtgccatgaagaaatgaaaaatacacagctttggtagggaaatggtcctggaaataatgtaatgccaagtttctgatcatttaacatatcactcacctccttcttcatctgatgttatgaaccactttatttatttatttaagacagagtttcactcttgttgcccaggctggagtgcaatggcatgatctcggctcactgcaacctccacctcccaggttcaagcgtgaagttatgaatcactttaattcttcttaacaacccacaaaagtttaagtgaaaactagtaagacttcatggacacagatagaaactcataatttataaaacatgctggtataaatgcatgcctacaaaggttatagattgagaaagaggtcaatatcttggagctatgactttgattattgtaaaaagaagcactacatattcatgttatatactaaaagtaaacctacaaggaagccaatatggtttatgtacttaaaacccctattctccatattattttaaatacaacattttctgatgttgctgaactttctattttacccttccagttttagtaagaggaaaacagtatgataaagatttttacttctggaatttgactttaaacaaaaaaaagggagagtaacacaaaaataatcagtatatcactttataagtttaattattcttatttgaaaacgggtagaattagtattgtcaggaccacagttttgtgttcccttccatttcccattctttgttggagacaaattacaaagctattttttatttagaaaattgatcttggcccaggtgagaacagggagaagttgaagacttaccttctgttaatacttagattacttaaaagcaacaggcttgttatttgatcataataaaatgttttaacaaagctactggtgcaaagggtgagaaggtggcttaaatccacattctaaaacacattataactgaaataactgaaatatacactatataaaaaacattataactgaaatatacagaaatcactcgaatatattatcctactgactcattccttctgtttattactgtattgccacattggagttccatatttccagctattctttctacggtacaaatggttccacactaccaaagagaaaagaaaagctcactgagctttaaccctgagagaactcagagaaaatactctgtgctggtatctcacaggatatacctggaaaagaaaactaatttcatttgttctatctctagtacaatttctacaaggtaaaatggaaaactcacttcaagtgtgtgggttactaatatttcttcctaacttcacaggaagtttgtcacctttccttgcaggatactgactgtaaacctgcagaatactacatgataccctacttgaaaaggccacttgagcttttcagggatgccaaatgtcaagattttgtgactgttttctataaaaagaccatgaaacgagaaaacaagtttatcctatcaatgggaactagagttttctaatactacctcaagaaaagcaaaggtattattgttctctctaaggcttacagtccaaaggaaagtgactttaggtagctcagtcaacctttatttctcaatgaaaaggacaattttcagtataatgtgatctgctactcctttccacaatcagaagactccagattcaactggaagatcaacatagagagaactgaaatcagtcttcttgaacagtttttgaagctatgaaccaaacatctcatgacccagacactgaattaggaggatgaatgagcataaaagtgataggtttttttatgtacatcggccacagagtttacttatgcataaactgtgtaaatagaatatactaaagaaccctcaaggaaactaattcttatgatgaggaactcatatcctctacaggttaagattttctggatccttaatagatctcttgctatatataatgtaatagaaacatcttttaaaaatataaataaggaaaaatgtatttcctctaagaagcaaaggtcctgaaaaaattactgctgtccacaactgaatgaagagaagagggtgtggagaaggttgggtgacagataagagtacacactatcaaaggaaaaggctgacctactaacttagtccaataatgtcttttcaaaaaagttataacttggctatctaaaaagagaacatcagatgaatgttgatttatactaggtactaataatcatcaaattttcaatactataaactttcaatagaaaagagtttagggacaatatctatctaaggacatttatttcactcattaaataagtcctcttggaggttcttttcaactctatacttctaaaacctacagacttcatctaccctgaactcttagaaccattactctgcattatttgctattattcaaaagggaagcatgagaaaaacaaaatctatcatatggatttttttctcaatttaagttctatgcttccaattaagcatggcctaagtaaaaatttacttcattatttttatttgaagactatttttactcaagcacaggttctataagcacacgatgctttatttaaaattactgtcattgaaaaatgactgtcaaaggtaaaataatccagtatgagaaagagtctgtgctcctgtagagaaaatggaatattatatcatgctaaatattattaaatgatgtgtccaaccacagcatgatctctgtgtggattataaaatttatcagactcatgctctctaatcagatgccaaattatcacacaaagttgttagaccagcaagctctctccagataacactgtttgcaagcctcattccagctatctagacccgaaaaagttagtaccatattctagtcacatttatgacattaagatcagacttttaatttatcctgctatcaatttactcttgctggaggttgacagaagtaggagtgattattaacataaactgtaatcactatgagccattagaaatgaagaatcacccagagctgaatcttactagcgattcagaaggcttccttggttggtctattagtaaaattaaggaaagatgttccctaaatgccttgttgtaatgacacgacaaactagtctttgatgggttgacatttctacggctccattaccttcctctttacttatggaaagttacaaaaaattttgtgcaagaaagggtctcttaaaattgggagactaagaaaagtggatggatcggcctacacttcctatctccttccttaaatgactcctttttcctcaaaagccattgaaactgaaatggcagatccattaagagtaaggcttatggctattaatcttttgcaaatgacttaatcagaagattccagagtgcttccccagtagagcattttctccctgtccactctagtttgactgatgctctatctgttatagacacagctaaagttacagaaacagatgaaatttagaatgtaatacaagccatgtcaacatgtgaaagaaataaagtgtcatgtaaaaaaaaaatggaaggaaaaaaaatcattgtgccccacttagtttagaaagggtattcagtcacatttactgtgctagaaagcctcaatccctgttcccaaattccatatttaaagtaactgaaacctcagcttctaacctaggaaacttccaaccagaggaaatgaaaacaaattcatgatgttgatctcacaaagctgcaaagcaatcttggttacttttcacacttgacattcaagacatcagaaatacaatctccagtgcccctctccttatacctgtcacgctgccacaagaaagcactgaggcaatgattaaaactataaacatacatctgtaacatttctttctaaactattctagcacttcaaagcctgaagcctattactgttatatggagaaatgtatacatactaaatagtgaaaaacataggaccctatctagtgccacaaatgaaagaagcaataccctcttctggctataatgagttatttggtgaaacactgaatgtaaagagggatactacatttgaaattatctttgtaaacagagaattctgactctggaagaccattctagaagtcatgttctgactaaatagcatgagcttggtttaaagaaacctaaaggaatcaataaagaacaaattttaagtagaatttaatctgtacctaatctaatttcacttgtgtacaacagtcaactctgagacagtattggagataaaagttgactatgatcactttcatagttcttgcctctgttctttaacttggccttcccaatacttgcagtctactattacaagactactctcctggttttgattaccttctgataaggattatatcacttttgcaaagtcattcttatagactctcaatctctttcccgctctctcatcttaaaacttgcatgcttttgatttaaaaaatgctctcactcaaagaggagttgactgaatggcaaaaataatacacacacatgcatttatgatatgatatggaacatatgaaatggattgtgaaagttggggaagaataaactttattggcccacagaagggatgagggaacgagaaggggctagggataagaatgaataaaagtggaaaaactaaaacagaatgatttaaaatgtgcaaatacactttgcaacctccaccattcaatttagggattgatatgtatgtacagtgagatccatgtaggctaaagtgagtttcactttgtagttgatgctacttgtaccagttctatcattagtaagtcaccgtttaattctgccaaaatcagacaaggatctttctggttagtgcaaacaaggttttccatcctgggctgcagtctgacccgccagtgctcagtaggcatgcttgtgatgaattcgcacactttccagttccccacctccaatggcggccagggtctccagcctgtttaagcgctccaagcttcttccaagaacttcttctagccgactgcgtaacacctgagccccttccagttccacctgcagagttcggtctctctcagagctgattaaacatgccacatggaaggaaagtggattagccatcaactgtagtgagtccacatttgtttccaaagaaccatcaataccactttgagccacacgactttgtaaagtaattgttctccaggacacaataaatgaatgtagtctttgtgtggcatttgtgttcactgctgatagattagtaaggactgttgctttttttaaaagcttgccccttatgctagattctgggccaatttcacataaaattatagctcctaagacttatctcacacccctatagcccaaacaagagaaatttcattatttggctaaaagcttttgtttctgaaaaactaaaacccaggacaaactaaatataaactggagcaagactgagccaagtagaaccactactgaagatatttgttttctcatttgttaccaaacttgacggtgggatggtgtgctgaaaaggaatctggttcataaaaactaaagctccagaggttctttaaaaagtaacacaatcaactggtcctatcatacctttcctctgccttcattttcctggtagaaagaaaacatttttaaagcccaacaataaattacaagaaactgaatagcaaaaataataataataataaaaattgaaaaagaataaaaggggctagtagggaaggcaaaatgagaaaacaaaaatgaagagaatataaaatgatccagagaggtatcatatatgtgaccaaaaatcaagaggtagaagaaaaatatattcatcatgatagctattggtggtcccaggatgatattagccatcccaattaatatattttctttgatgatattaaatgaatatcagtgcccattatagccttactctttttctttttttttgagacggagtctcgctctgttgcccaggatggagtgcagtggtgtgaacccagctcactgcaacctctgcctcccaggttcaagtgtgtctcctgcctcagcttcccgagtagctgggactacaggcgcgcgctacctcacccagctaatttttgtatttttagtagagacagggcatagccttacgtttataatagaacagcctttaacaggacatggatcacagaaaagaaatgaacatacattgagtgcttactacatgcaaggcattgttttagacacaaaagctgtcttcttatttaatctctgcaatagctgtgtgaaacaggcactaatcccaacttaagattttgacactgaggctcagagcaatccataaaacaaatgacaaagtgggtagccccggtaattgtccctcttttttctcccctcttcagtatcataagcatctgcacttaatgaagaataaaaggcataaatacaatagtaaaagaaataaaaatttcaataaagaataaaagaaaaaacagcctctctcttacctctctggatgggcatggaacttcaccagactgctatagagctgtctctctgcttgtaaggcctcattgagccgactccgttcatctactagtccttctagcatcagcagcaactgagtaaagaagagagaggaagcaatacgcaaatggcacagtgagacatgaataagaaacaagaaaatgcattagcatgtactatgacttaaaaagcccactatcttagtacttaagcttttgatactattttatagttttcaaatcaatgtcatattatcttttttttatctttaaaacctgtaaggtggaattcaaacatgggagcaaaaagaagaaaaagcagagagaagctggaagcacaggaaagcagctaagaaaaaggagtaagagggaaacaggatggacaagagggaaatgtatataataggacttactagtattcttcattcattcaattaatatttactgagcacgttctacgggacagactctgttctaggttctaggggaaagcttactatctagtggaggaaaaagacattcattaatcatagatgtgtgtcattgtgagtgtaataagtgctataaagataatgagctatgacaatgtataatcaacagagttgtttaaggtacagttaaaagccagaatgcagtggggtgagtagttagtgagacagatgataatggagacagggagtacaggcaagtaagtcttttggaaaagtctggcattgaagaaaggttaaatggggctgtagctacagagaaatttggggcaaatgtaggggtttctttctcttttttttttttttttaactgggagagatctgaacatggttaaatgcagataaaagagaaagattcagttgagggaggtgacttaggtatgagtgtgagggataactattggtatgtgtccaaaagaactgctgctcttttcagaactacaaatgtcagaaaggggcatctatagctgctaccgaccaaagtaggaaattttagagcacagtttctctaggaaataccatcaactaaccctccacaaatagctgagattgacagctttaccatggtttatttcacagtagaaaaataaggtttgagccgggcgtggtggtgtgcacctgcagctccagctactcaggaggctgaggcaggaagattccttgagccccagagtttgaggctgcagtgagctgtgatcataccactgcactcctgcctgggtgacacagtgagaccttgtctcaatgtggtgactcatgcttgtatgtaattccagcactttgaggggccgaggaggatggatcacttgcagtcaggagttcaagactagcctgaccaacatggtgaaactccatctctactaaaaaaaaaaaaaagaatacaaaaaaatgtaaataaataaataaggtttatattccagtaacttacctgttgtcttcggtttcctgaaatttcttgaccctgggattctactgaagcaactttttcccgaagaagtaagacttcctgggtcaggcgttccatagctggtatgtcttcaggatcaaccagttgcatttgcaggtcctagaagtcaaaaaataagtatggatgtgaaaatagtaataaaaggattattcagcagagtagcacgggaacaaatgtcttgaaatattctgcctatactttcaagtgggatatggataatcactggccaagggattcgatgtgtgcaaatattgtctgaagaggccctacaggtattctgagctgtgaacatttccagtggtctttaaaaagttttgaaagacctttatgagatcttctttaatctgtatgttcctggtcagagactccatatcagcagcctgcacctgcagctcttcttcctgcacagccatcatggactgtagagcagaaagttccatctgtgaaaagaggaaacaatgtctgccatgtttacattttaacactgaggcaaatgcttttgcatatcctattactatcagccagtaatggaaaagaaaatgagaacatgaatagggctctacagcatcaaaccaataatccatgcagtatagtaacaaaggaagttttatgggaagatgtcatagttgttcttaatgatgtcttctactttagctggcactataaaacacatcaaatttgtttaacaagcttattatgatactgaaaaagaatggttaccattagcagaagcaagaagagatgaagtttttatgtaagtaaaacttcacctaacagatgaaaaaatgatagcattaggatatctccattttgcaacccttaatgaattaagggataaggcatcaaacagcaacagctgctaacatcacgagagatcaccaaacattacatgactcctgatggaagaacacgccaccacctgtgaagaaatactgccaaaagttggcactacatgccctaaactttcagtgttctcatcagaaaatgacaagtacttggttatgacaaacttcattaaaaatcataataggccaggcgtggtagctcacacctgtaatcccagcactttgggaggctgaggtgggcggatcatgaggtcaggagttcgagaccagcctgaccaacatggtgaaacccatctctactaaaaatacaaaaactagccgagcgtggtggtgtgtgtctgtaatcctagctactcaggaggctgaggcaagagaatcgcttgaacccaggaggcagaggttgcaatgagccaagatcgtgccactgcactccagcctggcaacagagcgagactccatctcaaaaaaaaaatcatgataacaaccatagctgctaacacttactatgccctgggctctctaataaatgctttgtatagatttaatccttttaacaaacctagtgatctggctcctgcctacttttcctactttaatatctgccattttactgctcactcatgactctgtaggcacattagactttttctgttccaggaacaccagactttctcttgactcggcctttacaactactccctttgcctgaaatatctttctcagggctgcctccttttcatccttaggtcccagcttacgtgtcatctgctcagagaagccttctttggccaccctatttaagatggtctccatccatgttgctttctatcatttccctcatatcacttactatactctataactataatgtttatttatttattgtctgtatctccccaatagaaattaactacacagagccacagaccttactgatttcattcactacctacctcatccccagcactagcccaagcttagagaaggtccccatatagctaatgaatgaatgagtgaatcctcacaacaatcctatgagataactactcttttatttatacataaggtgacttcttctactcttcaacttacagacaaggtgatttgagtctgagagaaattaagaaacttgttcaaaaatcacagggctggctagtaagtggtaaatccagaacgtgaactcagggaagctgactcagagccactaggctataatatctttcctgtagataccacatatccatacaatctttatggtaagacaagttattttaaataaaacctttaaaggaatttagcaatagctaaatatcacccaaaatacccattcataggcattacaatttcatgatcctgaaaacaggacagaaccaaaaagtaacattactctggatttgataaatgtgagaaaaacaggaagaggatgtggaaactaaaatatctgacatgaataatcagataacggctaaggtagaaccacaaaaaggaagggggactaggggatttttaaaactggtatttcttaaatgccacacattctcatatcctgaaaactaattgagtcataaaacatgagtctgtttgtaagcagaaatatgacaatgaaatcaaaagataaaatatgataattctgtcacaaatacaaacacaggttttatattatagatctagctatggcaaaaggtagaaaaaaactaagagctatttggactagctagctaaactgaatttaggaagccatgacattgagtgatcttctaaaagagatgccagcatagtaacaaacaagcttttagtttcagtctgtaactctgagctgtggtcctagtatttcttcaacatcatagttgaatatgcaactagctgtggaggaaaggcagggggaagggaatctctaaggctgaaaggcctcttccaaaaaaaattgaagagaactctatgctagagcgagttaaagcataaggtgggaaaaatgtgctctaggaaatgaatcttcttaggaagtatgtgaagtcacaaaaggcttgagtttgaatcatagctctggcatttattagttacatgactattctccactcccattttaaaagagaaatcagtgtttcagcttcttcgtctataataattgggccgacaccacttactttgtgtagagttgtgagcattagtgctaatttaaatacctagcacagtacattgcacatgaatacttgataaacactgattatactcaaatttctcgtttcatgtttctaaatctaatttcacggatctaatgtcataactctaagcagcaatcacacagcgcttccttttttcaccagtgctttacaattattattattattattattatcttggaggcggagttttgctcttgttgcccaggctggagtgtgatggcacgatctcagctcactgcaacctctgcctcccgggttcaagtgattctcctgcctgaggctcccgagtagctgggattacaggcgcccgccactacacctggctaatttttgtatttttagtaaagacagggtttcgtcatattggccaggctggtctcgaactcctgttcgagcggatcaagtgatccgcccacctcggcctcccaaagtgctgtgattacaggcatgagccactgcacccggcctttacaattattttattccagttagcaatggggagagagggttacgtttttccagcatttaataagttttaatggtcccaatctaaaaacaggagcatctttttgagataatgtatatataaaataacttatatttttctccaaaaagaaaaaagtcatacctggcatttggactcagatattatacatggagaattatatgcttttaaatataaactattttgaaagaaaaaaataatagggattttggaattaagacttaactaaaaaactcacctgactttctctttcttttttagccatgagttcaagttcctctttggcattactcagttctttttccagccctgcaactgtgtccaagtctcctaaaatgaaaatatagcactagttttaattgctattaacataatgtggtatctgctgcctcctttgagtaatttacagaggacacattccaataataagaaaaaagaaaacatacacacaagttgttctttatagcattatttataatagcaaaatactgcaatcatcctagatgctataaagaaaagattgaataaactatagtatattcacagatggcactatatactgatgtaaaaaaagaataaggatgatctttatgaatttatatggagtgattttgagattttaagaatatgttaagtaaaaacaagctatgtgcttaagaatacatctaaagtagtaggttttctattaggaaaaaggggaaataagaatgtacatatatacattacatatacgcagatgattcatttgcttatttttgcaaaaagatatacaggaagaataacccagaaatgaaactgattacctgcaggagatgagtggaaacaggagagaaggaacaggaaaatattggacatctgagtatatcattttatatactagagttttgaactgtgtaaatgtttaatttttaatgtgtaagtcagtttgacaatgaatgagagagaaaaggtctaaaattgaatactaatataaataaataaatctatatagcaaatagataacaaaaccatccagaagataataaaaaaattaatccaaataatttttgaactcactactactctaactgaacactgtcagtgcaaaatatcctaaggataaaaagaattacaaaaaaatcttaaacattacttaatacatttattgttgatggtgatatttatgtaacaattccaaaaatacttttgcatattatagtattctgcaactgtgtaaatattttgaaatatattgatgctataagtaaccagggctctcaaggagatacaaatatgaaatgagggaaaaaagaacctatattgttaaattggaattaaggaaatcagtatcaaatcttcacatatatacaaatacacacatacatacttaaaaatattcattgctagttctgttctcttaaaagggcctagaagcggctgggcgcagtggctcacatctgtaatctcagtactttgggaggccgaggagggcggatcacgaggtcaggagattgagaccatcctggctaacacggtgaaaccccgtctctactaaaaatacaaaaaaattagctgggtgtggtggctggcgcctgtagtcccagctactcgagaggtgagcagagagatcgtgccactgcactcccacctgggtgacagagcgagactccgtctcaaaaaaaaaaaaggtcctagaagcaaaaggcattcatgtagcaatgaacacatcttgtgtccagatcatagtttctgaatgccattacccaccaaaaggaaccagggagctctttaggataatggctgattctgggactgaggcaggtaaagcaaaaggtaatcatagaacatcttattgtgccagaaactatcaaactatgctaacattatatatatatataacattagtaggtgatgtcaagttacagtgagtggccccagacttgaaacgatacccaggaaaaggtgtcagctcatggccctgctgtgcaggattggaacaattacctcctgcatttctgaatccctgcaaagctatctgaaaaggagagtaaggatagaatttctctgggccgaattgtgaacccagagcaatcagctcaactcaacataaggtaaggacagttcttcagcctttcagaggaattccaaacttatttgttctattaaggtaggaagagaaaagagtcttggccaaacctataatacagagattactagaagaaaaaacaagagaaaaacaaagtcccttaatgaaatgaaatttgatacttacctaatgtggatctgggtatgctgacatcctctttggcagtcaatgaagtgctatcatctctggaaggtatctgcattgaaccctaaaaaattgcaaaagtcaggggacttaggaagatgcaggaactatgatcacaatgacagtactgagaatattctcagaatttggtattaaaattatcaaacttacacctcaaatgtaaaaaggaaatggaatcagcatgaattatgtaagtctatagttcttacttgatcagtctgttttccaagacagccagtgggggtaacttcagcttgttggttagagatgggtgcttgggacatcagggagtctctccctcctaaatattggcgcagggcctgtaattctgaatttctttccattaaggcttgcaccaacttctctgcagcagcctagtaagaggaaatcacaaataacattataaagatattctagtaaaacaaattttttgttctggtattatttcttcaaagtcaaccatttgtaaaaaacaaacaacaatgacaacaacaaaaaacagtgggtccttaggaaatagtttccttgctttcagtttacagggaaaaacagagttaagtgaatggaaagaaagtctcataggcagaatattgggaaaaaaaaactgaatttaacacatctgtaacagataagagaatctgaaataggttctgctacaactatcaggctaaggtgttaagattctggtttgaattagtataacaaatgtctttattctcggatagttgcttcttaggggtggattccttttcactcaaacatttgtgtggtttgctcccttcaggtctttgccaaatgtcaccttatcaggttggtctttcctgcgtatcctatccaaaacagcaatcttgctggccaaagtataagatgaatatgttttggggatccaatgatagcatggtgactttagttaataatactgtattatttacttgaaatttgctaagagagtagatcttaagtggtttcaccatacacgcataaaatgtgtagtgacggatgtgttaatttgtggcaatcacttcaaaatgtatatgtatatcaacacatcatgctgtacaccttgagtatatacaatatttgtcaattatactttaataaagctgggaaaaaaatttttttaaaacccagcaatctcttctctatctccaacacttcttactgtgcttaattttttttcgatgcacttaccattatctaatagatctctctctctgcttcccctacatggaatgtaagtttcctaaaggcaatttggtgctgaatctcaagcacccagtacggtgtctggcacataataggcacacactacatatttactgaatgaatcaattacgcacataaacatgtttatcagaccacatgattaggataatctcaacctcaaaatcacccaactcagcttgtttcatttcaaatcccagttttctaagacagatgatgacacactaagggaaagatctagaacatttttaactattaatgcacaggaagtctgcatttaaacagaaaatctggaaataataaattgatattaaaattactgagggtctaagatgatgaatcataacaccaactgtctctgaggaaaagtactattgttttagggcagaagctgagctcttgtcacaatttctaggggaaatatgaaaaaaccttccacttttcagtaagtaaaatttgggctctttggagatttgaatttaactattttagacgtatcagaatattattaaagtaccttaataaaaatatctgtgaaaactgtggggaaaaaacataataaataatatacaagatatatactgtgctctatctgccttggcactccttttctcgtagtatttaagagtttttagcagtgctcctccaatgcagtccccgaacctgcagcatcactatcacctggaaacttgttagaaatgcaaattcttaagtcccacctatacctcgtaatttctttctctggagttgagctccacaatctacatctttaaaaagctattcaggtgatttcttttgcacgtaaatttagagaagcagatctagaagaatacaaccattaatcttcttgagttgaaaaatctcctgtaatttccatcatctccattattctattaccagcagtgcataattttttttctgaggtataataaagaccaattgtcccaaatcacaaagaagttaaaaagaaaactcaaagatcctagcctcttgccaaagatttaaataatttagaataattttgttaggtctattttagaaacaatttctgaagcacacagcaggacctttctagaaagatgtgtatttacttcagtgggcctaacaattagaatagtggagtataatcctttcacaacataagaaaacataagaaaatattatggggtcaaataacataggcaaaaaagagtctatcttcctctaaaaactgactacggggattctgagctactggtatctgaaatgcagcacaagtcaactaagagtttttagccttgaggagaaaacacatagaaatgaggaaaaattaacactttactatgggcagggcatggtggctcacgcctgtaatcccagcactttgggaggctgagatgggtggatcacttgaggccaggaatcgtaagccagcctggccaacatggtgaaaccccatctctactaaaaatacaaaacttagcgggcatggtggtgcatgcctgtaatcccagctacttgggaggctgaagcagaagaattgcttgaacccaggaggcagaggttgcagtgagccaagattgcgccatcgcactccagctgggtgacagagggagatgccatctcaaaaaaaaaaaaaaaaaagaatttacttcttaaatattgtgaaattaatataccctgtactattatgagattgtttattctcaccatgacctctgaaaaatgcgatcttttttccctcttaactcagattttacaaaaactaagagtaaacatgttgagtgtaagttttcccataccttgactggaaatgcaaaatatcactcaagtcttaacaatttagaatcaaaatcgaaacactcacaacccctactcctttctctcaaaattatcagattattaaggaaaagaaaatgtatgtaatgaagttaatggatacatgtattgtttaggcacccttccaaatgcaaggttttcaagaaatgtgtcatactttgatgattaatgtaaaactgtggtctaaggccaggcgcagcagctcacacgtatagtcccagcactttgggaagccaaggcaggatgattgcttgagcccaggagtttgagaccagcctgtgcaacacagcgaaacccccatctctaaataagtaagtaaataaataaaactgtggtttaggtaataaatagaaggaaagaaactaacagagttgacggtaaaatatataaatatacacacatctatagtctgcaaatgcttcctatttgcagactataaatgcactacatgacacttgtctgatctgtgcattaatccttacttggctttcctgctccctggtgctcacagactgaagcaggccttgaatctccatttcatgttccagcacttgtttatttcgatcacttagaaggtcctgcagcatcctttcctttcgctgtagacgctggcacagctcctctgctatctcactctgccctggtccaagtttgcagagcagtgttgcactaagatcctaatgcagaaaggacactgtaagcttctggaggaaagaaatgcctctgctaaatatcaaagggcttataagaatctatcatagaagaaggaggtgtgagattcttgagaataagtatcatgttttactcatttttgttttaccagatctagcacaggcctgctacacagaagtctctaaatacatgtcccaggaatgaatacaaaccatacagaaaactatctctggtggccacttacatacatattgttttctgaaataagtctttttcctatttgttcagggcatgtaacaattaatgttagatgaggataaatggacactcagttcatttatttgttttctccccagtgtaacttaacagggggaagcataaaacgataagctgaaaggaatactaaacactatatttgctatcatagcgatggtttctatttctgtactaactgatggcacatggtggaggaatggagccatactgcctaggttgatactggatctgctacttattagctatgttagcttggacaagttacttagcttcagaagtctgtttcctcctctataaaaaggaataatagaaagtacctcatggacttgtgaggatccaatgagttaatatccattaggatcttaaaacagtacctgacccagcatgaagactataactaataaaggttagctatcatgttaaagatgcaatttttgggtctcattaattctcacataagttctttgagaaagttaattgccaacttaagtttctagacgtggggaaaaaaaaaatcccagtgaaagtcaatgacttgcccaggcacagaatgaaattaaagacttgggtcacagtcctcccaatctgaagagtcctaatccaaggctgagattacataatcactgaaccaactgccttaaagttaactgaagtcttgcctccacttctttgttcctatcatgaagagacgtctgtaactgctgaatgatactctcttgttccttctgccaacggctaaatttggtttccatttcttctttcagccactggaggttttgacaggtagtagataactgttccacttccaggcctttggccctcaggagactctccatactctacagccataaagagagcaataatcagtcaaaatgattaccccatactcctcaggataaacaagaaattagatccacttttaaataatctcccatcaatttttttttatttgcaagatgagaacattgatctaacaatgccatactaatctatttttttggtttttagaaacttttatctagtttgtggagagattaaatatagaatatatgataaaaggaagtattttggaggaagtgcactaagctataaaggatttctcgaaaaagtggcagatagatacataagctctaaaataaatatgcaaaaaagtccacagtaaatatagataaacaagtgttctaattatggcaattcatggacatgtagataatattaatgtagaagacacaatttaataattgcaccctggtaatgcttcagtaaaagtaagagagagagagaagagcgtgtgtgtatgtatacttatgtatgaacaagaattggaaataaatcagaactatgtaaacagaaatcaatatttactggctctcctcacaaagttcatattacaaaagaaaagtagaagcgctaaaatctctcacttgctaattgacaatgatggaactagtaactgctctttttggttttcttcccccttataaagcaaaatccctggttttcagaaaatgatggaagggggtcatgcttcaggctcaggatacaagtgggagaggaacaccaagtcagagataggttttgctcttacttgcatagtagcttcattggaggagaggacatcgcgcagtctctctaagtcatgatctcgctctctcacagcaagacgaagctggcgcagttctttttctttctcttctagagcagagaatttttcatctatagcccgctgcaaggaaaggaagactcctaaagctctgtaagatttactatcctgatcactcttattcaacaagatggcagaatagaaaaccaaatcccaaagcagcaaatttaagcaaacacaaatttctataatacctatgtagatagaataatccatagcatagtgggcgaaatgatgatacatacctccagagcaacagctttatcatgtattcgctggcgaagtttctcaagcaacatttcatttgcttcaagggttttgtctgagttatctcgatactgtaggagctcccgaaattcctgagaccaaaaatagtttcttttattcttttatccaatattaactaaattaccaagtaatttgctagttattcaggataaaaaaaaaacaagatgtgatcactctcctcaaaagtaacaagtttagcagagataacagacatataaactgtaaactattctgcaacatacaacagacacaacacatagaattaactgttctgcaacatacgctagccaccaggggaacacaggatgcactgcctaactctgcctgaaggtgtcagtaaagacctcacagaggaggtaatatttgcagtgagtcttaattaaaggactaggatttcctaagtgaagaagggagaggaggatacgttagagaaaaaaaaatatgcacactatgcatacaatgaaaaaattgtacattcagtgaaatgtagtggattcaatgtgactgaagcttagagtaggtggcagaacagatcagtctcttcttaatgctccatcttcccctcaaacttttattctatcatcaaaattactctgtggaagtttctgtacagtttgtcttcatctattaaactgagatcagtagccaaatcttttgtcttcccaacacccagaaaagtgtttgattcacagaggtgcttaataactattttctgaatattaagtctttataaaagacttcataaaagactgcttaagtcagggctatatgtactgtttcttatacttgttagtaagcatcttaattcacaaattatattttctatttattttaaatcctcctgattcccacctctctcaatgttttccatatggcagggactcagcacaggtggattaatatcttaaaattatataaacaaatttcagagttctatgagcccagttttcattgaaatcatgtaaactcacctgaagcaactgctccttgtgactcagactatggtttaggtgctggatgttttgttcctgggttcgaatctcattgtatttttcagcctcccaggcacgaagctgttggctcttattctgcaattcttcttgtagctgctgcaaggcttttcgcaattcctgaattaaacatattacctttttaaagagatctaaaattgtcacatggttattagatacagaggccttaaaattttcaaggtatataaactgaaagaggagcagagggtgccattattaaaattgctatagaagtattatacatgaattgaataggatatggaaaattgtaaaagttgtgaatggggtaggaagtaagcttgatattatagttcaatacttattttttggcttaaaaagaatacatctatagaaccattaagtgagaatctgtcctacggtaaacctggattatttacaataagctcaaggataaactattcctatcatccttttttctaaagatctcatagagaccatcactcttctttcttagtttgccatatttatttttctaataataaagtcagtaatctttaaatcatctgttactttagaaagctaccaaatacatattctcaactaaacaaatcttggggaaatgtttcctttagctaaataacaaaaagttaagaattatttctacctccatccctccaccactccccgaccctgcccagacatctgaaattttaatatttcttttttttgagatggagtctcactctgttgcccatgctgaagtgcagtggtacaatctcggctcactgcaacctccgccttccgggttcaagcatttctgtgcctcagcctcccaagtagctgggattaaaggctcctgccaccacgctgggctaatttttgtatttttagtagagacggggtttcaccatcttggccaggctggtcttgaactactgaccacatgatccacccacctcggcctcccaaagtgctgggattacaggcgtgagccactgtgcccagccaaaattttaatatttcaaaaggaaattcagggctaatatttgatctccaaaccactaaaccagggagatccttcaaaaattacttttaaacctgagtgttaaagagcttaagaagagaccacacacaaaaaaatcttttaaatcttaaacaaacacatacactctgacctaacaagataaaggaaccatttaagagttgtgtattttggcccagcgtggtggctcacgcctgtaatctcaccactttggaaggccaaggtgggcagatcaccagaggtcgggagtttgagaccaacctgaccaacatggagaaaccctgtctctactaaaaatacaaaattagccaggcgtggtggcgcatgcctgtaatcccagctaccaggaggctgaagcaggagaatcgcttgaacccgggaggtggaggttgcagtgagccgagattgtgtcgttgcactccagcctgggcaacaagagcaaaactctgtctcaaaaaaaaaaaaaatgaaagaaagaaagaaaagaaaagaaagagagagagagaaagaaggaaagaaagaggccgggcgcagtggctcacgcctgtaatctcagcactttgggaggctgaggcgggcggatcacgaggtcaggacatcgagaccatcctggctaacacgatgaaaccctgtctctactaaaaatgcaaaaaaaattagccgggcatggtggcggccagtgcctgtagtcccagctacttgggaggctgaggcaggagaatggcgtgaacccgagaggcggagcttgcagcgagccgagatcgcgccactgcactccagcctgggcgacagagcgagactctgtctcaaaaaaaaaaaaaaaaaaaaaaagaaggaaagaaagagagaggaaagaaagaaaagaaaagaaaagaaaagaatcgtatatttattattcaaaaataaaaaataaaaaacagggctgattattatgcatgtcattcctctgaccttagtggttcttccccacttttctgcctggttttacccatccttcaagaataacctcagatgtctcctccttcatgaagttttccttgattccttttccttgactcctttcctagatattcctgtaggaccccatatatacatccccttcagaatttaccacactgaaactcagcttatgtgactgtctctcttactgaactataagtaacttaaaagaaaggagcctgtgctattcatccttgtatttccagggtacaactcaatacggcagtcgccccttacccacaggggatacattctaagacgcccagtggatgcctgaaaccagatagcactgaagcctgtgtatactgttttttcctgtgcatagataactatgataaaggtttacatacaaattacacatactgacagattaacaataacaataaaatagaagaattataacaacatgctgtaacaaaagttacgtgagggaggccaaggtgggcagatcacgaggtcaggagatcgagaccatcctaacacgatgaaaacctgtctctaccaaaaatacaaaaacaacattagccaggcatggtggcgggcgcctgtagtcccagctactctggaggctgaagtgggagaatggcatgaatacaggaggcggaggttgcagtgagcggagatcgcgccactgcactccaaccttggcgacagagcgagactctgtctcaaaaaagaaaagttacgtgaatgtggtctctcttaaaatatcttaatgttttttgtctgtggttgaccccagataactgaaaccatggaaagtgaaactgtggataaagagggactactgtaactagcatatggtacaagggcagcaagtgttgaactgaaatacttagattatgcaactgactcaagggttcaacacaaactgtcctgctaaaaagttatgatcagggcaaagtcagcatttagggcaataaaatagttaatgatttacctggttatgtttccaagaagcctctttctgctgttcactctcgtgtgctgcagcctctacaaattgcacacattgtttggcatcagccagttggcgctctttctgtcgtaccaccctctggagcttctgtatttcaagttggctgcagaataaagcactctgaagatcaagcagagctacctgttgctgagctggagaagtaccctctgagctctgaaaagagagtagaaatcacaatcacaaggagggcaagcactgagctcccacaaagactaaaaataaaatcaagactgcaaccaaaatggcacatccccaactgaagtctctcctgtcctacgtgaccctcacatacgtgaagttgtccaagctggctttggtgcagcatttctcgaagctttgccattgtgtcattttgaccttcaattacctggtacaactcctcagtctgaaaatgagagagggaatatcaaatatgttagtaaactaattataaattccattatatcacctgtacacattttagtaacaggactattccaaaatatcaattgagattaagctacaacttctccaggctaagacatgctagtctgacaatatccattttgacaaaatataaaatacttgtctactttgaagggaccaattgtttccacacaggtccttgattggtaaatatgttacctcacgttccctgcttttcagagtttccttgaggttctgaattgtaccatcttgcttttgagacgactcctgagcacactttagttcatagctcatttcattaagtttctcttgaagaatctgaattcagcaaagaaaaacagttttttaggtcaatgatgtcttttagcctcaaatgaataaagcctttcctcaaatctaggatttaaagaatttcttaggggatattaccttgttatttttcctacatagagtaaccattaaagtggtaagtcaatcagcaacaaaaagtagcaggagaaatgaaatacttccttcaatactaaattgtctcaattttcacgcactgtgatctctctatgatggcagccatactaggaacttgtccacatggaccaagtaggcaagtggtttctaatatggatcccttatacaaggaccaaagagcttctgctatctagcataggagagggcactataagggcacccaggccacaagttcagcatcccaaattgtagcaattttcttctaagccagacattaaaattcatgggctagaaagtagtaacaagttaagctaaaataaaaaacacagacctcctatctcagtgccttttacagtggaagactgcatgcaagtgtttttttgagacagagtctctctctgttgcccaggcctgagtgcagtggcatggtcctggctcactgcaacatccacctcctgcgttcaagcgattgtcttgcctcagcctcccgagtaggtgggattacaggtgtctgccacaacgcctggctaatttttttttattttttagtagagacagggtttcaccatgttggccaggctggtctcgaactcctgacctcgtgatccgcctgccttggcctcccaaagcactggcattacaggcatgagccactgcgccggcctgcatgcaagttttaattacacacctgaaaagcaccagaaattatgatctgtacagaacaagctaaaatcttcataagaataaagagaagaactacacttttacatgaaatattccctagagcacaaggagtacacagtattcatctcccaagtcctacaaaggttgacagactcaggctagagccagtcacatcctcaggaaaaccttgtcatctcctagggcatagtactaatcataccttgttggtggcctctgtttgctggattttttcctggagttctgccaagtgggaatcagatacagactgctgagttatagtggtctcatgtgaattcagcttttgttgtttcagcaactcttcagtcatgggctaggaagaaacggcaaggaagaaacggcaaaacgagtaaggtgagttaaacatggccaacaaaattttttttttgtcttcaaaaatgtctgttgcatcttttgccagagatttagagaatcagatttgttgcataaattatcagtatgaattcctaaagacaggtctgttccttattaagaacactgattcacctccatttgtactatgctccccagcttccctctccacttttctgtaccaattcacacaaacactacatgtttattcagcgaaagcaagtaattcagagttcaatgagaaggggaggatttaataaaggaaatgcttacaatgaccaaatatttgctttattctatttttaatcaaggagttgaaaaggcatactcatcaaacttacacttcctgagagaagttacattccggctacctttcttacaacatgcttgtttcacattattggaaaaaattggcagattttgatatggactatatattaggtaacagtattttatcaatgtctaattttctaaatttgataattgtactgtaattatataagagatgtccttgtccttaagaaataatgcttaagtatttagggtaaaggagtatactatctacaactaattctcaaatggttcaagaatttttaaaaaatactgtgcaaatacagacagtgggagagtttataaagcaaatgtgacaaaatatttgcaactggtaaatctgggtaaagggtatatgggagttcttggtatttctcttataacatctctgtacgtttgaaattatttcaaaataaaaagagaaaaattaaaataaatttaaaatagatgtgcctaaaggcagatttatagcataagcacagataaataatccatagtgaaatgggaaagagatatattttataggaatatcaattcacttaaaagattcaggagaaaaaagtatgattttatatatgggacaatttatatatggaacaatgatttatatatgggacaataagataaacttattgaactattcttagtaatcattacaagctaaggatgttaaaataaaactacaaatttactgcggcaattaaatttgatcttcccgcctccatacctgcttccattccaattaggaatataaactcattaagagagaaaaggcaactgctattcattttttgtttccctcacactttcagacttgattaccactttcaaggcagtggagttacagcttaccttaaatcccttcctgccagcaactgactggaagcataaaaattgcagaagaaaaatctcttctattcctccagtgctatttatcaacttttctaacacctactaaatgctataataagcaaagcaccatgtgaggcactgtgaggaatacaatgctgacataacatatatctgttgcacactaactatgtgctaggcactgtcttgaagatagagtatcatgcaagacaaagtccctgtgctcttgaaacttatattttgcaggggttggagtggggagtacatgataaacaaacaaggaaatgcaaaaaatattatggacaagccctgtgcggcaaaacaggaaagcataatacagagtgggtggttaaattaccctaaattgtttgatcagagaaaggtctttatgaggcagcatttaaatagatatctgaaggaaaaagaatcagtcctgcaaagatcagcagaacaatccaggcagaaagaacagctaatggaatatgagcctggaaaagagaaaggcctctgtggctagaatagcactctccagtagaaatataatgtgagccatgtatgtaatttttaattttctagtagcttcaatgaacaaagtacaaaataaataggtaaacttaattttaacaaaatattttatttaacccaatatatccaaaatgttatcataaacatgtaaataatataaaaattattaatgagataacattattatctgagataatattacatgatttttcataagtctgaaattcaaggtatattttatactcacagcacatctcaatttggactagccacatttcaagggttcaacagctcctaagactagtggctagcttactggatagcacagggctagagcatagtgggcaaaggggacagggaaactcaatgaggtggagaggcaggcaggcaccaggtcacatccagcttcagacaacaaagttaatgaactggatttcattttaattgaaatgagaatagactgcagttttttaacaggtaatcatacagaagttttgaaaagatcatgctgtggtgaatgaattattggggagcaccaagagaagcagagagaccaggtaggaggctgctgcggtagtgcaggtgaaagacaatagtagcttggatcctggtggttagtaaagggagggggaaataaatggatagatatggatatgttttgaaagtatagctaacaggacttgctggtggactggatagagggagagggaaaaaagcagcaaggataatgacttctggaaaaattatttgagatatttgttgttgtgggtataacaggaagccttcacctgaggcaatatgaactatgtcacaccatgggcaaagtaaccacattaatagatgtttacaatgattctaactaataaataaattcatcatttacttaatgataaaaccatctctataaaatttggcttcttacttcttcagcgtaaaacaacagtaacacctacagtaagatactttgaaattcaaactacaacaggcagaattaaagaaaatagcttcaagtttaaaatggcaaggaaggtggtcatatttatttactttaaaccaaacaatcttacagtggtgaaggaaactttataaactaaccatctgatccaatcctattttacatacaaggaaatggaaacttagagaagtaattagtccaaggtttcatgggaaatcaggaaaaagatccaattaaactgaactggatttccactcaggttgggaatgtatctctcatttctataaacccattgcctaccataatgccgggaatactgcagagatcaaaagtttttgtttaatgaacaaataagaacaataaaaacaaacaaaaacgagcctttagtggctctcttagaaataagactgtatataacatatattcgaacagcaactttaaagccaaagaatgccacaggaaaatacataatgtatttgaatctcatatgaatcaatcttgacatgaataataataagaaacctctttttctataaataatgtactgacctaaaagttggaagatatttgtttcttctttatttgtaataatttactattttgcatctcagaaaaatgtccttgcaggtaacagtctgctgaaagagcacttagcaagtcccactaagccaacaacataatgaattcttgtgaagtatcaagtacataaaacagtcactcctacaatgatagtgtagcccatgaaataagtaatacctgatttggtagaatcagtgttactctctagacactcaggtactaaaatcatgtggaaatgataatataattttaaattaagtcacttttgactcagaattaggacaaaggctttccagtatcagaaaagagaaccgcttccaggcctagtgttgcacaatatgagacttttttttaggctaaggccagtttttagactttttgtgttaacagcagttttcttggcactttctagtcctcacagtagtgagttatagatctcaaactgctataattgtcaaccctattgttaataataggagacagacaagaaccattgactaccataaaattaaaggcctaatcttttaccagcatctaatgccaacatcttccaaagggcctgatccacttcacataactaaaataagagtgggataaatttaccatagtcacaaaggagcagaccttggcattgcaaggtttaaggcaaagatcttctgttctttgaatttagatagaaagggaaattgcacatgggccagagctcattgctgtttactaagggaccacatccctcccatcatagcttttctagttcagggccagacaataaagaagggaattaccagctagaagaaggcttcaaacctttctttagatatctgaacagccttaggtcctcatacataaattctgtagaagggaaataaattactttgtataatatcagaatatcagtaagcagaactacactgttgctatttttctttaataaataagaaaggaacaaagaaaaagacggaaagaaggaaagaaaaaaaagaggaaaagcaatcaggaggaatcctgatgtcaatatttaatagtgcataaaatatggtaagtggaggattaaacaaaggaatcaaaataaccttacagaacaatcttgctctttaagataaaaggttttctccatatttgtggcagaactgaactaaaggaaacatttttttctttcatggtttcgtgtttctacaaactaaaaaagagaactaccaaaaaaaattatattatttctattctttccatatttgttcagagaaatagacaaaaaccagtctgccattgtcccatctagcactggttttgtcataaggctcttaaggagcttaaaagtaaccagatttaaacaatagatacaccgcccattttatttacaaacatgttgggcccaattcatctattttccctgacatcctaaattattagagaaaatggcataataattaaatgccacatttcttgaagctgaatgacattttctcccacctcctaatttttgtttttctagaaacagtaaacaatgtaagtcaagtcacagcagaaaggtcatacactaccatcttaaagctctaatgtccaaatttagtgaagtaaagggacttgacctgaagatacagttaccatagtttatatgtgttcattcagatgacaatttttttcacataatctctaaagaatcctccgagcatccttaggttagagaaagagggctcctggtttaaaataagtacttacttaaattaatatacttcagacaatggggtttaatgtatagaattaaagtgtcttgcctgagaatggtcagaaatctttgtctctgcatgggctacgttagttaaacaaggaactttccatatctccaaattgagagactgcctgaagatgatctttaaaatccttctccactccaaaatccagtcaccaaaatatagtattttatttaaatacggagaaaaaaagatcttgttttggctgttattttctcagtctttatgtaacgttctacaatattggtcatatttggtggcgggctggggggacgagtttatttcccatccatcctggcccaactaattttagaccctaatatgaaaacaccatgtttaatttgtaacacctatgtctagtcacagaaatactgtaaagcccaaatttagctgcgaggctccactgaaagaaaaagcaaaagaaaagaagtacacagtgttaagcatacagtgcttaacattttatacaaaatgaaaatgcactgactttttacctttcatgacactttcatctatgctgtttctcatctatgctgcttctcataattttgtgtaaatttaaaaacttttctcctgttttctgcttaggttcttattgtgatagacagtatacataccatagaactactttccaaaaatttcaagtggccatcaacaatgtcacttatcaagctctaaatttctggaatgacgttgaccagtagcaggctttctaaaaaatgccttctagatcacatctacctttgtgacagtattgttaaataagttgtatcaagtggaacatgccagaatgtttcacaaagtttattgaagctagcatttactgttgctatagaaacaaactaccatagttgaatttaaaaggttggtacagaatcaattgggcagacacgaatagctcaaattaagcaattaagaattcaagactataatgaatgaaactctcctctgatccaataatgggttaatcctttcttaatatcaaatatcttccagtagaactcagtagagttctggctgtgaacagtttatgccttaatcttttgactgacaatactgtacttgaatacttgaattcctgtctcttttatgaatgagtcatcactaatcctcaaatgaactattaattctaattaatatggtccagatgttataatactttactggtggattaataggctttccccaaaccttttaccttatgctctaatcatttacaggcattttgcggatgaaggctttaatgctccaggaagaactaactagagaactaactgccttacagaaaaccattgggaggaaacgtctataaatctgaaaacaagaacaaattttaaaagttggaaaaaaaaaagaggtaagaggaaaagttctagtgccagaaatgagattaaatgtcttctttttataggaaaaaagtgaagtaggaatctttacctttttgttttaaaaggtatacaattttgataatgggaaagtcaacagattttacaaaaaggattgtgaaaatcaaattatctgagtgcaaatcacgtttactaaatgagacagagcaaaaggtgcagcaaaaatggggtcatgactaattttctcaagtccagaatatttctaacctccacctagaccgaaatcacgtgaagccagaggccagctagctataatcagaaaggcactatgtagccgttttgtatacctggacccggagcggcaaataatcttcacagagatcatcccacagctcctgcaggtctgaaagctccaagggataactcacaggtgtcttgtaaaggggtttcaaagacctgttaaggaaaccggaactaactccatctgtcatgctagggccaggcttggctccaggtaggctggatttcactggaatcggaagcctgctccctcgggggctctggatgggcttataatcaagacctttaatcatgctaagagctaattccagcttgtgattacacccatgctgcggagcctgatcatctgaacaacagtcacactttccaagttcctttgcacttctctcagtctcctcatctttctgttgtggagggctagcctggacgcttgcatccaaagattccacagaggaaccaggcgtctcttcctccatgctttctccatctgggggtacctttgtgcttgctaagtcgggtggcccaacctcagacaacgctggttcttcagtgcaaatgctggtcgaccacctgctagaagggccgcaggagatacttctggccacctttcgaggtaccttacaaatggcttcatagtcagaatcagcaacccgcaaagcggcacaaccacggcatctcctgggtcggtttccagggccttctgaaccatggcagctgtgtggctcctggatctgatcctcattctccacccagcactcaaaccctgaataggcgaagtcctcctggagcagtgcagagtatctcgcatcgggtaagacggacatgtcaaccgtcccattccccgccttgatctccgcgccagagtcatcgttattcttccgatacatactggcaatgcagaacttgaggcgatccttctccagtagcagcttttgcaagcgctcaatagaaagcgcttcaatccgggcaataactgtgtcgaatcgatagattcgatcaagcatgaaagcacacttgctgcaagcgaactcggctttgccatcgcgggggacatccttgcccaagacgtgcgaaagcagaacctggagattgagcttggacgccgtgtggaagatccagcgccgctggtttccacacagctctcgggcacagatcctgcaaatctccttcatcttccctcctagcgggtggcaagcttcccgaggcggcggcggcggcggctactgggtgaccactcaatggctcttcgccgcgctctgtctcccgcctcggtggtctccggtcagcatggcacagcccagtggggtccccactctgcaggggcgcgcccctgccccgcgcgccgactccgggtaccagagccgtcagccccgcccctcgggcagggggcgggcgtggaaacgcctaagaggatgctgagtgacagaggcgcaggccgcgctccgaccctgccatgtctctccccagctgtctctcccgccagccgccgcgtcctcaacgtcctccccttttagcagactgggctcccggagcagcagcggccggccgcgcagacgcaaagcctcggggatggaggatcagatttcaagatggcgccagcggcttcgcgtctgcggcctccacaaggctcttctgggagctgtagtccggtcagcgggcttccggctctgcgcatgcgaggtagccagcgcgaccctcgccccaaatccggttgcacacctggctcacggcgagtgcggagcagaaagcactactggcgcgggccacagccagccgctttcatctgctaagacctcacctgaaagtcgcaccagtgccctcaaggatcctcccgcctctgcaggatgtcgaggctcctcctcgcggggaggagaaagacgaatcccctccctgcattctcggacagtgccacgtcctccggctgccagcggggcagcgccgctaggtaccgctgcgcgccgcccccgcttcccgccagcagcctcacctttcccggccccgccccgcctgggttctaagggcctgaggctgcgaggcaggcgagggaaggcttggtaacggaggggcggggccgtgcaacccttacctcgactctgaacaggaatgtccagaaaagagtagaggagtgtttctcccttgatgtgggtgggggagggttagtacccgtgggtgacttgcccttctttagataaaaaagcacagagcagtcacctgagaaagagtccggcacatacaatgtgaatctggttaaccaagatcttgaagatagtagaagagaaatgggcttttttaaggatgcagccagccgcgagtagattaccaccattgaagtccctttccctcaggtagagggcagtcattattttaggacaggggacggtagacaaacactagcgcaaaagacagtgcttctttccgtaagagctggagtgtctgggaatgcagctcgcgccagaaaggactgggaacttcactgacttcggtgaaaaccatgtcttactcagcattgtacagtgataggtcctccacccttgggtccaaaacttagattgcacacaaagaggagggaagctggagccctgactaggtagaatgctggtacctccggccatttttaataaggaattatcttcctggcttgagaggcattcagacacgtaacaagaggaacaacctcagcaatcacttgcagtcccctagagcaggacatttcccagttctaatcatgctaaatttttactaacttgaccttgtaagctaaggccagcaacatctaagtttttctgaacctcatccccaggacagagtccatactcctaagcctgaagacatccaaatgccatctctgagagttcataataagcccccaaacttcttattgaagactaaatgagatgattttgaggaaatgctttaaccgtgtttcgctcattaaataatagctaatattattattttactatgaattggaatattttcagtaactttaaaacattatggggccctgcctacataagattgtattgttctcttaatcaccaaagcaaaatcttgtagctccattgtaagagaaaaggacagttcttagagctttgggcttagtaggtgatatgatttgaatatatggccccaccaaatctcatgttgaattgtaatccccagtgttggaggtggggcctggtgggaggtgtttggggcggtggggggggcagatccctcatgggtttgtgctacctttgcaatagagagtgagtttttctgagatctggtcatttaaaagtgtgtggtgcctccaccgctccatcttgctcctgctctggccatgtgacttgtttgctcccccttcaccttcctgaagcctccccagaagccaagcagataccagcaccatgcttcctataaagcctgcagaactgtgagccaattaaacctcttttctttatacattacctggtctcaagtatgtatagcaatgcaagaatggcctaatatcataggctatagaattttgcatatgtaatttcatctactatgtatattctgactcaaaaaccaagaatagaaaagcagttcaagtaaaaccacagctgcatttttgcctgcctctaggtatgtgagcttcaaagttggaagaaattaagcaacatgctttggaatctatggtgatctatagaaaggcaaagtttctggactcaccctgactgatggaaagacagactgcctgccaggacactaccctgctgtacccagtcttaagtataataaagatctcattttttactgtcaatgcaagccacattttcctattaggaaaatgtgaatgaaacaaagtgctcttcaagagcaaaccctgaattatattttgggttattctctgttcctcaaaaggattttgcatctaactgatagtctccaaattgtaatgacagtatatagatagcttggtgtagacatacaggtcaatacaaatggagaaaaggcaatttgccattgaagaatatgtttgctttaagtaaagatcaatatactaagaaagctatacatatctagacttccaaaaacagatgggaataaactactcagcaatcagaatattcgaagatggcactctgttcacttccagagaaaatagttcaaaactgtatctcaaagtggatataagctattgtactagaattagtccctgtgtgagcatttggcattataaaataagatgttcccaattaaaagatcactggtatgtagataataaaacgtgaaaataaaaatttaaaaataaaacaaaaattatgtgataatcaattttgcactccttggtccttaccattattatcttgtggtcaagagtttgcagttgaactggttacctatggtggggctacacaaggacatttactttttattctacatactgtgtatcatttgaattttggacaatgaatgtttattcaggtattaattttagattttatttaatttagaaaacattttatagttaaaataagggctgccaatttaacacactaatgtcagggtctaagtggtaaaacttgaacctaaaataagaatttttatactacctatgataaatatataatataagaagataacttatataaacaaaagttcaaaggggatccacaagttattagtaatggttatgtctagagagtggaattatggacatttattttcttttttccttattttctataattttttacattatgtattacatactttaaataactttaagtacttactgcttttgtacttaaatatataaaaagaaaaaaatataattgttactaagaaaaaggtagatgaaacacattttggtgtattcatacaatacaatacagtactagccagcgatcaaaaagaatgaactcagatacatgcaacgtggatacatcttgaaaacattttaagtgaaacaagccatatgcaaatgagtacatcctgtgtgattccatttatttgaagtctgacaacaggtctacagccgtactaccctgaatgcacctgatattgtctgaagtctaataacagactataggaaaaacagatctattgtgatataagtcaggaagtggttgaacggtgagagacagggtgagaagtgattgcaaaggggcacaaagaaattttctgaggtgatgaagctgttctgtatcttgttttggatgaagataacataggtgtatagaattgttgaagctcattgaactgggcacttagatctgtagattgtatacatagtatatttcaattaaaaagattaaaaggagtaaataaaactatgtgtttccctcaaaattttaatttgagggatttctttggtagaaagtcacccgcactttaagaacagttttgaaaattagggaaatgctataaaatatagcccagaagaaattctgtaaaagacccaattgcaaattaaaaacttaagcctatccatatgagtttttttttttttttgagacggagactcactgtgtcacccaggctggagtgcagtggcacaatctcggctcactgcaacctctgcctcccgggttccactgcgccccaccttaggataatattttatatgcatatgtacaccaaacacttatgattggaggaaggcatgttgttaaggtgagacttagggcttttgtaatgatgtagtataaaattattacttctaaaacgtagtgaaggcacataacgaaaagtttgagaataagcttcatattatgattaaacaaattattaattttatatatcaacagttcaccctgaacattgattaataaatacatttacaagcatttacttgctttatggcctaggttaagtcacttatatctggcttttaatttcctaatctacaatgaaatatgttgaatttaaacagcagttttcaaacttaagcatgcatcagaatcacctggagggcttgttaacataaattgttgggacctacccccttgagtttctgacacaataaggtctggggtggggctcaagaatttgcattcctgacaagttcccagatcatgttgatgctgctatctgggaatcacactttgaaaaccactgaatgagaactatcctaagctgtatcagacaacagatcagaacttctgcagatagacagaaaagcacaccaatgaagaactacttacaaaatctatgttgaatttagagaactgtatccgcatgtggaacaagatttctaaatattactgtggtatggggtgttttgcactatctctgttttgacctctaaattttgcagtcaccatagtcacttttgcaccccctgtgtggcaactgggttgtagtgtttctaagacctacttctgggctgagagggagtttccaaaagaattggagaggtggaaaatccccatgtcccaaaccagttgtattaggtttcactgccctagttatgacattggaaatagctattctaattactaaaaactatgcaccaaaagaaaaatgtgattctggcagagaaactaaggcagatgagaaaatgcaagaatgtcaaagtaaagccagttaggctttgtggtaacacacaggcagttgcgtgatttccctgtgctctttggaaacctttaagaagtcagaaacaatcatgctttccattaattaacaacacagcatcttgaaatgcttgttttaaagccaggagatttccggttcatctgcagattatagtagtatgcttctcagcaaaatccatctaatagtaaacattagagtctttcaagttattaaatacgcataggttgttaagtaaattttaaagtatttgttaaatcaatcaatgagcaagaatgcaaacatacctttttttctctcttcaatgagctttcagtttagttaaaagggagaaaaggtgcacgctacagttagaacaattgactggtaaactaaatggtactgaattaaatttagtgtgaatacagaaaaagtagaggttagtatgggctggtatagttgaagggacaagagtggcacttgagatgggtgttaggatgaagaaggccaaggaagggactcagcaaaataaaatagcttcattaaaagccacggaacttgggttaaacacagtgctagcctgtaggtaaagagagatgttggggatttttgaatgaccaggttcatccatccatacatctaatcctctatagttgttcattcaaagaacatgtatcaagagccaactgtaagccagacactatgctatggagtgccttgccaattagaatttggttaatgttttgacaaaggcaaaagaatttggacttaatgttatggatttaagcagacaatgacatgatgaaaacctttttttaggaagattacccaggcaacaggatggatggtacttcctttttttttttttttttgagacgaagtcttgctcttgtcccccaggctggagtgcaatggcacaatctcgactcactgcaacctctgcctcccaggttcaagagattctcctgcctcagcttcctgagtagctgggattataggcatgcgccaccacacccagctaattttgttatttatttatttatttttttcaatagagatgaggtttcaccgtgttggccaggctggccttgaactcctggcctcccaaagtgctgggattatatgcgtgagccaccgcgcctggccctctgcttccctcttttctaatctgatggttaagcccttagcattcccttgactctggaacttttgcagagcaaagagcagaggctgtttgaagccagctgcatttctagacttttatgaaattctaagcccactgcaaagattgagccagatgtcccattggggaagagaggagagagaaaagtttttgaagtcagcgaagaggagagagtgacatttcacacagatggaaagagactggaggtcaaagagtaacaagtacccacctccattccatatcagtgccctggagaagcagcaggacctcagagagggaagtaatggggtgacttggagaggctgcactttagcaggggattctggctccataaaaggttaaatatagcaagcttctagggttggcaaaaccatgcttactgaggcaggggtggtttagtggcagatcaacgatcagagtagtctccttggtgctttggtaccaggtaaaacctagggacctttaaatagctgagaaagtagggagaggaggaaatatcaaacgtatgaaattgaatttctcaccatcctgattcagacaggggctttaaattgatgactaccttagatttatgaactaagagtcatacactatgaacttttgttcattggtgctcagtcctagacccttttcacctctctattctcttctggtgtcatctcatcctttcccatctttataccagtggcttccaatttatgtttttattgtagaattctcatctgagtgccactctcaaatacctggttacctatttgatatctgcatgtggatgtgtcatagacatctcaaaattaccgtaggaaagactgatctcctgactgttgtcttccccttgtttaaagtgcctccctttcctcctaatactttatatgaggagtcagaaaactatggactgtggaccaaatccagcccccacctgtttgtgcaaatacagttttgttggaacacagccatgttcattcttatgtgttgtgtgtggctgtttttatgcaacaatggcagaaactttacagcctgcaaagcttatttactatctggccctatacagaaaaagtctaccaattcctgctctttgctttcttcaatgtatttatcacaatttgaagttatatatttgtttcattatctgcttatttatctgcctccttccatagaaggtaattctctagtgcctaccatgacagcaccattgcctagtcatggtaggcactcaattgttattgaatagaatgtatgaatgagaaaatgaactattatatattaaaattttattttggtcttttgccttagcacaaaactttcatccttccttaccctccaatgacttcatatctttgttttgttttgtttttttctgagacggagacttgctgtgttgcccaggatggagtgcagtggcactatcttggctcactacaacctccacctcccgggttcaagcaattctcctgcctcagcctccccagtagctgggattacaggcacgcgtcaccacacctggctaatttttgtattcttagtagagacagggtttcaccgtgttggccaggctggtctcaaactcttgacctcatgatcctcccacctcggcctcccaaagtgctgggattacaggtgtgagccaccatgcctggccctaatgacttcatatcttaagtaacaagagtgctaaaataatgagtcccctcaatttctttgccctctactctatcctcctttcagattaatctttctaaaacagagctcagatatcactctccctcaaagaaacctggagacccaatgacttgtccattaatcctaaacttctttacctgcttcttaaagttctctgaatctggctccactctatttttctgtccccctatattctattcctgctactacttctctaccctgaacttccccacctctatacttcatacacttggaatattcttttctatcactaccacctccacctatcaaaatcctatccacccttcaagtatttcctccaagctgcctttctgagtaccaccaaaagacatctttctcttcttccatcttccaaaatacttttttgtacctatagtaacttgtatgtcatttctccatactgcgttctccccattagctggtaagctacttaagaaaaggaaccacagctttctcatcttggtatctgctatggtttgaaagtttgtattcccctccaaattcatatgttgaaatcctaacccccaacataatggtattaggaggtgggggctttgggagagattagtgtccttataaaaagagacctcagagagttagctaatcccttctaccatgtgaagacacagcaggaaatccataaaccagaaagtgggccctcaccagacactgaaaatgccagtgccttgatcttggacttcccagcctccagaactgtgagaaatgaatttctattgtttataagccactcagtctatggtattctgttatagcagcctgagtggactaagactgcttctgaagtatttggaacagtatctttctagatctcaataatcattgaatgaatgaataaagaaatgcctttccttttcatatctacttggtaaaatcctactcattcctcagagaccaaaatctttgcttctgaccccagtccatgatgatttttcctttctgtactgccttgtatttttttcatcagtgactttctcctattgtaatctctagaaggtagagactaaatcctgcacatctttgtgttcttcttccttcacctaacagtaccttgtgcattacaagtgctcagtaaatatttttgattaagttgtaaagcagctgcctatttttccacttcctttgctgctcaaaaggattagagcaatgattgctttagctgctaaggcctgcttcagagacacattattaatgaaggttgtctgggagacagtaatgttgaacggggatttgtaaatgagtctccagcttcaacattcatcagcaaaagaaggggatactgaaaagctactctaaaaaaaaatctcatatgaagttgtccggagctgcctgagctactaatcactgcaaggttttcagtctctgccttgagcatttagagcacattcttgccttaacctccaagtcagatctctccatggtaacgcaggaatgtttgctattttaggaaatatgcctcactgcatgcagtactatttacattaagttccaaacaaggcataaatgcaacagcttgactgtgctaatttgtgtgagtgggaaggtctcacttacttaatgtgggcctctccctaattgtgttatcctgtctcattttataagccaaccacagtgagattacatgttaataaattttgctcatcttatactgaaggagaaatgcagagagagaaaaaaggcgacaaacaaaacaagaattcctccagacctccctttgcaagggcatcattttttctgccttcacaccctccaggtctggtttcatttaaaaccttcattgagatgaagcttctaacattctgtagaaggaaataatatcaataactgaaacaattgctagcttttccctgcaactttgtagatacctttactgaggaagagaaaaatgctttgtaaactttattagattttctgactccctagtgaaaaagatgtggacaagatgtcacagcctcacatcaaaaagctcctcaacactctgatcacacatactattgatctgaatggacatcaagaaggattggaaggagatatggaatgatgtcagtcaatggcatatctagttggtggtactttttttgctttacaagaagttaattatagacgttcataaatactgtgcaagtgcactcccactaaaatgaatgttgtagaatgttttggtagaatggaaaaggaaaacagctagaaagactgtaagatcaattaaataaaataatctttatcaaaagtgtctgtcttatttgagagaatgaagactctgaagtgaacttcctgtactcagatattacagtgagtatattatactcatactccagactttcatactgggatcacttgagagatagttatctgtgggatgtggagtaaattagcgttcttcacttggacaattcagacctagaagtgcaagatctgtgagctcttctttcttctagggcccaactgtttgtggtattctcagttgtgaagtataggtggaattaaaggaagtgaataggtctttagaacttaagctcctccatactccagctgaatcagtgagggattccagggatggcttcactggagatgaggagattctttagcctctgaagaacaggcccagagcttagaaattgaacttttaccttccacattgtaagggtctttcttctgtggtgacagttggcatggcagacaaggtttgagtagaatacagtggaactataactgttacagtgaaagtatactgttagcagagaaggataacacccacaacataggctccaagtgtcacaaatagcaaggttcaccatacattacctatgcagaggggagagacaaagtgctttgtaattggttttataatattcttttccccaaccaattcaaagaacagacttgacaaagcagttcatagctgtgtcagattatgatttgctctctgaggaggtgacatcaattatctcagatgctcttcaagcaatcctcagtttccacgacaactaggattacctttctaaatgcaaatcatatgcttttattccccttgctttttttttttctggtgcctacaacatgaagcccttagctcaacatttatggtactttccagctatatattttatcattctccaatacttatttttggtaacatcgattactcccaattccttagctgtgttccacatcactgtatatattgctccgtttcctattttctgcctggtgtatccagtctttaaggcccaacagaagggtgacctccaggtgagttcctccttggagttaattcctttcagctgtgggttcctttagcaccatgcgtgtatttctgtctcctcatttatcacactgtattttagttctttgtttacataccagtctttcactggactataaacctttggaaggctaggactccctatactagtggtactcactgagcaactgtctcatctcctagagagcattttgaaattttgtgggggtgtttcttgtttttgatgttgtcacgatgataagtgaggcaagggatgttacaggacaaagtattgtaccaaattccaaatgacttttggaatttgaatgttccattgggtgatgataaaactgtttacaatcatctgaacctagaactttatataggagcatgatgttaatttacactaaatttttccatgaattaaactactatgtaaattgagggaagacactaccagtccttgggcccaattttttttcccataagacgtagacccaaagggagaaacaaggaaatatgctatgggaggctttctattctccacacttgagaggaccaactatcagcggcctcctgtggcagagctttccaacttgggtattccagcacagtgtacctcagcatggtccaccactgtgcaaagatgctgatcccctcagctctcagggtggtgcatgggtcctgaggtggccataagcaattgcctcaaaccatgagcagccatgggcacttatttcagaataccatagatgtacactcatttcctatgaaaatgaattttctatgaaaaagggtaggaaacattgtcttatagaacaaacagcgcaatgtatcaggttttgaaatgtacaacgtattgggtaataacaacaataaatttttattaggcaatgtttaaaaagcatatcaatttagtacagtttatatgatttgatgcatttcttctgcccaatggtcatgcaatattatcccctggatgctgtacttattcttgttctaagcatccttttagagtagaatataaataatttagtctctttgaaattataatcttttggttctttaagtctgttctgaaaactggtaccaaaccaattccttaattagcattgaaaatactgaactaaatatattcatttcagtgcttaccaaagatgatgaaaataagtatatgtacaaaatattttagtatttatgtgcctgtaaatacaaaaggagcaataaaagtgatttcatttcagaaggtgaacattttgaaagaaataatattcatgtaaattctgaactaaaatagaatgaaataaaattctgaaataagataaaaatagaatgttagcattataggaaactatagagattatttgagctaatcttctcattttatgtatatggaagctgagaagtgacatatccatagtcatacagctaataaataatcaggatggaatcgcttctcggccttttggctaagatcaagtgtagtatctgttcttatcagcttaaataatcaggatggaaattcaattcttcttattctcagttgagctttttctaattaaatgtattacgaaatattttcaagagtcccttaagaaaatttccacatatttcaacatgtatcttgcaaaaagcctatgaacttcaatttgtattcatacttgtaaaattatgttcacacattatttcttgagtttgttaaccaatgctttccaaccaaaatggagctgcagtctaagaagtttgtaattgtggccaagatagtaattttttcctgccctcatagtggcctaagcacccaaattggccacctccaagtgagaagcttcatccatttacctctataccttacaaatattatcatttgccatgaaatggaaaggttgggaagcagtggtttaaactaattcttatcattgctcttttatcttgaccccaacctttccatatgtgaaccagtaaagtaaaccacccacattttgtcttatcagtagtctaagaccagtgcaagaatgtaaggataccaggtaattgcttttgttgtttgggtgcaggtatattctaaagttcttttagaaaatatctttttagtaaattaaaagttgaatgaaggagaggagttcccttcgaggtaacttcccagaaaatcaatgcaattattttttaccacagtgagttctcttttcaatattaaaactacattatggccaggtgtggtggctcacgcctgtaatcccagcactttgggaggccaaggcgggcagatcacctgaggtcaggagttcgagaccagcctggccaacatggtgaaaccccatctctactaaaaatacaaatattgctgggtgtggtggcatgcacctgtaatcccagctactcgggaggctgaggcagaggttgcagttagccgagatcatcccactgcacttcagcctgggcaacagagtgagactccaactcaaaaaaaaaaatttttttttggaggcaaatttctatcattatctgatacacttggacggaaatagtaatcaccatttcaactagtacccagcacattttcaaggacctggaaggttcatactccaatatatacaaacagagaatatgcctagctcatagatgatcaataactgtttatttgaacccatagtttgtgtacttcggcacagtattttacaacttaaccctcaaaaaaacccctaaaacattgtatgttctgtataattataaatcacttgatgtggctggcaaattctaaggtggtccctataattctcacccactggccatcacatctttgtgttatcctcaccccttgaggatgggtagaacctgtaacttctaaccaatatggcaaaggtcatgaaatgtcactgcatagttatgctatgttatatgaaaaaagtaaagaggtcatatagatgtaattagggctgctaatcagttgattttaagttaacgaaaagggatattatgctggtgggcctgccctaatgagccccttaaaagaaagtctagaagtgagaaaagtaacagactctttctgctgctggctatgaagaaggaagctgccataacttctacagctacacagcaataaatccttccaacagcctgaggagcttagaagccgatccttccctaggtatgcctccagatgagaaaagagcccagtctacatcttgatttcacacttatgagactccaaacagatctcagctaagccatatctggactcttgactcacagaaactgtgagataacaaaaataaggtgttttaaactgccaagtttgtagtaatctgttacacaacaatagataacaaatacacttagatattaaaaagcagggcttatgaaagcatgaagcaagtgcttctggatgtactgaccaaaccttacctgcacttccatgctagttggctcctccaacagatgtagcagttgttgtttctcccgagatagctgttctacaagcctctcctgggcagccaggctctgattcagttcttcaattctcctgaagcaaaggaaaagtaaggacagtaattatgatcatgatactattattaccttattttttcagcccattccaaagatagcatggtctagtatagcaggtttttatccttttggatcattgaaccttttgacacatttgtttagaaaaccatgtattttctgcccagcccccaaatatatacacaaacaactttttgcttacattttcaccacgttcatggacctcctgaagttaatccatggatctttagaccataggaatttaactcttggaataagggcctagaattttttggtggtggtggtagtggctgttccattcaataaacggttcttggataactattttgtgtactcaatgcactctaccaagtactggaaatatgaagttggaaaagaaacaatcgctgttttgcaaaaatttaaattccaccagcatgtgtttgctagtgatttggagagtaagaagacatacagctacagtcacgtaccatatactgtttctgtcaacattatgtcatcatactgcatgtatgatgatggtccaataagattatactggagctgaaaaattcctatcacctagtaaagtcctagctgcagtaacatcatagtgcaatgtatttctcacttgtttgtggtgttgctggtgtaaagcaaacctactgcactggcagttgtatacaaatataacatatgtatagtatgtaatacttgataataaatgttactggtttatgtatttactatactttcattgtcgttttagagtgtactctttctacttattaaacaaaataactgtaaagtagcctcaggcaggtccctcaggagctattccagaagaaggcattgttatcataggagatgacagctccatgtgtgttattgtccctgaagaccttccagcggacaagatgtaaaggtggaagacagtgaagctgatgatcctgacactgtgtaggcctaggcttgtgtgtatgtttgtgtcttagtttgtaacaaaaaagtttaaaaagtaaaaaaaaaaaattaaaaatttaaaaacagaataaaccttttctagaataaggatataaggaaaatatttttatatgactacaaaatgtgttttaggccttcacattcatccacttcactactcactcgctaaatcacccacagcatgttccagtgctgcaagttccatttatggtcagtgccctaaacaggtgtactgtttgttatcttttatacagtatttttactgtatcttttctatgtttagatacacaaatggttaccattgtgttacaattgcctacagtattcagtacagtaatatgtcatacaggtttgtagcccagaagccataggctataccatatagcctaggtgtgcagtagcctatcccatcaaggtttgtgtaagtatgctctgtgatggccacacaatgaagaatgaaattgcctaaagatacatttctcagaacatatccctgtagtttgtgatgcatgattgtatataagcaaataatagtaatagaatataataaatgctaccagaatagaggcaccatatagtacattgagtgctgccatagagctataggatgaaagataaagaaataattcatttgacttgaaggagtatagcgatgctcaggagaagaaattttaaagattgagtggtttcagagtaaacagacaacctacagaatgggggaaaatatttgaaaactatgcattggacaaaggtccaatatccagcatctataagaaatgtaaacaaatatacaaaagaaaagcaaccccattaaaaagtgggcaaaggacataaacagacacttcaaaagacgtacctgcagccaacaagcatatgataaaaagctcaataacactgatcactagagaaatgcaatcaaaaccacatgtgataccatctcacaccagtcagaatgactatggttaaaaagtcaaaaaataacagacgttagtgaggttgcagagaaaaggaaacacttatacactgttggtgggagtgttaaattagttcaaccactgtagaaagcagtatggtgattcctcaaagaacaaaaagcagaactaccattcgacccagcaatcccatttctgggtatactcagaggaatataaatcattctaccatgaagacatatgcatgcaaatgttcactgcacactatttacaatagcaaagacttgggtggttttccaggctcagaaggaggagattgaacaaaggaacaaaggcatgaagacccagtgtacaatttgggaagagtcactggaacaaaggcccagggaagaggcaatggctggagaagagactgaaaattcagaccctcagactagggttaagttgtaaaatactgtgctgaggtatacaaactatgggttcaaataaacttattgatcatctatgtgctaggcatattctctgtttgtatatattggaacatgaaccttccaggtccttgaaaatctgctgggtactaaatgaaatgtttccagttgtgattctttttttttttgagatggagtcttgctctgtcgccagactggagtgcagtggcgcaatcttggctcactgcaacctccacctccctggttcaagcgattctcctgcctcagcctcccgagtagctgggactacaggcatgcgccaccatgcccaaccaatttttgtatttttagttgagatggggtttcaccatgttggccaggatggtcttaatctcgtgatccgcccgcctcggcctcccaaagtgctaggattacaggtgtgagccatgattcccaggagaaataacttttaaaacttaaaaacattgggctgggtatggtggctcatgcctgtaatccctgtaatcccagcactttgggaggctgaggcaggcggatcacctgaggtcaggagtttgagatcagcctgaccaacatagtgaaaccctgtctctactaaaaatacaaaaattagctgggcgtggtggtgcacgcctgtaatcccagctactcgggaggctgaggcaggaaaatcggttgaacctgggaggcagaggttgcagtgagccgagatcttgccactgtactccaccctgggcaacagagcgagactccatctcaaaacaaaagcaaaaacagaaacaaaaaattaaaaacattatacaaatgtaaactgcaatgatgacgagaaggaggaatgtggactccatatgaaattccctcatggtatctgcactagaacatctctacttttcttaaacctcaaactttgctcatctctttgacccttagtctccacagaggatctgttctcctactctccaaaattgttcaaggtcatctgatgagtggcctcaatttattttcagatgtgcatgtgctttacttggggttttgttttggtttttagttcagtttttttttattggggttcaaatatgacactgtcttggggaacctagtagggaaaatctgaaagcaaatacagtaccatactgagaattgtacaatatgtatatatataaaagaaacaatacagaaacttcattctgctatcacaaagccttcaaagaaatgacgattgatgccttagtgaggttcactagaagggaaaaagttggcagatgtttcccacagaaggaaaagcatgagcaaaattctggagacttgccatagcttcttatgcttctggaggcagtatggcttcagggtttggatgtcagcaatccctgaaaccatgtttcacaagtctccagatgccaattttttcattaataaagtataataattcatatctcatggggctgttaaacaagaacataaagtactcagctgtatggtaagagctcaacaaagcttagccatcattattattactagcctggcatgaatgaagttaaggaatggtggtgggtgatgagtgtgggagaaatcagaggttacatcataaaaggctttgatggtcacattaggagtatggatcttatctcctaaaggtattgcaaagcttcttaaatggctctgccatggtgcgattaaatttatgtcttggaaagatcacattggtcatggtatgcacatgtggtttttgcctattcagttaaaagctccttaaagctttttataccaccacagtcttatgcacctaagaggctaaattatttgccaatttgttgttgttgaattatctatttcagaactactctgaattattaggttgagattgaatgagaggagcaggactggaagtggagaggacatttagaaagtttcctcggtaatccagacagtagatggtggtgacctcaataattgcccagttaccttcaggacaaagtccaagttccttataatggtatacaaagctggcacaatcagacccctattctcaaaacagcttacctctcacttgtcttctcacttgctccagttatgtacaattatttaaagttcttgaaatattcctttccctgtgtcttccctccatagtttctccttctgcatagaatatttcctttccctatccactttctacctatttattctacctcctattcatccttcaaagctcagctcagatttcgcttcctctaggaaaacttcaatggcattatcttagtctttttgggctgctataacaaaacaccataaactgggaggattataaacaacggaaatgtatttctcacagttttggaggctgggaagtcctagatcaagtcactgacaggttcaatgtctggtgaaggttcacactctggctcataacggtgcattcccactatatcctcacatggtagaatgggctaactagctctctggggtctcttttacaagcgtattaatcccatttatgagggctccatctccaatgtctatgatttaatcacctcctaatggctccacctcatactacttctggaggcagaagtattaaccttaagggttaagatttcaacatataaactggtgggggagggaggtggggatgggacacaaacattcagaccacagcagacaacttgctcttttaatgtggaatggatgaccctccaatatttccccagagcaccccatgctcttctatcagggaacttattaaaatcatgtaacatgtttcttggtgacaagaattaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatggataccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcaccgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaatggggttatttgtttttcattgttcaattgttaaattccttatggattctggatattagacccttttcagatgctagttgcaaatttttttagattctacaggttgtctgtttactctgttgatagtttcttttgctgtgcaaaactctttagtttaaataaatccgacttgtctctttttgtttttgttgcaattgcttttgaggacttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgacaggaatagtgttgaatctgtagattaccttcggcaatatggccattttaatgatattgattcttccaatccatgagcatggaatgtttttccatttgtttgtgtcatctatgatttctttaagcagtgtttcatagttctccttgtagagatctttcacctccttggttagatgtattccaaggtatttttttttttttttagcagatattgtaaatgggattgcattcttgatttggctctcagcttgaatgttattggtgtgtagaaatgctactgattttttttttttgagacggagtctggctctgtcgcccaggctggagtgcagtggcatgatctcggctcactgcaagctccgcctcccgggttcacgccattctcctgcctcagcctcccaagtagctgggactacaggcgactgccaccacacccgcctaatttttttttttctatttttagaagagacggggttcaccgtgttagccaggatggtttcgatctcctgacctcgtgatccacccacctcggcctcccaaagtgctgggattacaggcgtgagccaccatgcctggtgaaatgctactgatttttgtacattaatttttgtattctgaaactttattgaagtctgaaaatatttttaataattttagtaatacttgtcatttaacactaagcttttaaaaaactgtaaattataaaagtaaccattttagcaatataaatgtatataaagaaaaatatcaagtcttctccctatcacggactgtgatctcactcttcctcagtatactataaatatcactcagcaacttttcccccttactttaatcaaggaattcccactaggacaataatatagagctaactcattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctcgggattgtttgatcaaaggaaatcctccttttttattataataggtagcatcccatactaaaaatgttgtcacaatttacactcactggtagtgtatgagagtgcccattttccccaaatgttatctcagctcttgatgttattataggctgactgatactttttgataaagcttatttgcatttgtctctactaaaagtggaaacattcactgtttcaatttagttgattgctgactgataggaagtttgcagtcttaggtctggtggatttaccaacttatgacaaggtccatctgacctagtaatagagaaagagcccaagggaaacacagcatatgaaaatctattgtttcagttcctgaatcagatacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcaatgttctgaaaaacacacaggcattaatcgttattaactgccacagacactctttcctggatccaggttcctatttgagtcttgccttggtccacagcctctcacctcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcctgaaaacgaaattgctggaataatacttttaatagaattatagtaatagaacaatacttttaaatgtctggggatttaattatttaaagaaatttggttgtaaacatttttaaaaacaatgcttttatcataaaattggaattttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtctggtgcaggttaagtggcttagtgtgtggtaaggagtatagaaaatagtttgcaactagtttgtgaaaatcctgctaagacaactagataggccggccacggtggctcacacctataatcccagcactttgggaggccaaggcaggcagatcactcgaggtcaggctttagagaccagcctaaccaacatggtgaaacctcatctctgctaaaaatacaaaaattagctgggcgtggtgacatgcgcctgtaatcccagctacttgggaggctgaaacaggagaatcgcttgaacccaggaggtggaggttgcagtcagccaagatcatgctgctgcactccagcctgggtgacagagagagactctgtctcaaaataaaaaaaattaaaaaagtaaaaaactggataataatcagtagaaatcaaagacttatcagggagctttaagcaaagtattggcatgatcgggtccatgttgaagaaggaattatgaagaaggtgggtgggtcaggggcaactaaccagaatagggagggggactgtctaaggacaagaggtacagggagaaagactcaaaagacatttcagagacagaagccacaggccttgatgacttgtgagattcagattagactggagggaggaccaaagacaatgctgaaatttccagcatgtcagtgggaatgcattctattaactaaaataggggcaggtttgtaggggaacctaaggaggtttctgcaaaatgttaattgagggattactttatttcagcttaaacgttagcatgcaaagatggattagtcccttccctgatgaagtccataatacagtattaggcaagaagaatgttatttagtaaagaagtctttagatcagaggttgacagagagactgaaggtaaagtagctaaagtatgaaaagtagtattgtgggtactagaacagtagggaggattttactttactatcgccatataataaccaccaacacctagacttctagaagtccaaggcaacatacaatagcagcatattttctaccatacttgtgaaggcatttcataacccatgtttccatgcagggtggtcgaaacacaaatactaattgggaaaagtagaaacctagtttagatatttgagagttacttagaattaaagaattttagagctggaaggcagttggactcaaggcattttagatcatattactagtatgtttttagtgacatactgagaagaatgtttgttcccctcataagtaggtaccttttgaccaaggttagaacatagattcagatccagtgagatgaaaatatcctaatttcttcaaaagaaggaatgatagccctgtcttttcaggatatactttaaagttattattttatgaacactaaatagcattaccagatttagcaaataaaaatataagatatctacttcaatttaaatttcagataaacaacaaataatttgtttcattagaagtatatcctttgcaatatttgagacataacttaaacgctaaaacattgtttgttgtttatctgaaatttaaattgaattgagtaccctgtattttattctgcaatacaaataccaaaagattaacaaatggaaacacgcatatttcaattttgtatgaagaacaagtctaagatctctatatcagttccatggcctggcactgcaagaataattcatctgtaccaattgatgaatcagtaaaatagaagatttgctaaacagttgctatgtccccagctttgtggtcaatacttaaaggaattcaaatgtcttcataaaaaatagtccctaagctagaggcccttcatagaggtgaaggaatatgcattcaattatgtgggaaatgcaaagagggagcaacttcctaatctgtaataggcagataattgtattttcctcattcataaacctacctgagaggatcgtgaggcataaataaatcaatacatgtaaaggacttaggacagtgtttctaacacaggtataactataattttaattataataatattattatcaccatcatcatcaagaacaacagcattatcatttggaacagcagtttgctttccatgagaccataatgtttcaagtggattcagtgttcaggatatggtgctgagaaagaggactcctaagtttattattatttctgccaccaattgattcacttctgtgaccttgggtaaaattctgctaaggcttctccacctggaaaatgacaaagagtgggcaaaaagctatttaaatctcatatgaaagaaaatggaatctataattatgaagtgttattatcaatgatattcctatgcctggctaatttatataaatcagaaaagtctggatatgctaaaccacctcagataagccaaaactgcttgagcagattttttaaaaatctcatatctaaaaatacgtgaggtctcaaatgactggagctatatggatgtcctctgcctagttcttagtctcatgatgtgacatagggaatctctatcaggtataaactgatcaacagaaagttccctgaaaagtcccttactattaatactatttttgcatgaggaatctttgaatattcaaataaaaataaacaaacaacagggaaagtgagaggcactatgaaaccaacctaaagccagaaagaattaggttcgaatcctggctctatcactttcctgctaggtgaccttgggcaggttaactaatcactatgagcctcagttttcttataagtatagtgtggttgctttgctttttaatgaagataagtattcacgagggattctgtgaggattgaatgagacaatgtgcatgataagcatagaacaatgccttgcacacagctgtgcaacaaccttgattcactttcccttcatgtccaggctgactagtgccagtcagagaccccagccttaccaggaaaaatacttagatctaaaaggaagaaaaacagaggacataaattagtacgttctatctgttctaaatcctactgaagaaaatgaagtcaatgctttgaccaatttggccaaagattcacagatttgaagacctcagcatttctgtgttctagttctcttagtttaaagacaaggaaattgaaatccagaagggttacctccaaggtaaaagccgtaactgaaaccaacactccactcttgctttagccttttatcagagagaccagcttagcaaacactgcccagttttgtctgattttgtagaatgtggtaaattatagaattagagaatgtgctgcatttagtcttgaaagaatatatggaggcagtaagtatagtggtcaagagcataggctctgaaggcgagaagggggcttgacaagtcacctgccctctctaagagcctcattcacctcatctatcaaggagataacaatgataccaatctacaaaggatgttagggagactaaatgaaattatgcacaaaaatcacatcgcacagtgcctggcatgcagtcagtattcagaaaatgataactattattaactataaaaacaataacaatttaccctctctaactaggatagctgaaatccagaagggttttcaaggtaaaagcaataatcttacatcaaagtctaaccttcttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgttcaaaaagcatttaatatgtgatgcaggtccagctaaagaagaaaaaggaaagaaagaaaaaaccttttaacgatttttaactgtacagcgattaaattatacacaactggcctgataatagagtctattcaaaatttgacctcaatctacctctccagctttatcttccattattatctgctagcctaactggatttcccaaacatgccctatgcttcttggtgccacatcattgtgtgcccttcagcttcatggttaaatgctccgtcccctgtgaagccttactttatctctccaaattaaaagtaatttctcatgatgacattatgagctttcaaatattcttttcatactgcaacattggcatcccgtgtaaatgcttcatatttctacacctgtcttatttacccttttaaattgcaaactccctaaggacagaggaaatgatggtgtggcagaactacccaggtgcgctggttattaagatactgcctctcagcgttgtcatgctggggcaggaatttcaggataagtaaacctaggttcacatacctttctgccacttcctaactgggggaccttttttgtgtaaattacttcaacttttacaacctaatttcctcatttataaaatagggtttgcaaaaattacctcaaagtttgtagtgaggaataaatgaatttatgtaaagtacccagcacaatgtctgatacaaataaccgcagctcgggcgcggtggctcacgcctgtaatcccagaactttgggaggccgaggcgggcagatcacgaggtcgggagatcgagaccatcctgcctaacacggtgaaaccccgtctctactaaaaatacaaaaaattagccgggagcggtggcgggctcctgtagtcccagctactcggaggctgaggcaggagaatggcgtgaacccgggaggcggagcttgcagtgagccgagatcgcgccactgcactccagcctgggcgacagagtaagactccgtctcaaaaacaacaacaacaaaaacaaataaccggcagctgtgactaatctgaggtctcgcagtgtctctcacctctttgtgcagtaaaagctttgaaagagtgaaccaacaagagaacaaagaaggaatagatgacaagaggcggaagtggactaacaatgatacgtttgttgaatgagtgagaaggtaatagataatgctgtgagattatgtggaaaactttttatctgaagtctttaaaagacattctcacttttggctgggcgcgggggctcacacctgtaattccagcactttgggaggctgaggcgggcggatcacttgaggtcaggagttccagaccagcctggacaaactggtgaaacgctgtctctactaaaaatacaaaaattagccaggcgtggtggtgggtgcctgtaatcccagctactcgggaggctaaggcaggataatcgcttgaacccaggaggcagaggttgcagtgggccgagattgtgccactgtactccagccggggtgacagagcgaaactccatctcgaaaaaataaaaaatgtactccagctggggtgacagagagaaactccacctcaaaaaaataaaaaataagggccgggcacggtggctcatgcctgtaatcccagcactttgggaggccgaggcgggcggatcacgaggtcaggaaatgagaccatcctggctaacacggtgaaaccccgtctctactaaaaatacaaaaaattagccgggtgtggtggcgggcacctgtagtcccagctactccggaggctgaggcaggagaacggtgtgaacccaggagtcggagcttgcaatgcgctgagatcgcgccactgcactccagcccgggtgacagagcgagactccatctcaaataagtagataaataaagactttctcaggtttttgttttgtttttgtttttttgacagtcttgctctgtcgcccaggctggagtacagtggcgcaatctcggctcactgcaagctctgcctcctgggttcatgccattctcctgcctcagtctccgagtagctgggactacaggcgcctgccaccacgcccggataatttttttgtattttttgtagagacagggtttcaccgtgttaggcagaatggtctcgatctcctgacctcgtgatccgcccgcctcggcctcccaaagtgttgggattacaggcgtgagccaccgcgcctggctgactttttcagttttaagctaagaatattctctaataggtatattattgacccattgacaatagaagattgaatacactttaggattccagcctcctcttctactgctcatgctctccgtaagaagggctaaacatcctactcctgtgcactacattggagctcagaaatactgacttaaaatctccagatcttaacacggacttttaaagggaagattgagtatggacccagtattagatggtattatggaattatttttaagctttttgggtacaataatagtattgtggttatgtttaaaaacaaagccttctctgtgagagttatattctgatatcttcccaaataaaattatatgatgtcagagagttgctgtaaggggtggaagaggacaagatggagaacgaacagtgcagggagatcactgaaaagaacagcaaaatgttgggaaccgttaaagctgagtgatgggaacatggctccctggtaaatgggacacatacatcgggaggtactattttcgtagtctttgtttatatttgaaaattttcaaacttacataatgagaagtcaaaaggggcattttcatcccaaaaaggtaaatgtccatattcttttttattttttcattttcatttctggaattacctaaactcaggtcatagatagcaatgaaaattcggctccctgtggcagcttctttcagccaccagacttacatagactcagtggtgcagagtccgtttcccaatactgagggataaagaaaattaagcctgcctctaggcacgtctcaaacttgggagactcagaatacaacagagtatgggatacagggaggaaagaagagatgcagaaataaattaaaaacaagatttgtttaaagaggaactgcaacttctttaattgggcagattgaaccaataaaagcacagttctctcccttcacctgttatcctttagtctcttcaactttcacattgcttcactcactctcttcctctccctttcacctgctcaccttacccaacttgaactgtgccctctgatctgacacaggatgacaatgacatcagtcattacctagcagccattttttctgataactagagttctgagtgatgatagttcatggtgagataatttccaagacctcgctagccattggtggtactactctccattaaagacaagggcatttgctgattgagaaatcaatcatacaagtgtccttggaggccaccaaggctttgcctgaactgttctcagcctatgatggtttctctttctaaacctgttcttctaggttcagctcaaacatcctctcctatagaaacctttccccatcctcccagtcagaactaatgatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcgagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccatctcaaataaataaataaataaataaaaaccaaaaaaaaaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaatcagagttgtgttaaggtcagtgagtgaaggaaatgggtactgcacctttgcaagatagtaggaagcaagccagagaagagctggcattccacaaaagagtctttatttgggacaaaaatcaatatgaccaaatcccatcctaatcaattctgtaaactaaaggaatttttaaaaaataatttagcaggaggaagagtttcaaaatcttgtagggaaaccctgatgtaactcctgattattcacccaaagtgaaaagtaactattagtgaatgggttttattttaaaacctttcatttttagaatcttatctcttctaggaaaagtgtagtacatacgaattttttgtatgcagagtgaatttttctccaggcttctctgacatcaatggggcaaggtcataactctataaaacagggagaagcactgagcattttcagaaaggactctatctgtcttgaccaaaagacaaaggactggtcattgcaggatccccagaaatacattttagtagtttccaagtgaattcttttgtaaatggagtttctctccattcataagttttagagcaaaaatgaagccttagtgggtctagatatctggctaacattaactccctgtgtgaccttaaactggtcgtccccaaagctttatgcttttatacaattaacttgatttacagcctctccttcttgcccataagaatgataataccacctgcattactcatcttttacgcttatgtgagacacctagccacctatcagaaggtattcaaatgcaaagcattaagtttttacactttaatgtgaagtggaagaaagtcttgattcaaatgcacaatctctacctttctactgattccacatttgctgtcttttactagtgcagttaagtcccaaattagaaacataagtcgccccaacatgtgacaaatgtcctttgttgccagagaaaggacagtggggctgtgtcctcagccttagcaaccagaagattctgcaagaccaggacattctcctgccagagcctgctttagtgtccagtcctgttctccaaagagatggaaaaaaccaagtggaaaagtttcagtttattcaatataaggctccacattcaaatggcaaaactgctctgttcaggtcatatttcaagcccaacctatgtcagtccttagtaaaagcttcaaagcaataccagtcctttcccagcctggtttaccttgattagacaaacacagacacccatgtctgagtaagcactgagaccatggatgagtgctaaggagattaggtgtttggatagacacagctagggtgtgtgcgtgtgtgtgtgtgtgtgtgtgtgtgtgtgtgtgtagagagagagagacagaggcaaagacagagacagtgctcattgggcagaggacagagtagctgagatagtatcatttgtttattcatttgctttttcataaaatacttagtaagcacctacttggtatgtgccaacactttaataggtactagaaagagcaaaacagacagaatcacagtcttcagagaatttacagcctatggggttaattaaaccaatgattatcatagcatgtaacaaacaaaagagaaccgagaatcagctgtatggaaatgcacacaggtggcagatataaatagcagcagatacacgaatcagtgcgggtccatcatataactcctagctttagtctctaaacttaggctcccactcaactcaactcctactctaactcaagatataccataccttggtttgctctttctctaagcatcgctgttctagtcttctaaggagcaggaatataaatctacatctatgtgaaactacagcacccccaagggaaaataaagaatccagtgctattctagtaattttagggcagtagtacagtacaatgcaaagtataggcttttgaactaaattggcctgggttcaaatatgagccctctcacattctattaggttgaaccatataaaaatggagatattcaatcatttttttacagtttcacgtagttcatctctgtattctagaggtaaatcattttaacctaagtttcatttccttctgttgttagtttttttaatggtgctaatacccctacctttcagggttgtaaatgaaaagatgttaaaaaaaaatacctgacatatagtgggtgttcaataaatgttagttttcccaaagatagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgacaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatagaatcttggtcgtgtcccagaggcctctgttgatgtggcccaactgagctggccagtgagaaaacatacacataaatacccatgatctcagcgattctctcccctccccaggacattccttagcagaaccaatctctctcactcggctggagcctctctgttcacagataggcctggctgggcttaatttagcaaagggcaggccccctgcaaaagccaggggtaagtctggagcccctgtaatgccccaggacaccttgtgtggagacaggagcccagccctgccgaaggagctaaaggggatgttcagaatgtttgtttttctcagctatttaggaactggagctcacaggaaccaccctttacttccttaacttctcacataaatgttttctttgggcagcagctatagaactggaaactaagtaaaaccttactttggaatataaaaactatattaatttttctatagataaattgttgcataggaaacttgctaaatatttttaaattatctgtaacatctaacataatctgacatttatccccaaattcagctttcaattctggattgaaacatactttgatctgttctctaaaaaggacaaagccagtcactggtgttttgcaaagtctgggaccatttttcctacacagaatctcacacaataaacagacaagatattagaaactaagttctaatatctagcagtcactccttccctggaagcctggctgtgtcctgaagccaggtcctatgatcaggcaactcttctgaagctctgcttccactagagacagcacttaccctgtagactctacagatgtaccatccaggatggcaggcatgagccacatgtggctactgaacccttgagatgtgactagtccaaatcgaaatgtgctgtaaggatttcagacttagcacgcacaggagttcaaagactaactacaacaaaagaatgtgacatctcattaataattttaaaatgttgatttcatgttgaaatgataatgttttaaatgtattattaacattaatttcacatatttctttttactttttttaatgtggccatcagaaaaatttaaattacatgtatggcttatatttacgttggacagcactgttctataagatgttaggaaaaagatgtatttgctttaagtactttgcattaagacatagtctgacctgaatcacagttaatcctgtggtctcatagcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccactgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacgaggtcaggagttcgagaccagcttggtcaacatggtgaaaccccgtctctactaaagatacaaaaaaattagccaggtgtggtggtgtgtgcctgtaatcccagctacttgggaggctgaggcaggaggatcgcttgaacccaggaggcagaggttgtagtgagccgagattgcaccactgcactccagcctgggcaacagggacatactctgtctcaaacaaacaaacaaacaaacaaacaaacaaaaaaaccagaagaaagcactggcagtctcttaccgccatatcaatccatctacacatctcgggttacattctctgtctttccacttataaccatagatcaactatccatgctcctatctaaagccaaaccttccacttatgtattaattaagtcctattccccctacctctcaaaggcaacacctagaaggtctcccctgcttctctttatcaatatttcactttctaatggaaaattctgttggcatacgaacatgctattattcatttatctttctagaaatcccctatggacctcatacccttatcaggtatgccccattcctttgctctcctttgaaacaaaactcaaagtaattattcatcctcattgactccaattcttctcctcacattgtttcttaaacccactgcaagcaggcttttgtcttcaccactccaccagaattactttaatcaagatcactaatgacatccatgttgttaaatccaaaggtcaattcttttttgagacagagtcttgctctgttgcccaggctggagtgcagtggtgcaatctcggctcactgcaacctccgcctcccgggttcaagtgattctcttgcctcagcctcctgagtagctgggattacaggcatgcgccaccatgtccagctaatttttgtattttcagtagagaccgggtttcaccatgttggtcaggctggtctcaaactcctgacctcaagtgattggcccaccttggcctcccaaagtgctgggattacaggcgtgagccaccacgtctggcgggccaaaggtcaattcttaatcatcgtattactcaagctctcagcaggatttcaaaaggtggatcctgtcctcttcactacacacattcttcatttggcttccgggactccagactttttctcctacttcactggtttgtaccttctctatcttccttttctgattcttcctcttttctccaaattactaatgttggagctatacaggaccagtctctggtccttttctcttccacctggaaaggtctaactccaactcctttggtcatctcctatggtttcatggctttaaatatttaaatttaatatttaatgatctatttgctgataactcccaaatttatgtctctagccctactctatttcctgaactttagacttacgtattcaactgcttacttaatactgccacataaaatgtctagcaaatagcttacacaccaaatttccaaaactgaacccctactctccaccttcaaatctgctccatccgtagccttccctatctcagttatggcaactccatccttccagttgcttactccaaaaaccctggaattttccttgattcctttatttctctcccattctgtatccaatccattggcaaaatccttttagatttgctaccttcaccacttgttcccacatgcatcactattacctaagtctgatcactatcagcccctacatacattactgcagtgtcttcctaagagtcctcctggtgtctacttttgttctacagcctatttgcaatactgtaaccagatttatcatttcaacaagtcagacaggactggcatttgttagacccctcctctgctcaaaacccttcaataggttcccatgtcactctgagtaaaagctgaagtctttaaaatcatctacagggacttactacacaagccccataccctctggggcctcatcttccagcatgcttaatcttgattatgctgcatcagccacagtggctttcctgatgtttctctgcctggaatattcttcccccagttctctgtttggccaacttcgtcatctccttcaagttgctatttgaaaattattttctatggcatagccactttgaaaaatagttagacagtatctattcagaaaataggcagaaataccgactgggcatccctaatctaaaaattcaaaatccagcatgttccaaaatccaaaactttttgaggaccaacatgatacctcaggtggaaagctccatacctgacctcatgaaaggttgcagcaaaaatgcaggcacaacacccagtttattcagcatccccaagagaaaaacataattaccttcaggctatgtgtacaaggtgtatatgaaacataaataaatttcatgtttagacttgggtcccatccccaagatatctcattatgtatatgcaaatatttcaaaatctgaacacatctgaaaatcttctggttcaagcatttcagataagagatatttaatctatatatacttattatataacctaacagttccactactgggcatttacccaaaagaaataaaacaaagacttgttacatgaatattcatagcagcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttgaaacacgtggcaccagtaggacatatggaaacttttttggtgtgatggaagtatttttttatcttgattgtgtggtgtttgttatacagtggtatacatttgttaaaatttatctaactgcatacttaataaagtttatttaaacaaaacatgaaaggaaaaactaaaatgacatagcaagtggcaatgcaaactgccaagtgcaaagaatgagtaaagagcttggttggcatggagactaccagtctaggatgcttttattgcctcaggtcagcttggaaggccataaatgctgtgaaggtaaacctagaaacaaatcttcctgcactggtaactgtcatgtttatttgcttccctttccatcccatcctttcaaaaaaaaaaagtaaaaggtagtgtggtccacaaactaccgtgtggctccccatgatccccgcctcttggtgtttgtgcccttgtgtaactccttctctttgggtatgagcaggccctgcgacttatttctaaccaatagaatatggcaaaggtgaaggaatgtcactcctgtgattatattaaatttcaaggctctcttgcttgcagatttgctctagagcctctccttgctgacttgaagtggccatatggggaaagctcacatggcaaggaacactaggtgacttcaaggaaccctggacagcctctagccaacctctggcaagaagtcaaggccctcagtcctactgctacaaagaaatggattctgttgacagcccaagtgagctctgagtcagattcctcagtcaagcctctagaggagaatgcagcctggccaataccttggctgtagcctagggagaccctaagcagacaacccagctaagcggtgcctggattcctgacccacacacactgtgagataataaatgtgttggggggtgaaggagggatgggggtaggggtggctgtgcatttgggtatggaagggtgttttaaatcgctttctaaacacggcctctcctggccactccttaatactgcaacctgctctccactcctgtaattttttttcaacatttgttttaggttcagggggtacatgtgcaggtttgttacatgggtaacttgcatgttgcggaggtttggtgtatgaatgaacccatcacgcaggtagtaagtatagtacccaatagttagcttttcaaccctcgccccccttctaccttccactggggtaggccccagtgcttattgttcccatctttgtgtccatgtctcaaagttttgctctcacttataagtgagaacatgcagtatttggttttctgtgcctgtgttaattagcttaggataatggcctccagctgcatctcttttgctgcagaagacatgatttcattcttttaatggatgcatagtattccgtgctttatatgtaccgtatttttcctccccagtctactgttgatgtgtatctaggttgattccatgcctttgctattgtggatagtgctgcagtgaacatgtaagtgcatgtgtctttttggtagaacaatttattttcctttgggtatatatccagtaatgggattgctgggtcaaatggtagttctcttttaaattctttgagaaatcaccaaactgctttccgcagtgactgaactaatttacattctcaccaacagcgtataagcacttttctctacaaccttgccaacaccttattttttgtttttcacagtaggcattctgactggtgtgcaatggtgtctcattgtggttttgacttgcatttctctaatgatcagtgatattgagcatgagaattttttcaaatatttgttggccccatgtatgtcttccgttcatgtcctttgcccattttttagttgggacaaggtctcgatctgttgcccaggagtgcagtctgatcactggagttcagtgatgcaaacacagctcactgcagccttgacctcctaggctctagcaatccttccaccactgcctcccaaagtgctggagtttcagatttgagccaccacacctttgctcatttttgaagtggggcaagacccccacttcgtaggactattacttgattgagattaaatatgtgtaaaatgcataacatggtgcctggcttatagtaaacactaaatggatttcttcttccataggatttaaatagggagcaattttttttctatcaagagctgatcagaaataaatgggaagcatttaaatgctctccttcccctgtcccaagaggactttcactttccaacattctacatactttatttataatatttattgtttattttctgtctactcatgacagactataagttctatgaggatgggaatgcctgtatgtgcttattatatgacctaacagttccactactgggtatttacccgaaagaaataaaacaaagacttatacatgaatatattgatatatactccagtcacctccaatagaatctagaacacagtaggggcttagtacatatttttaaatgaatgaagactaatgtttagtttaaactaggattgacctattcttatcttcggcagagacagagaataactaattaccacttgtcacatattgagacttcagtacctaaaaggcattattaggtcacctgtaagtctgttttcccccaaagtaaaaatcccaattccattgcccttttcacataagcctcattttctaacctttttagtttggtttaacgaatttcctatttcctctgaattctggagttccaaaccagactcagcacaagcctaacagggcaacctatacagataaggacagcccaggcacattgcacacggcaagttgcacctgttttaagagtaaaaatgaggtcaatgccaccttgtactgcaggtacctcaatgagacaatgccaccccttcctgccacaatcttggcaaaagtcactacgaaagtaaatatcattttactagagtcctttctttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaaaatgcataacatggtgcctggcacacagtaaacacaaaacagatttcttcctctatagcatttaaatgggaagtatttagcgtttacttgccatgtgcatgagtgaatttgggaaaagtggggggaggatatggggcaaagaaggacagaaagggcctaagagtaggaagaatttaataccagaagatgggacaagacctgggtctagaaacctcttctgcagataaagtagctgcaaattatagggaaggagtcctcaggctgctttccttataaccatttattttcctgcaccttatatcaagaacgttaggcactggttaagaccctgtccccttgcagcagtagagaaaacaggaggaaggagacgggaggtagaaatttggaagctagcagttgaaggccaactcagaaagcgtcaggtggaattccattcctaattgacatcaccatcctctaactgcagcaattctctccagcccttttatgtgctccctacagaaccaagcttccacacagctgaaggaacctgtctgctctcaccccagcttcacagaagatggcagggactggttattactaacctgcctcctagtcttctgaggctccaaatggttttgtcagcaagctgagcttccccacaatcccacagactagaaggggttggaaagaacaagccttagaacaatactgctccccacctctaagggatctgctcctctgagtcccagaagttcaccgccttcatttgatttctgctacaggaagactctgggaatccagctctggacccagcacttcctgatttttgaagtagagagttgacaaccctgttgtcatcaatacaactgtgctaggtgggtgggaaaggaaaatatcttgggctcccaaaatcactaagctaaaaggaaaactcaggatcatggtggatggaagtcaggactagattgcagctccgactcggatggacagagaagcatgtggaggctcatatcatgaatttttgctccagaacgactggaggaataaattacaaaacctgagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagctcgaacacaaagtcttcaatttgacccaatccaaccaagacaaagaaaaacaaataagaaaatatgaacaaagcctccaaaaactctgggattatgttaaatgaccaaacctaagaataattggcattgctgaggaagaagagaaatctaaaagtttgaaaaacatatttgggggaataattgaggaaaatttccccaaccttgctagagacctaaacaaatacaagaagcacaaagaacacctgggaaatttattgcaaagagatcgtcacctaggcacattgtcatcaggttatctaaagttaagacaaaagaaagaatcttaagagctgtgagacaaaagaacccagtaacctatgaaggaaaacctgtcagattaacagcagatttctcagcaggaatcctacaagccagaagggattgggcccctatcttcagcatcctaaaacaaaacaattattagccgagaattttgtatccagtgaaactaagcttcatatacgaagagaagatacagtatttttcagacaaacaaatgctgagagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacagaattgcagaatggataagaattaaccgaccaactatctgctgcctttaagagactcacctaacacataagagacttatctgacacataaggactcacataaacttaaggtaaaggggtggaaaaaagacatttcatgcaaatggacaccaaaagcaaaagcaagcagaagtaactattgtttttttgttttttttggtttttttgagatggagtttcactcttgtagtccaggctggagtgcaatggcgcgatcttggcacactgcaacctccgcctcccaggttcaagcaattctcctgtgtcagcttcccaagtagctggaactacaggtgtgcaccaccatgcccagctaatttttgtatttttagtacagataggtttagtacaggcaggggtgatccgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaggccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaacacatatatacagaacattccatccaacaactgcagaatatacattctattcaacagtgcatggaactttctccaagatagaccacatggtaggccacaaaacaagccgcaataaatttaagaaaattgaaattttatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaagggaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccgggcgtggtggctcacgtctgtaatcccagcactttgggaggccaaggtgggcggatcacaaggtcaggagatcaagaccattctggctaacatggtgaagccccgtctctactaaaaatacaaaaaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttataggtgggaattgaacaatgagaacacatggacacaggaaggggaacatcacactctagggactgttgtggggtggggggaggggggagggatagcattaggagatatacctaatgctaaatgacgagataatgggtgcagcacaccagcatggcacatgtatacatatgtagctaacctgcacgttgtgcacatgtaccctaaaacttaaagtataataataataaaataaaataaataaaaaataaaaaataaaaataaaaatacaaaaaattagccggacgccatggtgggcacctgtagtcccagctactcgggaggctgaggcaggagaatggcatgaacccgggaggcggagcttgtagtgagccgagatcgcaccactgcactccagcctaggcgacagagcaagactccatctcaaaaaaaaaaaaaaaaaaaaacctagaagagatggataaattcctggaaagatacaaccctcctagcttaaatcaggaagaattagatactctgaacagaccaataacaagcaacaagattgaaatgctaatttaaacattaccaacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccatgatcaagtgggtttcataccagggatgcagggaggtttaacatacgcaagtcaataaatgtggtacaccacataaacaaaattaaaaacaaaaatcaccatgatcatctcaatagatgcagaaaaagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacacgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcacgaccaagaacccaaaagcaaatgcaataaaaacaaagacaaacagctgggacttaattaaactaaagagcttttgcacggcaaaaggaacagtcagcagagtaaacagacaacccacagagtgggagaaaatcttcacagtctgtacatctgacaaaggactaacatccagaatctacaacaaactcaaacaaatcagcaagaaaaaaacaaacaatcccatcataaagtgggctaaggatatgaatagacagttctcaaaagaagatatacaaatggccaacaaacatatgaaaaaaggctcaacatcgctaataatcagggaaatgcaaatcaaaaccacaatgtgataccaccttactcctgcaagaatggccataatcaaaaaaataaaaaaatagtagatatggatgtggatgcagtgaacagggaacacttctacactgcttgtgggaatgtaaactagtacagccactatggaaaacaatgtggagattccttaaaaaactaaaagtagaactaccatttgatccagcaatcccactacagggtatctacctagaggaaaagaagtcattatacaaaaaagatacttgaacacgcatacgtatagcagcacagttcacaactgcaaaaacgtggaaccaacccaagtgcccaccaatcaatgagtggataaagaaactgtggtgtgtatatacacacatatatatatatatatgatggatatatatatatatatatatgatagaatactactcagccaataaaaggaataaattaacgcattcacaatgatctggatgagattggagactatcattctaagtgaagtaaggcaggaaaggaaaaccaaacattgtatgttctcactcataagtgggagctaagctataaggatacaaaggcataagaatgacacagtggactttggggactcaaggggaaagggggggaagtgggtgagggataaaagatcacaaatagggtgcagtatatactgcttgggtgatgggtgcaccaaaatctcacaaatcaccactaaagaaattactcatgtaaccaaacaccatctattccccaataacctatggaaatgaaaatacaaaaaataaaaggaaaactcaagctggaaactgtttagggcaaacctgcctcccattctattcaaagttatctctctgctcactgagataaatgcatatctgattgcctcctttggaaaggctaattagaaactcaaaagaatgcaaccttttgtctctcttctgtgacctagaagccgcctcccccactgcaagttttcctgcctttgcttcaagttgtcccgcctttccagacctaaccaatgtacttcttacatacattgattgatgtctcatgtctccctagaatgtacaaaaccaagctgtgccccaaacaccttggtcacatgtcataaagacttcctgaggctatgccaggggcacgtgtcctcaaccttggcaaaataaactttctaaatttactgagacctgtctcaaattttcggagttcacagtgggcaagactagatttacttttgtgttgagcagatactgagcttgactgatgagaatctggagtgtgaggtctgacggagtaactctgagagaggaagctacctgtgtggtctcagggagaagatctgagacttaccaagaaaaagtgacctgaaagaactggctgacttcaggcccttgaccagtgcctagaccctctttctgcagctccagatcatagccatcatgctggcagcctccctgccgctcatccaggcaccttaaagaagggcttcctcttcccaagcctctgggtgggctttctaaagccctgtgtgcatgaagaggtggcttgtagccctttgcagcagcagggcttacatgaggctgggatatgaaaagctggcattacaatgcagcttgtgccttgcattcactccccacttcatcaagccaagtttctaaataacagggatagtaactgcccactgtggcccaatgtcacttctaaagttgcttggcaaaaagccacatgactattacttagctctccacagaacggcatgtaccaagtcggatcactgctgtcggtgtgtgggtggattagctgctattgaacatgatagggcgggcccctttccagtttgcaccagccccgctctgtgcctactccatgtatcatagagcctcctctctctgtgcagttgaacttgatcagatgagatggcaaaagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtgaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttaggcaaattactattctgagctttagtcatcttatctttaaaatgaagggtttattctttagaggaagctgagtgaatggcatacgggaacactctgtactatttttataactttgctataagtctaaaattatttttaaataaatggttttcttaaaaagtgaaaggattatgtagattatcttcaagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcctacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacaggacttcagaactgggagggatgtgtgcgtcaatcctggtccagcccactcatttaaacacaaagaaccagaagcccagaaaaagtgacttgccttagcctggccttcctcttgattcctttccctcaattctcccgtcctgatcaatcatcaagtcctacaaatattttacctcttaaatattttaaagatgagttgcctcccctctattcctactgccacagccctcattcgggccttcatcttctttggcttggcaagtctgttctcactcacttcctgccttgactctcttgaatccacctttcccatgcatcagagggatctagcaggttccctgcagcttaaagcccatcagtggtgccttgtcttcttcaggataaagtctacactctttaaaatggcacaaaagactgtgtccgtcatatcagtctcattcttcgcctagtacttaaatccaccaacaccaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagttgccttacactttgtacacagctctgttactgccttttactatactctagcacctgtggtttactcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatactgaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaggagattgagaccagcctggctaacgtggtgaaaacccgtctctactaaaaatatgaaaaattagcgtatgtttcacagcatctgtaatcccagctactcaggaggctggggcaggagaatcgcttgaacctgggaggtggagattgcagcaagccaagatggcgccactgcactccagcctgggccacaaagtgagactccatctcaaaaaaaaaaaaaaaagaagaaaaaagaaatgccttttcccatttcttgttatgttactaccttttaggattcaatgcaaacttcaaacacttggcaaggcctttcctggtggattttattgcactatagcaaaatctgtccatacctctatggtagcccttattataccatttttatttatttgttgatgtcttctccaccagaatctagcacagtagctggcatatagtagataatcaatagacgtttgactgaatataccaatgcatatgcgcaaatatgagcaaaaaaatgactaaaatgatattgcaaacaagggaaacatttgagacagaaatttagaatgtctatttttttcaagtgtaacatgctacttctatcagtgcataaacctgaatgtacatacactatagaaagaagtggccttgtaataagttcatgcagaagtataaattatgtagacattgttagggggataactgaaagtggattagaattaaattagggcccagaatttagtctgggatttgttttccagtggttgaaagaaaaattcctaagtattcaaagggaagaagcatttctcaacaggcaagtattatgaattctaattaaaagctctgaaaaaatgagataagttgtgttaaggaaaagcagaaaacagagttgcctttggttaagagttccactatttttataagcaactgacttttttggggaaagttgctttaagcatttttttttctgtgtgtatgtgtgagatggggtctcactctgtcacccaggctagaatgcaggagcacaatcatggctcactgcagcctcaaccttctgggctcaagcaatcctcccacctcagcctcccaagtagctggtaccacagccacacaccactatgtcagctaattaaaaaaaaaaaaatttacagagatgcagtcttgctatgtttcccaggctggtctcaaactcctgggctcaagtgatcctcccaccttggccttgcgaagtgctgggattactgacatgcgccaacatgccaggcctaaacattttgtgtgtgtgtgttaaaatatacatataataaaatttgccattttaactattttaaagtatatagttctatggcattaagtacattcacatagttgttcaaatatcactatccatctccagaactttttcccaaatgaaactgtagccactaactccccattccctcctccccacaacccctggcaaccatagttccactttctgtcttcattatttgactactctaggtacttcatttaagtgaaataataaatatttgtcctttagggactgactttacttagcatgacatctttaaggttcactcatgttacagcacatgtcagagtttcatacctttctaaggctaaataatatccagtgtctatatagcccacattttgtttatccactcatttgtcaatgaacacttgagttgcttccacctgttggctactgtaaacaatgctcctatgaacacagaaatacaaatatctatttgagttcctgttttcatttattttgtgttatacccagagtagaattgctggattatacggtaagtctatgtttaattttttgagaaactccatactggttttcacagcacctgcaccatttcacattctttctagcaatgtgcaagggttccaatttctccacatctttactagtatttgttattttctgggttgtttgatttttagtataatagccatcctaatgagtgtgaagtttgaaaaaatatttaaccaaaatcataaatattggttacaaatatttaatggatggattccctctatttctgccaactttcattccctgaaagaagaaataggtaagcatgacctcacgaacctcagaaggctgagaatggggaattggcacacacagtgtgcgtagacacagacacacatggaccatgttcatactaggcttccagagaaccatttaaaaatagtttggctaatgtaatcttgtctgtctcttatgttcctcctttcccatcatacacatttcttaaagttcgtgtaagtaaaacataggagaaaaaaacatagccactaattaaataaggcatccaagtgtaaaagaagagcaaactctgctacatataagaagacaagcattaattctggcaacagcagccacacagccactttagacaataacctgagcaggtgcatgctttctagtatgtgtctccagctatgcaggatagaaatcacaatcctttctatttatctaacgtctaatacactaaaacatgtttacccatgggggagaagagcacgacaggaattgatgactctaatttaggaaactaaggttcacagaagttaagtgacttggccaagatcatgtagctagaaaaggcaggttaagaattcaggtttccttagagttcaaaacttttatcacaacatttttgataaccccccaagatactcatccttctctaatagccttcctttggttcaagtccagcttcctaaatcctaccgcctgatggagttcctgagcttccttgtaagtctgcaggtatattgttcctcatcatgttgcccaaagcctaaagaaatcaggctaggaccaaagaaaatcagtcaatgagccaaaaagaaatttaatcaacccagcctttcttatttattttctttgaatgaacatttgtatctgagaatgccaaggtaaatttgatgcaatagggacacttggattatattatgttatttacacacaagcaaacaaaaattgagaattgagacaaataggacaaatggtcccaagtccactattgaggaaaaagaaactgatttggaataaaaaatagtccagcatgaatgtgtcagtaattaagacttatctggataagtttgccgtctctcaatttgtcacaataatggcaaatatttattgagagcttactatgtgataggcattatgctgagttcagctaattgactcatttcatcctcctctagaccctataagataggtgttattactgcccttgctttagctcagagaaattatggtatttttcccaacacaaatagtaagtagaaaaatcaagatttcaccccaggtctcgccaatttatagctcttagccgttatgcccagcaataacagaatagtaaaaacaaggacaatttggtaggcaagtaaaatcagtaggctgtttaccatagctatagaagtatgctatgcataaacctcaaagattgcgcaggaaaagtatcatccaatctcaaagatgagaaaaccaaagaagtttcaatctcagagaagtcaggcagcttaagggtcataaaacaacgcaacacaactctctcaactcatatctaagggctaagtccactttaaccttccaatatcattacatcatatttaaacattgactctatctggtcaaggacgacaacattttatttctcctgacccttttgctatcagatctggccttgtcagtttttcaatttcattcttagaatggaaacttaattcacacaagttgaacaagtagtcatcagggggcaaaacccagtggatgatggttttgtgtgctgtttggagactgggtgtttaccacacagcagtggatttcataaattccagggtcagacaagattccagtagcgacacacttgactaatatgagaaaatgcaggattaggcaatcaacaatgaggaagtcagccaagttgccacccaaaaattacttaccacagcagctgcagtccagaaatgctaacaagccagtctccctaggagtgggccatactcagctgtggaccactcacaacattttctcactttattttgcttcagagtcagtgtactgcaatgatttctcctttgcttgctttatatgtttaaaattgtcttccctaaaagctgaacttaaaattaatgtttgctaccaaaagggggtagcagtgcctagtcatgtaggcatatgtcccactctgtcggtacagagggtaagcagcctcttcctttttaaaaaatttattacgatgatttacaaaaattgaagcttacaggataaacactcaacaaaaaagtagccagtctcaagaaaccaatttttatgtatgaattaatattattttattaatccatggccaggatgattcttaagattatttcttaattctctgaacagcttaaaagagagaaactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaaagagaaagatagcacccactctccagttctcttctcccaaagttgcccgtatttcccttccctgaagccaatcaaatactttattgtttctcgctaagagtaatttttcactcttaagtacaaacagctcaacaaaaattcccggtagcataaatatgcacatcaataaaataattactactcacaatagactttccattacatatgtttcacaagcattggttttcttaaaaagaaccacgcatacagcactcaaattattgcagattctaactcagtagagtttgatttaatgtttttacaatattttttttaaagaagtgtccttccaacgctaaggaaaaaaatcagaatcaagaaaattctgtttcttagcaacagaaaaatcaaacttctgttactaagtttggtaacagaacagtactctaaattatcctctgaaccacctgatttaccatgtgatgctgggcacattgctgctaattaatcttcctaatctcgtgggatcacaatatgaataacaagaatgaacatcagacacatctgtgggaattatgagggggagattataaagagtcaaaccttgtccccatatttaaattttataataactataactactagtagaaatataactactaccctctcatatatatgtgatgttattaagtttataaagtgttttgatatgtttcttatttcatcttcatggctgctatttattcatagaaaaataattctcagtatctgtagcattattgttaatgtcaatcctatagaggctggaacaggctcagagaggctaagtaacttgcctaactaagtctcctggttgacaataggtcttaatgcagtgttttccgaatccctcgttcttacatcaaaacagaactgtggctgggtgtggtggctcatgcctgtaatcccagcaatttaggaggccaaggtgggaagatcacttgagcccaggaatttgagaccagcctgggcaacatagtgagtgagacctcaatctctgccaaaaaaaaaaaaaaaaaaatacatacacacacacacacacacacacacacacacacagacacacacatatatatataaataattagccaggtgtggtggcacacctgtggtcccagctacttgggaggctggggtgggaggatcatttgagcccaggaggtcaaggctgcagtgagtcgtgacggtgccactgcactctagcctgggtgacagagcgagaccctgtctcaaaaaataaaataaaccagaacggctctagttcctatcaatcactcatcatgacatagtgtggtaaactaatttcaactctgaatgattgataatggctttatgtgttctgtttcccaagtaataagaacattttagcacaagcctttagcgcttttcaaataatcatagccaaatgagaaaattaatatgacaggcagattgaacaaacatttggtgagaaggaagaggaggggatacagtagtttgagatccctcaaatcatatgatgcagtagctgcctgacaactctgctaacacgtaagactagatagagacagggccatatctacttcctgtatgggacccatggcaatactagagtctagcaaaagggttgtcctctctgcatgtgacaataggctgtgttccactccccccacatacaccttgtgcagctcctataatctcatttatcacacttctccaggtgagaaatggtgccttctcacaccccacccaaagttgtttcctaaagatctttcgctagggcggagcagagagtgagatcaaatgattcagacagccatctgattcagctttaaaaaaaaaaaatcctggtgggggcgcagtggctcacgcctgtaatcccagtactttgggaggctgaggcgggtggatcgcctgaggtcaggagtttgagaccagcctggccaacatggtaaaaccccgcctctattaaaaatacaaaaattagccaggtgtggtagcaggcgtctgtagtcccagctactccggagaatcgcttgaacccaggaggcggaggttgcagtgagctgagatcgtgccactgcactctagcctgggcgacagagtgagactctgtctcagaacaacaacaacaacaacaaaatcctttccctcaaattacctaagaaattgtcctttccttctttgccctgaagacagttaatggggaaagttcctccctctgcacagtgaataaatccatccactattcctaccctaaccctaaggcaaaacctcccactcatcctctgtctctcgccatctctctgttaccaaccctcacttggcaatatccttcttgacacgtggcagctccaatgaggcacactcattacatagccacgtaaaagataaaaggtgaatctggaccaacttctggaaaatttggacttaaaacatggaaatgcaggagagacaggaaatagagttaaatcccccagatttagctatacacattaattgaattaactaaataatcatttgggtctcatagacaccagctatttccctgatccaagatgttatctagcagcctgtatcgcttcccagtcatccatcctcttgacaggacagagcacacatagaaaatggtatttgtatagtcctctggggtaaacagttggagagttagaatctctgataaggtcagaggcaaccagtccccggtcacttgggccacttcaggtcctgcttgtccagacacagagagggctgaggaaaccaatattgtggtgaccagctacgaggcttaatcctcataacccatagcccaatgtcctcttatcaaggtgctgtcctatctcacccacagctcagccaatccagtaggtcttccttccccaccctgatcactgacccatcaatcaagatagccctcccatccaaggaagaggccatttcccctcccactccacccaggccaactgctatcccacaggttactctcttcttcattttaaggcaagctattccaaagactaaaaatgcctaagattctgtcttaaaagcttatctgcatagtcatcttcaaaagcaaacatgaatttctcaaggaacggaaacacccttagcccctgcccttttctccatagcatcattctctgccccaccaagccggaactaggagggcactttctctaggagaggtatgacctggagatgatctgcttcagagccacctcagggatcttgcttaaaaatgcatattttcccaggcaaagtggctcatgcctataataccaacaacagtggaggctgaggtgggaggatctaaaggccaggagtttgagaccagcctggacaacatagtgccacccctttggtacgaattttttttttttttttttttgagacagactcttgctctgtcacctaggctggagtgtagcggcgcaatcccgtctcaccgcaacctccgcctcctgggttcaagcaattctcctgcctcagcctcccaagtagcttggactacaggcatatgccaccacacccgctaatttttgtactttttaagtagagatggagtttcaccatgttggccaggctggtctcgaactcctgacctcaagccttctgtcttccttggcttcccaaagtgctgggattacaggcatgagccactgtgccctgccaatttttttttttttaattatctgggcctggtgtcctgtgcctgtggtcccagctgctcaggaggctgagccagaaggcatcacttgagcccaagagttggtggctgcagtgctatgatggtgacactgcactccagcctgagcaacagggcaagaactgtttctaaaataaataaattttaaaaatgcaaatatccaccccagccccaccctctccccccaccttcccccacattactacatcggaatccctagggtgaggcatggaatctacattttaaaccagctcccaaggtgattgttccgcacagttccacgtcagtgtttgagagaggctctgatttattccagtcctctttctttacagagaaggaaagcagaaagcaggcaccagagaggtgaaatgagcttgtccaaggtcacaggttgttaaggtgaccagagctggacgaaaccccacctctctcgctgactagcacagcgccagctaggaagagcctagaatagcgaccaactggcaggccaaaccgtcccctgcccctgcccctgcctcggagaagcgggcccctgcactcacccgcttgtagatgtcctcccggctggcctcatacttctgttgcatgcgctcctccaggaagtagatgcgcagcttgaggctgaagttctccttcttcaggtcattgaggtgctgggacagagtgcgatatccattagacatgatgggcaacccatggggaggagcgtgcccgattgccccctcaacccaggaacatggtgcagctgcaccgcagcatgaagccagccggctgggacgctgctgaggctgcggaccgagaggctggggctacggcgacatggcccctattgctggagctctctccgggactcgggactgggctcactgctctgggtgctggagcgcagcacactttccttttttacctcagggagatatttgcggaatccctgacagaggaacatgctgcgtgaactcagacacaagtggtgt

SEQ ID NO: 1120 - DNA, 45351 bp, Homo sapiens
gcagacaacttgctcttttaatgtggaatggatgaccctccaatatttccccagagcaccccatgctcttctatcagggaacttattaaaatcatgtaacatgtttcttggtgacaagaattaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatggataccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcaccgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaatggggttatttgtttttcattgttcaattgttaaattccttatggattctggatattagacccttttcagatgctagttgcaaatttttttagattctacaggttgtctgtttactctgttgatagtttcttttgctgtgcaaaactctttagtttaaataaatccgacttgtctctttttgtttttgttgcaattgcttttgaggacttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgacaggaatagtgttgaatctgtagattaccttcggcaatatggccattttaatgatattgattcttccaatccatgagcatggaatgtttttccatttgtttgtgtcatctatgatttctttaagcagtgtttcatagttctccttgtagagatctttcacctccttggttagatgtattccaaggtatttttttttttttttagcagatattgtaaatgggattgcattcttgatttggctctcagcttgaatgttattggtgtgtagaaatgctactgattttttttttttgagacggagtctggctctgtcgcccaggctggagtgcagtggcatgatctcggctcactgcaagctccgcctcccgggttcacgccattctcctgcctcagcctcccaagtagctgggactacaggcgactgccaccacacccgcctaatttttttttttctatttttagaagagacggggttcaccgtgttagccaggatggtttcgatctcctgacctcgtgatccacccacctcggcctcccaaagtgctgggattacaggcgtgagccaccatgcctggtgaaatgctactgatttttgtacattaatttttgtattctgaaactttattgaagtctgaaaatatttttaataattttagtaatacttgtcatttaacactaagcttttaaaaaactgtaaattataaaagtaaccattttagcaatataaatgtatataaagaaaaatatcaagtcttctccctatcacggactgtgatctcactcttcctcagtatactataaatatcactcagcaacttttcccccttactttaatcaaggaattcccactaggacaataatatagagctaactcattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctcgggattgtttgatcaaaggaaatcctccttttttattataataggtagcatcccatactaaaaatgttgtcacaatttacactcactggtagtgtatgagagtgcccattttccccaaatgttatctcagctcttgatgttattataggctgactgatactttttgataaagcttatttgcatttgtctctactaaaagtggaaacattcactgtttcaatttagttgattgctgactgataggaagtttgcagtcttaggtctggtggatttaccaacttatgacaaggtccatctgacctagtaatagagaaagagcccaagggaaacacagcatatgaaaatctattgtttcagttcctgaatcagatacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcaatgttctgaaaaacacacaggcattaatcgttattaactgccacagacactctttcctggatccaggttcctatttgagtcttgccttggtccacagcctctcacctcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcctgaaaacgaaattgctggaataatacttttaatagaattatagtaatagaacaatacttttaaatgtctggggatttaattatttaaagaaatttggttgtaaacatttttaaaaacaatgcttttatcataaaattggaattttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtctggtgcaggttaagtggcttagtgtgtggtaaggagtatagaaaatagtttgcaactagtttgtgaaaatcctgctaagacaactagataggccggccacggtggctcacacctataatcccagcactttgggaggccaaggcaggcagatcactcgaggtcaggctttagagaccagcctaaccaacatggtgaaacctcatctctgctaaaaatacaaaaattagctgggcgtggtgacatgcgcctgtaatcccagctacttgggaggctgaaacaggagaatcgcttgaacccaggaggtggaggttgcagtcagccaagatcatgctgctgcactccagcctgggtgacagagagagactctgtctcaaaataaaaaaaattaaaaaagtaaaaaactggataataatcagtagaaatcaaagacttatcagggagctttaagcaaagtattggcatgatcgggtccatgttgaagaaggaattatgaagaaggtgggtgggtcaggggcaactaaccagaatagggagggggactgtctaaggacaagaggtacagggagaaagactcaaaagacatttcagagacagaagccacaggccttgatgacttgtgagattcagattagactggagggaggaccaaagacaatgctgaaatttccagcatgtcagtgggaatgcattctattaactaaaataggggcaggtttgtaggggaacctaaggaggtttctgcaaaatgttaattgagggattactttatttcagcttaaacgttagcatgcaaagatggattagtcccttccctgatgaagtccataatacagtattaggcaagaagaatgttatttagtaaagaagtctttagatcagaggttgacagagagactgaaggtaaagtagctaaagtatgaaaagtagtattgtgggtactagaacagtagggaggattttactttactatcgccatataataaccaccaacacctagacttctagaagtccaaggcaacatacaatagcagcatattttctaccatacttgtgaaggcatttcataacccatgtttccatgcagggtggtcgaaacacaaatactaattgggaaaagtagaaacctagtttagatatttgagagttacttagaattaaagaattttagagctggaaggcagttggactcaaggcattttagatcatattactagtatgtttttagtgacatactgagaagaatgtttgttcccctcataagtaggtaccttttgaccaaggttagaacatagattcagatccagtgagatgaaaatatcctaatttcttcaaaagaaggaatgatagccctgtcttttcaggatatactttaaagttattattttatgaacactaaatagcattaccagatttagcaaataaaaatataagatatctacttcaatttaaatttcagataaacaacaaataatttgtttcattagaagtatatcctttgcaatatttgagacataacttaaacgctaaaacattgtttgttgtttatctgaaatttaaattgaattgagtaccctgtattttattctgcaatacaaataccaaaagattaacaaatggaaacacgcatatttcaattttgtatgaagaacaagtctaagatctctatatcagttccatggcctggcactgcaagaataattcatctgtaccaattgatgaatcagtaaaatagaagatttgctaaacagttgctatgtccccagctttgtggtcaatacttaaaggaattcaaatgtcttcataaaaaatagtccctaagctagaggcccttcatagaggtgaaggaatatgcattcaattatgtgggaaatgcaaagagggagcaacttcctaatctgtaataggcagataattgtattttcctcattcataaacctacctgagaggatcgtgaggcataaataaatcaatacatgtaaaggacttaggacagtgtttctaacacaggtataactataattttaattataataatattattatcaccatcatcatcaagaacaacagcattatcatttggaacagcagtttgctttccatgagaccataatgtttcaagtggattcagtgttcaggatatggtgctgagaaagaggactcctaagtttattattatttctgccaccaattgattcacttctgtgaccttgggtaaaattctgctaaggcttctccacctggaaaatgacaaagagtgggcaaaaagctatttaaatctcatatgaaagaaaatggaatctataattatgaagtgttattatcaatgatattcctatgcctggctaatttatataaatcagaaaagtctggatatgctaaaccacctcagataagccaaaactgcttgagcagattttttaaaaatctcatatctaaaaatacgtgaggtctcaaatgactggagctatatggatgtcctctgcctagttcttagtctcatgatgtgacatagggaatctctatcaggtataaactgatcaacagaaagttccctgaaaagtcccttactattaatactatttttgcatgaggaatctttgaatattcaaataaaaataaacaaacaacagggaaagtgagaggcactatgaaaccaacctaaagccagaaagaattaggttcgaatcctggctctatcactttcctgctaggtgaccttgggcaggttaactaatcactatgagcctcagttttcttataagtatagtgtggttgctttgctttttaatgaagataagtattcacgagggattctgtgaggattgaatgagacaatgtgcatgataagcatagaacaatgccttgcacacagctgtgcaacaaccttgattcactttcccttcatgtccaggctgactagtgccagtcagagaccccagccttaccaggaaaaatacttagatctaaaaggaagaaaaacagaggacataaattagtacgttctatctgttctaaatcctactgaagaaaatgaagtcaatgctttgaccaatttggccaaagattcacagatttgaagacctcagcatttctgtgttctagttctcttagtttaaagacaaggaaattgaaatccagaagggttacctccaaggtaaaagccgtaactgaaaccaacactccactcttgctttagccttttatcagagagaccagcttagcaaacactgcccagttttgtctgattttgtagaatgtggtaaattatagaattagagaatgtgctgcatttagtcttgaaagaatatatggaggcagtaagtatagtggtcaagagcataggctctgaaggcgagaagggggcttgacaagtcacctgccctctctaagagcctcattcacctcatctatcaaggagataacaatgataccaatctacaaaggatgttagggagactaaatgaaattatgcacaaaaatcacatcgcacagtgcctggcatgcagtcagtattcagaaaatgataactattattaactataaaaacaataacaatttaccctctctaactaggatagctgaaatccagaagggttttcaaggtaaaagcaataatcttacatcaaagtctaaccttcttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgttcaaaaagcatttaatatgtgatgcaggtccagctaaagaagaaaaaggaaagaaagaaaaaaccttttaacgatttttaactgtacagcgattaaattatacacaactggcctgataatagagtctattcaaaatttgacctcaatctacctctccagctttatcttccattattatctgctagcctaactggatttcccaaacatgccctatgcttcttggtgccacatcattgtgtgcccttcagcttcatggttaaatgctccgtcccctgtgaagccttactttatctctccaaattaaaagtaatttctcatgatgacattatgagctttcaaatattcttttcatactgcaacattggcatcccgtgtaaatgcttcatatttctacacctgtcttatttacccttttaaattgcaaactccctaaggacagaggaaatgatggtgtggcagaactacccaggtgcgctggttattaagatactgcctctcagcgttgtcatgctggggcaggaatttcaggataagtaaacctaggttcacatacctttctgccacttcctaactgggggaccttttttgtgtaaattacttcaacttttacaacctaatttcctcatttataaaatagggtttgcaaaaattacctcaaagtttgtagtgaggaataaatgaatttatgtaaagtacccagcacaatgtctgatacaaataaccgcagctcgggcgcggtggctcacgcctgtaatcccagaactttgggaggccgaggcgggcagatcacgaggtcgggagatcgagaccatcctgcctaacacggtgaaaccccgtctctactaaaaatacaaaaaattagccgggagcggtggcgggctcctgtagtcccagctactcggaggctgaggcaggagaatggcgtgaacccgggaggcggagcttgcagtgagccgagatcgcgccactgcactccagcctgggcgacagagtaagactccgtctcaaaaacaacaacaacaaaaacaaataaccggcagctgtgactaatctgaggtctcgcagtgtctctcacctctttgtgcagtaaaagctttgaaagagtgaaccaacaagagaacaaagaaggaatagatgacaagaggcggaagtggactaacaatgatacgtttgttgaatgagtgagaaggtaatagataatgctgtgagattatgtggaaaactttttatctgaagtctttaaaagacattctcacttttggctgggcgcgggggctcacacctgtaattccagcactttgggaggctgaggcgggcggatcacttgaggtcaggagttccagaccagcctggacaaactggtgaaacgctgtctctactaaaaatacaaaaattagccaggcgtggtggtgggtgcctgtaatcccagctactcgggaggctaaggcaggataatcgcttgaacccaggaggcagaggttgcagtgggccgagattgtgccactgtactccagccggggtgacagagcgaaactccatctcgaaaaaataaaaaatgtactccagctggggtgacagagagaaactccacctcaaaaaaataaaaaataagggccgggcacggtggctcatgcctgtaatcccagcactttgggaggccgaggcgggcggatcacgaggtcaggaaatgagaccatcctggctaacacggtgaaaccccgtctctactaaaaatacaaaaaattagccgggtgtggtggcgggcacctgtagtcccagctactccggaggctgaggcaggagaacggtgtgaacccaggagtcggagcttgcaatgcgctgagatcgcgccactgcactccagcccgggtgacagagcgagactccatctcaaataagtagataaataaagactttctcaggtttttgttttgtttttgtttttttgacagtcttgctctgtcgcccaggctggagtacagtggcgcaatctcggctcactgcaagctctgcctcctgggttcatgccattctcctgcctcagtctccgagtagctgggactacaggcgcctgccaccacgcccggataatttttttgtattttttgtagagacagggtttcaccgtgttaggcagaatggtctcgatctcctgacctcgtgatccgcccgcctcggcctcccaaagtgttgggattacaggcgtgagccaccgcgcctggctgactttttcagttttaagctaagaatattctctaataggtatattattgacccattgacaatagaagattgaatacactttaggattccagcctcctcttctactgctcatgctctccgtaagaagggctaaacatcctactcctgtgcactacattggagctcagaaatactgacttaaaatctccagatcttaacacggacttttaaagggaagattgagtatggacccagtattagatggtattatggaattatttttaagctttttgggtacaataatagtattgtggttatgtttaaaaacaaagccttctctgtgagagttatattctgatatcttcccaaataaaattatatgatgtcagagagttgctgtaaggggtggaagaggacaagatggagaacgaacagtgcagggagatcactgaaaagaacagcaaaatgttgggaaccgttaaagctgagtgatgggaacatggctccctggtaaatgggacacatacatcgggaggtactattttcgtagtctttgtttatatttgaaaattttcaaacttacataatgagaagtcaaaaggggcattttcatcccaaaaaggtaaatgtccatattcttttttattttttcattttcatttctggaattacctaaactcaggtcatagatagcaatgaaaattcggctccctgtggcagcttctttcagccaccagacttacatagactcagtggtgcagagtccgtttcccaatactgagggataaagaaaattaagcctgcctctaggcacgtctcaaacttgggagactcagaatacaacagagtatgggatacagggaggaaagaagagatgcagaaataaattaaaaacaagatttgtttaaagaggaactgcaacttctttaattgggcagattgaaccaataaaagcacagttctctcccttcacctgttatcctttagtctcttcaactttcacattgcttcactcactctcttcctctccctttcacctgctcaccttacccaacttgaactgtgccctctgatctgacacaggatgacaatgacatcagtcattacctagcagccattttttctgataactagagttctgagtgatgatagttcatggtgagataatttccaagacctcgctagccattggtggtactactctccattaaagacaagggcatttgctgattgagaaatcaatcatacaagtgtccttggaggccaccaaggctttgcctgaactgttctcagcctatgatggtttctctttctaaacctgttcttctaggttcagctcaaacatcctctcctatagaaacctttccccatcctcccagtcagaactaatgatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcgagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccatctcaaataaataaataaataaataaaaaccaaaaaaaaaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaatcagagttgtgttaaggtcagtgagtgaaggaaatgggtactgcacctttgcaagatagtaggaagcaagccagagaagagctggcattccacaaaagagtctttatttgggacaaaaatcaatatgaccaaatcccatcctaatcaattctgtaaactaaaggaatttttaaaaaataatttagcaggaggaagagtttcaaaatcttgtagggaaaccctgatgtaactcctgattattcacccaaagtgaaaagtaactattagtgaatgggttttattttaaaacctttcatttttagaatcttatctcttctaggaaaagtgtagtacatacgaattttttgtatgcagagtgaatttttctccaggcttctctgacatcaatggggcaaggtcataactctataaaacagggagaagcactgagcattttcagaaaggactctatctgtcttgaccaaaagacaaaggactggtcattgcaggatccccagaaatacattttagtagtttccaagtgaattcttttgtaaatggagtttctctccattcataagttttagagcaaaaatgaagccttagtgggtctagatatctggctaacattaactccctgtgtgaccttaaactggtcgtccccaaagctttatgcttttatacaattaacttgatttacagcctctccttcttgcccataagaatgataataccacctgcattactcatcttttacgcttatgtgagacacctagccacctatcagaaggtattcaaatgcaaagcattaagtttttacactttaatgtgaagtggaagaaagtcttgattcaaatgcacaatctctacctttctactgattccacatttgctgtcttttactagtgcagttaagtcccaaattagaaacataagtcgccccaacatgtgacaaatgtcctttgttgccagagaaaggacagtggggctgtgtcctcagccttagcaaccagaagattctgcaagaccaggacattctcctgccagagcctgctttagtgtccagtcctgttctccaaagagatggaaaaaaccaagtggaaaagtttcagtttattcaatataaggctccacattcaaatggcaaaactgctctgttcaggtcatatttcaagcccaacctatgtcagtccttagtaaaagcttcaaagcaataccagtcctttcccagcctggtttaccttgattagacaaacacagacacccatgtctgagtaagcactgagaccatggatgagtgctaaggagattaggtgtttggatagacacagctagggtgtgtgcgtgtgtgtgtgtgtgtgtgtgtgtgtgtgtgtgtagagagagagagacagaggcaaagacagagacagtgctcattgggcagaggacagagtagctgagatagtatcatttgtttattcatttgctttttcataaaatacttagtaagcacctacttggtatgtgccaacactttaataggtactagaaagagcaaaacagacagaatcacagtcttcagagaatttacagcctatggggttaattaaaccaatgattatcatagcatgtaacaaacaaaagagaaccgagaatcagctgtatggaaatgcacacaggtggcagatataaatagcagcagatacacgaatcagtgcgggtccatcatataactcctagctttagtctctaaacttaggctcccactcaactcaactcctactctaactcaagatataccataccttggtttgctctttctctaagcatcgctgttctagtcttctaaggagcaggaatataaatctacatctatgtgaaactacagcacccccaagggaaaataaagaatccagtgctattctagtaattttagggcagtagtacagtacaatgcaaagtataggcttttgaactaaattggcctgggttcaaatatgagccctctcacattctattaggttgaaccatataaaaatggagatattcaatcatttttttacagtttcacgtagttcatctctgtattctagaggtaaatcattttaacctaagtttcatttccttctgttgttagtttttttaatggtgctaatacccctacctttcagggttgtaaatgaaaagatgttaaaaaaaaatacctgacatatagtgggtgttcaataaatgttagttttcccaaagatagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgacaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatagaatcttggtcgtgtcccagaggcctctgttgatgtggcccaactgagctggccagtgagaaaacatacacataaatacccatgatctcagcgattctctcccctccccaggacattccttagcagaaccaatctctctcactcggctggagcctctctgttcacagataggcctggctgggcttaatttagcaaagggcaggccccctgcaaaagccaggggtaagtctggagcccctgtaatgccccaggacaccttgtgtggagacaggagcccagccctgccgaaggagctaaaggggatgttcagaatgtttgtttttctcagctatttaggaactggagctcacaggaaccaccctttacttccttaacttctcacataaatgttttctttgggcagcagctatagaactggaaactaagtaaaaccttactttggaatataaaaactatattaatttttctatagataaattgttgcataggaaacttgctaaatatttttaaattatctgtaacatctaacataatctgacatttatccccaaattcagctttcaattctggattgaaacatactttgatctgttctctaaaaaggacaaagccagtcactggtgttttgcaaagtctgggaccatttttcctacacagaatctcacacaataaacagacaagatattagaaactaagttctaatatctagcagtcactccttccctggaagcctggctgtgtcctgaagccaggtcctatgatcaggcaactcttctgaagctctgcttccactagagacagcacttaccctgtagactctacagatgtaccatccaggatggcaggcatgagccacatgtggctactgaacccttgagatgtgactagtccaaatcgaaatgtgctgtaaggatttcagacttagcacgcacaggagttcaaagactaactacaacaaaagaatgtgacatctcattaataattttaaaatgttgatttcatgttgaaatgataatgttttaaatgtattattaacattaatttcacatatttctttttactttttttaatgtggccatcagaaaaatttaaattacatgtatggcttatatttacgttggacagcactgttctataagatgttaggaaaaagatgtatttgctttaagtactttgcattaagacatagtctgacctgaatcacagttaatcctgtggtctcatagcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccactgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacgaggtcaggagttcgagaccagcttggtcaacatggtgaaaccccgtctctactaaagatacaaaaaaattagccaggtgtggtggtgtgtgcctgtaatcccagctacttgggaggctgaggcaggaggatcgcttgaacccaggaggcagaggttgtagtgagccgagattgcaccactgcactccagcctgggcaacagggacatactctgtctcaaacaaacaaacaaacaaacaaacaaacaaaaaaaccagaagaaagcactggcagtctcttaccgccatatcaatccatctacacatctcgggttacattctctgtctttccacttataaccatagatcaactatccatgctcctatctaaagccaaaccttccacttatgtattaattaagtcctattccccctacctctcaaaggcaacacctagaaggtctcccctgcttctctttatcaatatttcactttctaatggaaaattctgttggcatacgaacatgctattattcatttatctttctagaaatcccctatggacctcatacccttatcaggtatgccccattcctttgctctcctttgaaacaaaactcaaagtaattattcatcctcattgactccaattcttctcctcacattgtttcttaaacccactgcaagcaggcttttgtcttcaccactccaccagaattactttaatcaagatcactaatgacatccatgttgttaaatccaaaggtcaattcttttttgagacagagtcttgctctgttgcccaggctggagtgcagtggtgcaatctcggctcactgcaacctccgcctcccgggttcaagtgattctcttgcctcagcctcctgagtagctgggattacaggcatgcgccaccatgtccagctaatttttgtattttcagtagagaccgggtttcaccatgttggtcaggctggtctcaaactcctgacctcaagtgattggcccaccttggcctcccaaagtgctgggattacaggcgtgagccaccacgtctggcgggccaaaggtcaattcttaatcatcgtattactcaagctctcagcaggatttcaaaaggtggatcctgtcctcttcactacacacattcttcatttggcttccgggactccagactttttctcctacttcactggtttgtaccttctctatcttccttttctgattcttcctcttttctccaaattactaatgttggagctatacaggaccagtctctggtccttttctcttccacctggaaaggtctaactccaactcctttggtcatctcctatggtttcatggctttaaatatttaaatttaatatttaatgatctatttgctgataactcccaaatttatgtctctagccctactctatttcctgaactttagacttacgtattcaactgcttacttaatactgccacataaaatgtctagcaaatagcttacacaccaaatttccaaaactgaacccctactctccaccttcaaatctgctccatccgtagccttccctatctcagttatggcaactccatccttccagttgcttactccaaaaaccctggaattttccttgattcctttatttctctcccattctgtatccaatccattggcaaaatccttttagatttgctaccttcaccacttgttcccacatgcatcactattacctaagtctgatcactatcagcccctacatacattactgcagtgtcttcctaagagtcctcctggtgtctacttttgttctacagcctatttgcaatactgtaaccagatttatcatttcaacaagtcagacaggactggcatttgttagacccctcctctgctcaaaacccttcaataggttcccatgtcactctgagtaaaagctgaagtctttaaaatcatctacagggacttactacacaagccccataccctctggggcctcatcttccagcatgcttaatcttgattatgctgcatcagccacagtggctttcctgatgtttctctgcctggaatattcttcccccagttctctgtttggccaacttcgtcatctccttcaagttgctatttgaaaattattttctatggcatagccactttgaaaaatagttagacagtatctattcagaaaataggcagaaataccgactgggcatccctaatctaaaaattcaaaatccagcatgttccaaaatccaaaactttttgaggaccaacatgatacctcaggtggaaagctccatacctgacctcatgaaaggttgcagcaaaaatgcaggcacaacacccagtttattcagcatccccaagagaaaaacataattaccttcaggctatgtgtacaaggtgtatatgaaacataaataaatttcatgtttagacttgggtcccatccccaagatatctcattatgtatatgcaaatatttcaaaatctgaacacatctgaaaatcttctggttcaagcatttcagataagagatatttaatctatatatacttattatataacctaacagttccactactgggcatttacccaaaagaaataaaacaaagacttgttacatgaatattcatagcagcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttgaaacacgtggcaccagtaggacatatggaaacttttttggtgtgatggaagtatttttttatcttgattgtgtggtgtttgttatacagtggtatacatttgttaaaatttatctaactgcatacttaataaagtttatttaaacaaaacatgaaaggaaaaactaaaatgacatagcaagtggcaatgcaaactgccaagtgcaaagaatgagtaaagagcttggttggcatggagactaccagtctaggatgcttttattgcctcaggtcagcttggaaggccataaatgctgtgaaggtaaacctagaaacaaatcttcctgcactggtaactgtcatgtttatttgcttccctttccatcccatcctttcaaaaaaaaaaagtaaaaggtagtgtggtccacaaactaccgtgtggctccccatgatccccgcctcttggtgtttgtgcccttgtgtaactccttctctttgggtatgagcaggccctgcgacttatttctaaccaatagaatatggcaaaggtgaaggaatgtcactcctgtgattatattaaatttcaaggctctcttgcttgcagatttgctctagagcctctccttgctgacttgaagtggccatatggggaaagctcacatggcaaggaacactaggtgacttcaaggaaccctggacagcctctagccaacctctggcaagaagtcaaggccctcagtcctactgctacaaagaaatggattctgttgacagcccaagtgagctctgagtcagattcctcagtcaagcctctagaggagaatgcagcctggccaataccttggctgtagcctagggagaccctaagcagacaacccagctaagcggtgcctggattcctgacccacacacactgtgagataataaatgtgttggggggtgaaggagggatgggggtaggggtggctgtgcatttgggtatggaagggtgttttaaatcgctttctaaacacggcctctcctggccactccttaatactgcaacctgctctccactcctgtaattttttttcaacatttgttttaggttcagggggtacatgtgcaggtttgttacatgggtaacttgcatgttgcggaggtttggtgtatgaatgaacccatcacgcaggtagtaagtatagtacccaatagttagcttttcaaccctcgccccccttctaccttccactggggtaggccccagtgcttattgttcccatctttgtgtccatgtctcaaagttttgctctcacttataagtgagaacatgcagtatttggttttctgtgcctgtgttaattagcttaggataatggcctccagctgcatctcttttgctgcagaagacatgatttcattcttttaatggatgcatagtattccgtgctttatatgtaccgtatttttcctccccagtctactgttgatgtgtatctaggttgattccatgcctttgctattgtggatagtgctgcagtgaacatgtaagtgcatgtgtctttttggtagaacaatttattttcctttgggtatatatccagtaatgggattgctgggtcaaatggtagttctcttttaaattctttgagaaatcaccaaactgctttccgcagtgactgaactaatttacattctcaccaacagcgtataagcacttttctctacaaccttgccaacaccttattttttgtttttcacagtaggcattctgactggtgtgcaatggtgtctcattgtggttttgacttgcatttctctaatgatcagtgatattgagcatgagaattttttcaaatatttgttggccccatgtatgtcttccgttcatgtcctttgcccattttttagttgggacaaggtctcgatctgttgcccaggagtgcagtctgatcactggagttcagtgatgcaaacacagctcactgcagccttgacctcctaggctctagcaatccttccaccactgcctcccaaagtgctggagtttcagatttgagccaccacacctttgctcatttttgaagtggggcaagacccccacttcgtaggactattacttgattgagattaaatatgtgtaaaatgcataacatggtgcctggcttatagtaaacactaaatggatttcttcttccataggatttaaatagggagcaattttttttctatcaagagctgatcagaaataaatgggaagcatttaaatgctctccttcccctgtcccaagaggactttcactttccaacattctacatactttatttataatatttattgtttattttctgtctactcatgacagactataagttctatgaggatgggaatgcctgtatgtgcttattatatgacctaacagttccactactgggtatttacccgaaagaaataaaacaaagacttatacatgaatatattgatatatactccagtcacctccaatagaatctagaacacagtaggggcttagtacatatttttaaatgaatgaagactaatgtttagtttaaactaggattgacctattcttatcttcggcagagacagagaataactaattaccacttgtcacatattgagacttcagtacctaaaaggcattattaggtcacctgtaagtctgttttcccccaaagtaaaaatcccaattccattgcccttttcacataagcctcattttctaacctttttagtttggtttaacgaatttcctatttcctctgaattctggagttccaaaccagactcagcacaagcctaacagggcaacctatacagataaggacagcccaggcacattgcacacggcaagttgcacctgttttaagagtaaaaatgaggtcaatgccaccttgtactgcaggtacctcaatgagacaatgccaccccttcctgccacaatcttggcaaaagtcactacgaaagtaaatatcattttactagagtcctttctttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaaaatgcataacatggtgcctggcacacagtaaacacaaaacagatttcttcctctatagcatttaaatgggaagtatttagcgtttacttgccatgtgcatgagtgaatttgggaaaagtggggggaggatatggggcaaagaaggacagaaagggcctaagagtaggaagaatttaataccagaagatgggacaagacctgggtctagaaacctcttctgcagataaagtagctgcaaattatagggaaggagtcctcaggctgctttccttataaccatttattttcctgcaccttatatcaagaacgttaggcactggttaagaccctgtccccttgcagcagtagagaaaacaggaggaaggagacgggaggtagaaatttggaagctagcagttgaaggccaactcagaaagcgtcaggtggaattccattcctaattgacatcaccatcctctaactgcagcaattctctccagcccttttatgtgctccctacagaaccaagcttccacacagctgaaggaacctgtctgctctcaccccagcttcacagaagatggcagggactggttattactaacctgcctcctagtcttctgaggctccaaatggttttgtcagcaagctgagcttccccacaatcccacagactagaaggggttggaaagaacaagccttagaacaatactgctccccacctctaagggatctgctcctctgagtcccagaagttcaccgccttcatttgatttctgctacaggaagactctgggaatccagctctggacccagcacttcctgatttttgaagtagagagttgacaaccctgttgtcatcaatacaactgtgctaggtgggtgggaaaggaaaatatcttgggctcccaaaatcactaagctaaaaggaaaactcaggatcatggtggatggaagtcaggactagattgcagctccgactcggatggacagagaagcatgtggaggctcatatcatgaatttttgctccagaacgactggaggaataaattacaaaacctgagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagctcgaacacaaagtcttcaatttgacccaatccaaccaagacaaagaaaaacaaataagaaaatatgaacaaagcctccaaaaactctgggattatgttaaatgaccaaacctaagaataattggcattgctgaggaagaagagaaatctaaaagtttgaaaaacatatttgggggaataattgaggaaaatttccccaaccttgctagagacctaaacaaatacaagaagcacaaagaacacctgggaaatttattgcaaagagatcgtcacctaggcacattgtcatcaggttatctaaagttaagacaaaagaaagaatcttaagagctgtgagacaaaagaacccagtaacctatgaaggaaaacctgtcagattaacagcagatttctcagcaggaatcctacaagccagaagggattgggcccctatcttcagcatcctaaaacaaaacaattattagccgagaattttgtatccagtgaaactaagcttcatatacgaagagaagatacagtatttttcagacaaacaaatgctgagagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacagaattgcagaatggataagaattaaccgaccaactatctgctgcctttaagagactcacctaacacataagagacttatctgacacataaggactcacataaacttaaggtaaaggggtggaaaaaagacatttcatgcaaatggacaccaaaagcaaaagcaagcagaagtaactattgtttttttgttttttttggtttttttgagatggagtttcactcttgtagtccaggctggagtgcaatggcgcgatcttggcacactgcaacctccgcctcccaggttcaagcaattctcctgtgtcagcttcccaagtagctggaactacaggtgtgcaccaccatgcccagctaatttttgtatttttagtacagataggtttagtacaggcaggggtgatccgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaggccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaacacatatatacagaacattccatccaacaactgcagaatatacattctattcaacagtgcatggaactttctccaagatagaccacatggtaggccacaaaacaagccgcaataaatttaagaaaattgaaattttatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaagggaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccgggcgtggtggctcacgtctgtaatcccagcactttgggaggccaaggtgggcggatcacaaggtcaggagatcaagaccattctggctaacatggtgaagccccgtctctactaaaaatacaaaaaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttataggtgggaattgaacaatgagaacacatggacacaggaaggggaacatcacactctagggactgttgtggggtggggggaggggggagggatagcattaggagatatacctaatgctaaatgacgagataatgggtgcagcacaccagcatggcacatgtatacatatgtagctaacctgcacgttgtgcacatgtaccctaaaacttaaagtataataataataaaataaaataaataaaaaataaaaaataaaaataaaaatacaaaaaattagccggacgccatggtgggcacctgtagtcccagctactcgggaggctgaggcaggagaatggcatgaacccgggaggcggagcttgtagtgagccgagatcgcaccactgcactccagcctaggcgacagagcaagactccatctcaaaaaaaaaaaaaaaaaaaaacctagaagagatggataaattcctggaaagatacaaccctcctagcttaaatcaggaagaattagatactctgaacagaccaataacaagcaacaagattgaaatgctaatttaaacattaccaacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccatgatcaagtgggtttcataccagggatgcagggaggtttaacatacgcaagtcaataaatgtggtacaccacataaacaaaattaaaaacaaaaatcaccatgatcatctcaatagatgcagaaaaagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacacgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcacgaccaagaacccaaaagcaaatgcaataaaaacaaagacaaacagctgggacttaattaaactaaagagcttttgcacggcaaaaggaacagtcagcagagtaaacagacaacccacagagtgggagaaaatcttcacagtctgtacatctgacaaaggactaacatccagaatctacaacaaactcaaacaaatcagcaagaaaaaaacaaacaatcccatcataaagtgggctaaggatatgaatagacagttctcaaaagaagatatacaaatggccaacaaacatatgaaaaaaggctcaacatcgctaataatcagggaaatgcaaatcaaaaccacaatgtgataccaccttactcctgcaagaatggccataatcaaaaaaataaaaaaatagtagatatggatgtggatgcagtgaacagggaacacttctacactgcttgtgggaatgtaaactagtacagccactatggaaaacaatgtggagattccttaaaaaactaaaagtagaactaccatttgatccagcaatcccactacagggtatctacctagaggaaaagaagtcattatacaaaaaagatacttgaacacgcatacgtatagcagcacagttcacaactgcaaaaacgtggaaccaacccaagtgcccaccaatcaatgagtggataaagaaactgtggtgtgtatatacacacatatatatatatatatgatggatatatatatatatatatatgatagaatactactcagccaataaaaggaataaattaacgcattcacaatgatctggatgagattggagactatcattctaagtgaagtaaggcaggaaaggaaaaccaaacattgtatgttctcactcataagtgggagctaagctataaggatacaaaggcataagaatgacacagtggactttggggactcaaggggaaagggggggaagtgggtgagggataaaagatcacaaatagggtgcagtatatactgcttgggtgatgggtgcaccaaaatctcacaaatcaccactaaagaaattactcatgtaaccaaacaccatctattccccaataacctatggaaatgaaaatacaaaaaataaaaggaaaactcaagctggaaactgtttagggcaaacctgcctcccattctattcaaagttatctctctgctcactgagataaatgcatatctgattgcctcctttggaaaggctaattagaaactcaaaagaatgcaaccttttgtctctcttctgtgacctagaagccgcctcccccactgcaagttttcctgcctttgcttcaagttgtcccgcctttccagacctaaccaatgtacttcttacatacattgattgatgtctcatgtctccctagaatgtacaaaaccaagctgtgccccaaacaccttggtcacatgtcataaagacttcctgaggctatgccaggggcacgtgtcctcaaccttggcaaaataaactttctaaatttactgagacctgtctcaaattttcggagttcacagtgggcaagactagatttacttttgtgttgagcagatactgagcttgactgatgagaatctggagtgtgaggtctgacggagtaactctgagagaggaagctacctgtgtggtctcagggagaagatctgagacttaccaagaaaaagtgacctgaaagaactggctgacttcaggcccttgaccagtgcctagaccctctttctgcagctccagatcatagccatcatgctggcagcctccctgccgctcatccaggcaccttaaagaagggcttcctcttcccaagcctctgggtgggctttctaaagccctgtgtgcatgaagaggtggcttgtagccctttgcagcagcagggcttacatgaggctgggatatgaaaagctggcattacaatgcagcttgtgccttgcattcactccccacttcatcaagccaagtttctaaataacagggatagtaactgcccactgtggcccaatgtcacttctaaagttgcttggcaaaaagccacatgactattacttagctctccacagaacggcatgtaccaagtcggatcactgctgtcggtgtgtgggtggattagctgctattgaacatgatagggcgggcccctttccagtttgcaccagccccgctctgtgcctactccatgtatcatagagcctcctctctctgtgcagttgaacttgatcagatgagatggcaaaagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtgaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttaggcaaattactattctgagctttagtcatcttatctttaaaatgaagggtttattctttagaggaagctgagtgaatggcatacgggaacactctgtactatttttataactttgctataagtctaaaattatttttaaataaatggttttcttaaaaagtgaaaggattatgtagattatcttcaagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcctacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacaggacttcagaactgggagggatgtgtgcgtcaatcctggtccagcccactcatttaaacacaaagaaccagaagcccagaaaaagtgacttgccttagcctggccttcctcttgattcctttccctcaattctcccgtcctgatcaatcatcaagtcctacaaatattttacctcttaaatattttaaagatgagttgcctcccctctattcctactgccacagccctcattcgggccttcatcttctttggcttggcaagtctgttctcactcacttcctgccttgactctcttgaatccacctttcccatgcatcagagggatctagcaggttccctgcagcttaaagcccatcagtggtgccttgtcttcttcaggataaagtctacactctttaaaatggcacaaaagactgtgtccgtcatatcagtctcattcttcgcctagtacttaaatccaccaacaccaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagttgccttacactttgtacacagctctgttactgccttttactatactctagcacctgtggtttactcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatactgaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaggagattgagaccagcctggctaacgtggtgaaaacccgtctctactaaaaatatgaaaaattagcgtatgtttcacagcatctgtaatcccagctactcaggaggctggggcaggagaatcgcttgaacctgggaggtggagattgcagcaagccaagatggcgccactgcactccagcctgggccacaaagtgagactccatctcaaaaaaaaaaaaaaaagaagaaaaaagaaatgccttttcccatttcttgttatgttactaccttttaggattcaatgcaaacttcaaacacttggcaaggcctttcctggtggattttattgcactatagcaaaatctgtccatacctctatggtagcccttattataccatttttatttatttgttgatgtcttctccaccagaatctagcacagtagctggcatatagtagataatcaatagacgtttgactgaatataccaatgcatatgcgcaaatatgagcaaaaaaatgactaaaatgatattgcaaacaagggaaacatttgagacagaaatttagaatgtctatttttttcaagtgtaacatgctacttctatcagtgcataaacctgaatgtacatacactatagaaagaagtggccttgtaataagttcatgcagaagtataaattatgtagacattgttagggggataactgaaagtggattagaattaaattagggcccagaatttagtctgggatttgttttccagtggttgaaagaaaaattcctaagtattcaaagggaagaagcatttctcaacaggcaagtattatgaattctaattaaaagctctgaaaaaatgagataagttgtgttaaggaaaagcagaaaacagagttgcctttggttaagagttccactatttttataagcaactgacttttttggggaaagttgctttaagcatttttttttctgtgtgtatgtgtgagatggggtctcactctgtcacccaggctagaatgcaggagcacaatcatggctcactgcagcctcaaccttctgggctcaagcaatcctcccacctcagcctcccaagtagctggtaccacagccacacaccactatgtcagctaattaaaaaaaaaaaaatttacagagatgcagtcttgctatgtttcccaggctggtctcaaactcctgggctcaagtgatcctcccaccttggccttgcgaagtgctgggattactgacatgcgccaacatgccaggcctaaacattttgtgtgtgtgtgttaaaatatacatataataaaatttgccattttaactattttaaagtatatagttctatggcattaagtacattcacatagttgttcaaatatcactatccatctccagaactttttcccaaatgaaactgtagccactaactccccattccctcctccccacaacccctggcaaccatagttccactttctgtcttcattatttgactactctaggtacttcatttaagtgaaataataaatatttgtcctttagggactgactttacttagcatgacatctttaaggttcactcatgttacagcacatgtcagagtttcatacctttctaaggctaaataatatccagtgtctatatagcccacattttgtttatccactcatttgtcaatgaacacttgagttgcttccacctgttggctactgtaaacaatgctcctatgaacacagaaatacaaatatctatttgagttcctgttttcatttattttgtgttatacccagagtagaattgctggattatacggtaagtctatgtttaattttttgagaaactccatactggttttcacagcacctgcaccatttcacattctttctagcaatgtgcaagggttccaatttctccacatctttactagtatttgttattttctgggttgtttgatttttagtataatagccatcctaatgagtgtgaagtttgaaaaaatatttaaccaaaatcataaatattggttacaaatatttaatggatggattccctctatttctgccaactttcattccctgaaagaagaaataggtaagcatgacctcacgaacctcagaaggctgagaatggggaattggcacacacagtgtgcgtagacacagacacacatggaccatgttcatactaggcttccagagaaccatttaaaaatagtttggctaatgtaatcttgtctgtctcttatgttcctcctttcccatcatacacatttcttaaagttcgtgtaagtaaaacataggagaaaaaaacatagccactaattaaataaggcatccaagtgtaaaagaagagcaaactctgctacatataagaagacaagcattaattctggcaacagcagccacacagccactttagacaataacctgagcaggtgcatgctttctagtatgtgtctccagctatgcaggatagaaatcacaatcctttctatttatctaacgtctaatacactaaaacatgtttacccatgggggagaagagcacgacaggaattgatgactctaatttaggaaactaaggttcacagaagttaagtgacttggccaagatcatgtagctagaaaaggcaggttaagaattcaggtttccttagagttcaaaacttttatcacaacatttttgataaccccccaagatactcatccttctctaatagccttcctttggttcaagtccagcttcctaaatcctaccgcctgatggagttcctgagcttccttgtaagtctgcaggtatattgttcctcatcatgttgcccaaagcctaaagaaatcaggctaggaccaaagaaaatcagtcaatgagccaaaaagaaatttaatcaacccagcctttcttatttattttctttgaatgaacatttgtatctgagaatgccaaggtaaatttgatgcaatagggacacttggattatattatgttatttacacacaagcaaacaaaaattgagaattgagacaaataggacaaatggtcccaagtccactattgaggaaaaagaaactgatttggaataaaaaatagtccagcatgaatgtgtcagtaattaagacttatctggataagtttgccgtctctcaatttgtcacaataatggcaaatatttattgagagcttactatgtgataggcattatgctgagttcagctaattgactcatttcatcctcctctagaccctataagataggtgttattactgcccttgctttagctcagagaaattatggtatttttcccaacacaaatagtaagtagaaaaatcaagatttcaccccaggtctcgccaatttatagctcttagccgttatgcccagcaataacagaatagtaaaaacaaggacaatttggtaggcaagtaaaatcagtaggctgtttaccatagctatagaagtatgctatgcataaacctcaaagattgcgcaggaaaagtatcatccaatctcaaagatgagaaaaccaaagaagtttcaatctcagagaagtcaggcagcttaagggtcataaaacaacgcaacacaactctctcaactcatatctaagggctaagtccactttaaccttccaatatcattacatcatatttaaacattgactctatctggtcaaggacgacaacattttatttctcctgacccttttgctatcagatctggccttgtcagtttttcaatttcattcttagaatggaaacttaattcacacaagttgaacaagtagtcatcagggggcaaaacccagtggatgatggttttgtgtgctgtttggagactgggtgtttaccacacagcagtggatttcataaattccagggtcagacaagattccagtagcgacacacttgactaatatgagaaaatgcaggattaggcaatcaacaatgaggaagtcagccaagttgccacccaaaaattacttaccacagcagctgcagtccagaaatgctaacaagccagtctccctaggagtgggccatactcagctgtggaccactcacaacattttctcactttattttgcttcagagtcagtgtactgcaatgatttctcctttgcttgctttatatgtttaaaattgtcttccctaaaagctgaacttaaaattaatgtttgctaccaaaagggggtagcagtgcctagtcatgtaggcatatgtcccactctgtcggtacagagggtaagcagcctcttcctttttaaaaaatttattacgatgatttacaaaaattgaagcttacaggataaacactcaacaaaaaagtagccagtctcaagaaaccaatttttatgtatgaattaatattattttattaatccatggccaggatgattcttaagattatttcttaattctctgaacagcttaaaagagagaaactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaaagagaaagatagcacccactctccagttctcttctcccaaagttgcccgtatttcccttccctgaagccaatcaaatactttattgtttctcgctaagagtaatttttcactcttaagtacaaacagctcaacaaaaattcccggtagcataaatatgcacatcaataaaataattactactcacaatagactttccattacatatgtttcacaagcattggttttcttaaaaagaaccacgcatacagcactcaaattattgcagattctaactcagtagagtttgatttaatgtttttacaatattttttttaaagaagtgtccttccaacgctaaggaaaaaaatcagaatcaagaaaattctgtttcttagcaacagaaaaatcaaacttctgttactaagtttggtaacagaacagtactctaaattatcctctgaaccacctgatttaccatgtgatgctgggcacattgctgctaattaatcttcctaatctcgtgggatcacaatatgaataacaagaatgaacatcagacacatctgtgggaattatgagggggagattataaagagtcaaaccttgtccccatatttaaattttataataactataactactagtagaaatataactactaccctctcatatatatgtgatgttattaagtttataaagtgttttgatatgtttcttatttcatcttcatggctgctatttattcatagaaaaataattctcagtatctgtagcattattgttaatgtcaatcctatagaggctggaacaggctcagagaggctaagtaacttgcctaactaagtctcctggttgacaataggtcttaatgcagtgttttccgaatccctcgttcttacatcaaaacagaactgtggctgggtgtggtggctcatgcctgtaatcccagcaatttaggaggccaaggtgggaagatcacttgagcccaggaatttgagaccagcctgggcaacatagtgagtgagacctcaatctctgccaaaaaaaaaaaaaaaaaaatacatacacacacacacacacacacacacacacacacagacacacacatatatatataaataattagccaggtgtggtggcacacctgtggtcccagctacttgggaggctggggtgggaggatcatttgagcccaggaggtcaaggctgcagtgagtcgtgacggtgccactgcactctagcctgggtgacagagcgagaccctgtctcaaaaaataaaataaaccagaacggctctagttcctatcaatcactcatcatgacatagtgtggtaaactaatttcaactctgaatgattgataatggctttatgtgttctgtttcccaagtaataagaacattttagcacaagcctttagcgcttttcaaataatcatagccaaatgagaaaattaatatgacaggcagattgaacaaacatttggtgagaaggaagaggaggggatacagtagtttgagatccctcaaatcatatgatgcagtagctgcctgacaactctgctaacacgtaagactagatagagacagggccatatctacttcctgtatgggacccatggcaatactagagtctagcaaaagggttgtcctctctgcatgtgacaataggctgtgttccactccccccacatacaccttgtgcagctcctataatctcatttatcacacttctccaggtgagaaatggtgccttctcacaccccacccaaagttgtttcctaaagatctttcgctagggcggagcagagagtgagatcaaatgattcagacagccatctgattcagctttaaaaaaaaaaaatcctggtgggggcgcagtggctcacgcctgtaatcccagtactttgggaggctgaggcgggtggatcgcctgaggtcaggagtttgagaccagcctggccaacatggtaaaaccccgcctctattaaaaatacaaaaattagccaggtgtggtagcaggcgtctgtagtcccagctactccggagaatcgcttgaacccaggaggcggaggttgcagtgagctgagatcgtgccactgcactctagcctgggcgacagagtgagactctgtctcagaacaacaacaacaacaacaaaatcctttccctcaaattacctaagaaattgtcctttccttctttgccctgaagacagttaatggggaaagttcctccctctgcacagtgaataaatccatccactattcctaccctaaccctaaggcaaaacctcccactcatcctctgtctctcgccatctctctgttaccaaccctcacttggcaatatccttcttgacacgtggcagctccaatgaggcacactcattacatagccacgtaaaagataaaaggtgaatctggaccaacttctggaaaatttggacttaaaacatggaaatgcaggagagacaggaaatagagttaaatcccccagatttagctatacacattaattgaattaactaaataatcatttgggtctcatagacaccagctatttccctgatccaagatgttatctagcagcctgtatcgcttcccagtcatccatcctcttgacaggacagagcacacatagaaaatggtatttgtatagtcctctggggtaaacagttggagagttagaatctctgataaggtcagaggcaaccagtccccggtcacttgggccacttcaggtcctgcttgtccagacacagagagggctgaggaaaccaatattgtggtgaccagctacgaggcttaatcctcataacccatagcccaatgtcctcttatcaaggtgctgtcctatctcacccacagctcagccaatccagtaggtcttccttccccaccctgatcactgacccatcaatcaagatagccctcccatccaaggaagaggccatttcccctcccactccacccaggccaactgctatcccacaggttactctcttcttcattttaaggcaagctattccaaagactaaaaatgcctaagattctgtcttaaaagcttatctgcatagtcatcttcaaaagcaaacatgaatttctcaaggaacggaaacacccttagcccctgcccttttctccatagcatcattctctgccccaccaagccggaactaggagggcactttctctaggagaggtatgacctggagatgatctgcttcagagccacctcagggatcttgcttaaaaatgcatattttcccaggcaaagtggctcatgcctataataccaacaacagtggaggctgaggtgggaggatctaaaggccaggagtttgagaccagcctggacaacatagtgccacccctttggtacgaattttttttttttttttttttgagacagactcttgctctgtcacctaggctggagtgtagcggcgcaatcccgtctcaccgcaacctccgcctcctgggttcaagcaattctcctgcctcagcctcccaagtagcttggactacaggcatatgccaccacacccgctaatttttgtactttttaagtagagatggagtttcaccatgttggccaggctggtctcgaactcctgacctcaagccttctgtcttccttggcttcccaaagtgctgggattacaggcatgagccactgtgccctgccaatttttttttttttaattatctgggcctggtgtcctgtgcctgtggtcccagctgctcaggaggctgagccagaaggcatcacttgagcccaagagttggtggctgcagtgctatgatggtgacactgcactccagcctgagcaacagggcaagaactgtttctaaaataaataaattttaaaaatgcaaatatccaccccagccccaccctctccccccaccttcccccacattactacatcggaatccctagggtgaggcatggaatctacattttaaaccagctcccaaggtgattgttccgcacagttccacgtcagtgtttgagagaggctctgatttattccagtcctctttctttacagagaaggaaagcagaaagcaggcaccagagaggtgaaatgagcttgtccaaggtcacaggttgttaaggtgaccagagctggacgaaaccccacctctctcgctgactagcacagcgccagctaggaagagcctagaatagcgaccaactggcaggccaaaccgtcccctgcccctgcccctgcctcggagaagcgggcccctgcactcacccgcttgtagatgtcctcccggctggcctcatacttctgttgcatgcgctcctccaggaagtagatgcgcagcttgaggctgaagttctccttcttcaggtcattgaggtgctgggacagagtgcgatatccattagacatgatgggcaacccatggggaggagcgtgcccgattgccccctcaacccaggaacatggtgcagctgcaccgcagcatgaagccagccggctgggacgctgctgaggctgcggaccgagaggctggggctacggcgacatggcccctattgctggagctctctccgggactcgggactgggctcactgctctgggtgctggagcgcagcacactttccttttttacctcagggagatatttgcggaatccctgacagaggaacatgctgcgtgaactcagacacaagtggtgtaacccgactccaagccaggactctgctgtcaccctcctggagcctcccaggcccaactgtaggcagttaacagcttctcggaaaagagagactgacccccaagagcttccaggaaagggggaggggagatattcaaggtgacagtgggtttgcaaagaagagaaggaaatagagggtggggagggggtatttaaatgacttgtggctgatttggactataagaccaaaaggagtgtggccagaagcaagaaataaggttgctatagaaaagaccatgtacataaaacggcccacaaaggtaaccgcatgtcaaatatcccctttctgtccagtgcaaatcttaaagagcttctaaccagaggagtctcaatttcctttgataatccagagctcacttctaatgagttcctttgcagttttcagccccaagctttttgagctctgaggcagttcaactaatagcctttattgccatgagccttcccccgaaacacaccatagctacccgcaaagaaagagcaaatcttctagctcagcggaatctttgcagactctatttaccagttacaaagctcagaaagaggcagggtcaagggatcctccctccatggaagaagggatgggcagaagagagtgtgggaggatgacagagagggagccgtcatcctggagcccaaagatttcaggcagtcactggttcttaactctggcacctgccaagtggagccgggcactcatcaccagatcttgctcctaaagtaatttaagatccttgagtgacagctgcaacattagcaggaagtattatttataccacattacattgaaggtgatgggagacaaccccagagcacagataacaaacacgggttctttgtggcaataatattaggttgaaaaaatatatattaacattcaagataaaggaaactacaaaatttacacttaattcaagccctcatttcctccccaacctacctgcttttcattcttccaattccttctcaaaccttcataatcattccagtcaacaactcctgagtactcaccaggtaggacattgggcatgagggatatatagatcaagaatgtcccaaccctcaaagagctacgtggccatacagctggccatgatatgttaagatatgtgttttacattatgatcctccaaacctgtgtttttcaacttttgtatgttacattgccatctagtacatatgcatacactcttaactgaagtaaatgtttcaaaaagtaattgtcaccatcactatgtgtgatgtcctctgatatttcctatttctttttctgccagtgacccacccgacggatttcatgacccactaataagtttcagcctgagtttaaaaaacgttgactctgggggagcccgtaagaaagagtagtcagttcttactggggtgatcagagaaagcttcattaggagttgaatttgcactttgccttgaaaaataaaaaatgtttgagtggataaagtggccccaggagggcataattagagtgaagcattctcccaaatagatttagattataaataggcaaaataggcaagcccaaatatttaccatttgaaaaaaaaaaactacacatttaaaatccatttaactattttcactaaatctgaattcttagaatttgagaatgccaactaggcttagttagagacagtgaagaaaaaagtctaagttaaaacaactcaaaatatccttttccattcccagttctcttactaaatagctatgttatagaccatttctctagaagcctaactgtcctcacttaaaaaatgaaatggctttaaaaattggtgattttttttttttttgagacagagtcttgctctgttgcctaggctggagtgcagtggtgcaatctcaactcactgcaacctctgcctcctgggttcaagccattctcctgcttcagcctcctgagtagctgggactacaggtgcccgccaccgcgcccggctaatttttcattgttttagtagagacagggtttcacagcgttagccaggatggtctcgatctcctgaccttgagatccgcccgccttggcctcccaa

SEQ ID NO: 1121 - DNA, 43322 bp, Homo sapiens
gcagacaacttgctcttttaatgtggaatggatgaccctccaatatttccccagagcaccccatgctcttctatcagggaacttattaaaatcatgtaacatgtttcttggtgacaagaattaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatggataccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcaccgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaatggggttatttgtttttcattgttcaattgttaaattccttatggattctggatattagacccttttcagatgctagttgcaaatttttttagattctacaggttgtctgtttactctgttgatagtttcttttgctgtgcaaaactctttagtttaaataaatccgacttgtctctttttgtttttgttgcaattgcttttgaggacttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgacaggaatagtgttgaatctgtagattaccttcggcaatatggccattttaatgatattgattcttccaatccatgagcatggaatgtttttccatttgtttgtgtcatctatgatttctttaagcagtgtttcatagttctccttgtagagatctttcacctccttggttagatgtattccaaggtatttttttttttttttagcagatattgtaaatgggattgcattcttgatttggctctcagcttgaatgttattggtgtgtagaaatgctactgattttttttttttgagacggagtctggctctgtcgcccaggctggagtgcagtggcatgatctcggctcactgcaagctccgcctcccgggttcacgccattctcctgcctcagcctcccaagtagctgggactacaggcgactgccaccacacccgcctaatttttttttttctatttttagaagagacggggttcaccgtgttagccaggatggtttcgatctcctgacctcgtgatccacccacctcggcctcccaaagtgctgggattacaggcgtgagccaccatgcctggtgaaatgctactgatttttgtacattaatttttgtattctgaaactttattgaagtctgaaaatatttttaataattttagtaatacttgtcatttaacactaagcttttaaaaaactgtaaattataaaagtaaccattttagcaatataaatgtatataaagaaaaatatcaagtcttctccctatcacggactgtgatctcactcttcctcagtatactataaatatcactcagcaacttttcccccttactttaatcaaggaattcccactaggacaataatatagagctaactcattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctcgggattgtttgatcaaaggaaatcctccttttttattataataggtagcatcccatactaaaaatgttgtcacaatttacactcactggtagtgtatgagagtgcccattttccccaaatgttatctcagctcttgatgttattataggctgactgatactttttgataaagcttatttgcatttgtctctactaaaagtggaaacattcactgtttcaatttagttgattgctgactgataggaagtttgcagtcttaggtctggtggatttaccaacttatgacaaggtccatctgacctagtaatagagaaagagcccaagggaaacacagcatatgaaaatctattgtttcagttcctgaatcagatacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcaatgttctgaaaaacacacaggcattaatcgttattaactgccacagacactctttcctggatccaggttcctatttgagtcttgccttggtccacagcctctcacctcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcctgaaaacgaaattgctggaataatacttttaatagaattatagtaatagaacaatacttttaaatgtctggggatttaattatttaaagaaatttggttgtaaacatttttaaaaacaatgcttttatcataaaattggaattttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtctggtgcaggttaagtggcttagtgtgtggtaaggagtatagaaaatagtttgcaactagtttgtgaaaatcctgctaagacaactagataggccggccacggtggctcacacctataatcccagcactttgggaggccaaggcaggcagatcactcgaggtcaggctttagagaccagcctaaccaacatggtgaaacctcatctctgctaaaaatacaaaaattagctgggcgtggtgacatgcgcctgtaatcccagctacttgggaggctgaaacaggagaatcgcttgaacccaggaggtggaggttgcagtcagccaagatcatgctgctgcactccagcctgggtgacagagagagactctgtctcaaaataaaaaaaattaaaaaagtaaaaaactggataataatcagtagaaatcaaagacttatcagggagctttaagcaaagtattggcatgatcgggtccatgttgaagaaggaattatgaagaaggtgggtgggtcaggggcaactaaccagaatagggagggggactgtctaaggacaagaggtacagggagaaagactcaaaagacatttcagagacagaagccacaggccttgatgacttgtgagattcagattagactggagggaggaccaaagacaatgctgaaatttccagcatgtcagtgggaatgcattctattaactaaaataggggcaggtttgtaggggaacctaaggaggtttctgcaaaatgttaattgagggattactttatttcagcttaaacgttagcatgcaaagatggattagtcccttccctgatgaagtccataatacagtattaggcaagaagaatgttatttagtaaagaagtctttagatcagaggttgacagagagactgaaggtaaagtagctaaagtatgaaaagtagtattgtgggtactagaacagtagggaggattttactttactatcgccatataataaccaccaacacctagacttctagaagtccaaggcaacatacaatagcagcatattttctaccatacttgtgaaggcatttcataacccatgtttccatgcagggtggtcgaaacacaaatactaattgggaaaagtagaaacctagtttagatatttgagagttacttagaattaaagaattttagagctggaaggcagttggactcaaggcattttagatcatattactagtatgtttttagtgacatactgagaagaatgtttgttcccctcataagtaggtaccttttgaccaaggttagaacatagattcagatccagtgagatgaaaatatcctaatttcttcaaaagaaggaatgatagccctgtcttttcaggatatactttaaagttattattttatgaacactaaatagcattaccagatttagcaaataaaaatataagatatctacttcaatttaaatttcagataaacaacaaataatttgtttcattagaagtatatcctttgcaatatttgagacataacttaaacgctaaaacattgtttgttgtttatctgaaatttaaattgaattgagtaccctgtattttattctgcaatacaaataccaaaagattaacaaatggaaacacgcatatttcaattttgtatgaagaacaagtctaagatctctatatcagttccatggcctggcactgcaagaataattcatctgtaccaattgatgaatcagtaaaatagaagatttgctaaacagttgctatgtccccagctttgtggtcaatacttaaaggaattcaaatgtcttcataaaaaatagtccctaagctagaggcccttcatagaggtgaaggaatatgcattcaattatgtgggaaatgcaaagagggagcaacttcctaatctgtaataggcagataattgtattttcctcattcataaacctacctgagaggatcgtgaggcataaataaatcaatacatgtaaaggacttaggacagtgtttctaacacaggtataactataattttaattataataatattattatcaccatcatcatcaagaacaacagcattatcatttggaacagcagtttgctttccatgagaccataatgtttcaagtggattcagtgttcaggatatggtgctgagaaagaggactcctaagtttattattatttctgccaccaattgattcacttctgtgaccttgggtaaaattctgctaaggcttctccacctggaaaatgacaaagagtgggcaaaaagctatttaaatctcatatgaaagaaaatggaatctataattatgaagtgttattatcaatgatattcctatgcctggctaatttatataaatcagaaaagtctggatatgctaaaccacctcagataagccaaaactgcttgagcagattttttaaaaatctcatatctaaaaatacgtgaggtctcaaatgactggagctatatggatgtcctctgcctagttcttagtctcatgatgtgacatagggaatctctatcaggtataaactgatcaacagaaagttccctgaaaagtcccttactattaatactatttttgcatgaggaatctttgaatattcaaataaaaataaacaaacaacagggaaagtgagaggcactatgaaaccaacctaaagccagaaagaattaggttcgaatcctggctctatcactttcctgctaggtgaccttgggcaggttaactaatcactatgagcctcagttttcttataagtatagtgtggttgctttgctttttaatgaagataagtattcacgagggattctgtgaggattgaatgagacaatgtgcatgataagcatagaacaatgccttgcacacagctgtgcaacaaccttgattcactttcccttcatgtccaggctgactagtgccagtcagagaccccagccttaccaggaaaaatacttagatctaaaaggaagaaaaacagaggacataaattagtacgttctatctgttctaaatcctactgaagaaaatgaagtcaatgctttgaccaatttggccaaagattcacagatttgaagacctcagcatttctgtgttctagttctcttagtttaaagacaaggaaattgaaatccagaagggttacctccaaggtaaaagccgtaactgaaaccaacactccactcttgctttagccttttatcagagagaccagcttagcaaacactgcccagttttgtctgattttgtagaatgtggtaaattatagaattagagaatgtgctgcatttagtcttgaaagaatatatggaggcagtaagtatagtggtcaagagcataggctctgaaggcgagaagggggcttgacaagtcacctgccctctctaagagcctcattcacctcatctatcaaggagataacaatgataccaatctacaaaggatgttagggagactaaatgaaattatgcacaaaaatcacatcgcacagtgcctggcatgcagtcagtattcagaaaatgataactattattaactataaaaacaataacaatttaccctctctaactaggatagctgaaatccagaagggttttcaaggtaaaagcaataatcttacatcaaagtctaaccttcttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgttcaaaaagcatttaatatgtgatgcaggtccagctaaagaagaaaaaggaaagaaagaaaaaaccttttaacgatttttaactgtacagcgattaaattatacacaactggcctgataatagagtctattcaaaatttgacctcaatctacctctccagctttatcttccattattatctgctagcctaactggatttcccaaacatgccctatgcttcttggtgccacatcattgtgtgcccttcagcttcatggttaaatgctccgtcccctgtgaagccttactttatctctccaaattaaaagtaatttctcatgatgacattatgagctttcaaatattcttttcatactgcaacattggcatcccgtgtaaatgcttcatatttctacacctgtcttatttacccttttaaattgcaaactccctaaggacagaggaaatgatggtgtggcagaactacccaggtgcgctggttattaagatactgcctctcagcgttgtcatgctggggcaggaatttcaggataagtaaacctaggttcacatacctttctgccacttcctaactgggggaccttttttgtgtaaattacttcaacttttacaacctaatttcctcatttataaaatagggtttgcaaaaattacctcaaagtttgtagtgaggaataaatgaatttatgtaaagtacccagcacaatgtctgatacaaataaccgcagctcgggcgcggtggctcacgcctgtaatcccagaactttgggaggccgaggcgggcagatcacgaggtcgggagatcgagaccatcctgcctaacacggtgaaaccccgtctctactaaaaatacaaaaaattagccgggagcggtggcgggctcctgtagtcccagctactcggaggctgaggcaggagaatggcgtgaacccgggaggcggagcttgcagtgagccgagatcgcgccactgcactccagcctgggcgacagagtaagactccgtctcaaaaacaacaacaacaaaaacaaataaccggcagctgtgactaatctgaggtctcgcagtgtctctcacctctttgtgcagtaaaagctttgaaagagtgaaccaacaagagaacaaagaaggaatagatgacaagaggcggaagtggactaacaatgatacgtttgttgaatgagtgagaaggtaatagataatgctgtgagattatgtggaaaactttttatctgaagtctttaaaagacattctcacttttggctgggcgcgggggctcacacctgtaattccagcactttgggaggctgaggcgggcggatcacttgaggtcaggagttccagaccagcctggacaaactggtgaaacgctgtctctactaaaaatacaaaaattagccaggcgtggtggtgggtgcctgtaatcccagctactcgggaggctaaggcaggataatcgcttgaacccaggaggcagaggttgcagtgggccgagattgtgccactgtactccagccggggtgacagagcgaaactccatctcgaaaaaataaaaaatgtactccagctggggtgacagagagaaactccacctcaaaaaaataaaaaataagggccgggcacggtggctcatgcctgtaatcccagcactttgggaggccgaggcgggcggatcacgaggtcaggaaatgagaccatcctggctaacacggtgaaaccccgtctctactaaaaatacaaaaaattagccgggtgtggtggcgggcacctgtagtcccagctactccggaggctgaggcaggagaacggtgtgaacccaggagtcggagcttgcaatgcgctgagatcgcgccactgcactccagcccgggtgacagagcgagactccatctcaaataagtagataaataaagactttctcaggtttttgttttgtttttgtttttttgacagtcttgctctgtcgcccaggctggagtacagtggcgcaatctcggctcactgcaagctctgcctcctgggttcatgccattctcctgcctcagtctccgagtagctgggactacaggcgcctgccaccacgcccggataatttttttgtattttttgtagagacagggtttcaccgtgttaggcagaatggtctcgatctcctgacctcgtgatccgcccgcctcggcctcccaaagtgttgggattacaggcgtgagccaccgcgcctggctgactttttcagttttaagctaagaatattctctaataggtatattattgacccattgacaatagaagattgaatacactttaggattccagcctcctcttctactgctcatgctctccgtaagaagggctaaacatcctactcctgtgcactacattggagctcagaaatactgacttaaaatctccagatcttaacacggacttttaaagggaagattgagtatggacccagtattagatggtattatggaattatttttaagctttttgggtacaataatagtattgtggttatgtttaaaaacaaagccttctctgtgagagttatattctgatatcttcccaaataaaattatatgatgtcagagagttgctgtaaggggtggaagaggacaagatggagaacgaacagtgcagggagatcactgaaaagaacagcaaaatgttgggaaccgttaaagctgagtgatgggaacatggctccctggtaaatgggacacatacatcgggaggtactattttcgtagtctttgtttatatttgaaaattttcaaacttacataatgagaagtcaaaaggggcattttcatcccaaaaaggtaaatgtccatattcttttttattttttcattttcatttctggaattacctaaactcaggtcatagatagcaatgaaaattcggctccctgtggcagcttctttcagccaccagacttacatagactcagtggtgcagagtccgtttcccaatactgagggataaagaaaattaagcctgcctctaggcacgtctcaaacttgggagactcagaatacaacagagtatgggatacagggaggaaagaagagatgcagaaataaattaaaaacaagatttgtttaaagaggaactgcaacttctttaattgggcagattgaaccaataaaagcacagttctctcccttcacctgttatcctttagtctcttcaactttcacattgcttcactcactctcttcctctccctttcacctgctcaccttacccaacttgaactgtgccctctgatctgacacaggatgacaatgacatcagtcattacctagcagccattttttctgataactagagttctgagtgatgatagttcatggtgagataatttccaagacctcgctagccattggtggtactactctccattaaagacaagggcatttgctgattgagaaatcaatcatacaagtgtccttggaggccaccaaggctttgcctgaactgttctcagcctatgatggtttctctttctaaacctgttcttctaggttcagctcaaacatcctctcctatagaaacctttccccatcctcccagtcagaactaatgatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcgagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccatctcaaataaataaataaataaataaaaaccaaaaaaaaaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaatcagagttgtgttaaggtcagtgagtgaaggaaatgggtactgcacctttgcaagatagtaggaagcaagccagagaagagctggcattccacaaaagagtctttatttgggacaaaaatcaatatgaccaaatcccatcctaatcaattctgtaaactaaaggaatttttaaaaaataatttagcaggaggaagagtttcaaaatcttgtagggaaaccctgatgtaactcctgattattcacccaaagtgaaaagtaactattagtgaatgggttttattttaaaacctttcatttttagaatcttatctcttctaggaaaagtgtagtacatacgaattttttgtatgcagagtgaatttttctccaggcttctctgacatcaatggggcaaggtcataactctataaaacagggagaagcactgagcattttcagaaaggactctatctgtcttgaccaaaagacaaaggactggtcattgcaggatccccagaaatacattttagtagtttccaagtgaattcttttgtaaatggagtttctctccattcataagttttagagcaaaaatgaagccttagtgggtctagatatctggctaacattaactccctgtgtgaccttaaactggtcgtccccaaagctttatgcttttatacaattaacttgatttacagcctctccttcttgcccataagaatgataataccacctgcattactcatcttttacgcttatgtgagacacctagccacctatcagaaggtattcaaatgcaaagcattaagtttttacactttaatgtgaagtggaagaaagtcttgattcaaatgcacaatctctacctttctactgattccacatttgctgtcttttactagtgcagttaagtcccaaattagaaacataagtcgccccaacatgtgacaaatgtcctttgttgccagagaaaggacagtggggctgtgtcctcagccttagcaaccagaagattctgcaagaccaggacattctcctgccagagcctgctttagtgtccagtcctgttctccaaagagatggaaaaaaccaagtggaaaagtttcagtttattcaatataaggctccacattcaaatggcaaaactgctctgttcaggtcatatttcaagcccaacctatgtcagtccttagtaaaagcttcaaagcaataccagtcctttcccagcctggtttaccttgattagacaaacacagacacccatgtctgagtaagcactgagaccatggatgagtgctaaggagattaggtgtttggatagacacagctagggtgtgtgcgtgtgtgtgtgtgtgtgtgtgtgtgtgtgtgtgtagagagagagagacagaggcaaagacagagacagtgctcattgggcagaggacagagtagctgagatagtatcatttgtttattcatttgctttttcataaaatacttagtaagcacctacttggtatgtgccaacactttaataggtactagaaagagcaaaacagacagaatcacagtcttcagagaatttacagcctatggggttaattaaaccaatgattatcatagcatgtaacaaacaaaagagaaccgagaatcagctgtatggaaatgcacacaggtggcagatataaatagcagcagatacacgaatcagtgcgggtccatcatataactcctagctttagtctctaaacttaggctcccactcaactcaactcctactctaactcaagatataccataccttggtttgctctttctctaagcatcgctgttctagtcttctaaggagcaggaatataaatctacatctatgtgaaactacagcacccccaagggaaaataaagaatccagtgctattctagtaattttagggcagtagtacagtacaatgcaaagtataggcttttgaactaaattggcctgggttcaaatatgagccctctcacattctattaggttgaaccatataaaaatggagatattcaatcatttttttacagtttcacgtagttcatctctgtattctagaggtaaatcattttaacctaagtttcatttccttctgttgttagtttttttaatggtgctaatacccctacctttcagggttgtaaatgaaaagatgttaaaaaaaaatacctgacatatagtgggtgttcaataaatgttagttttcccaaagatagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgacaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatagaatcttggtcgtgtcccagaggcctctgttgatgtggcccaactgagctggccagtgagaaaacatacacataaatacccatgatctcagcgattctctcccctccccaggacattccttagcagaaccaatctctctcactcggctggagcctctctgttcacagataggcctggctgggcttaatttagcaaagggcaggccccctgcaaaagccaggggtaagtctggagcccctgtaatgccccaggacaccttgtgtggagacaggagcccagccctgccgaaggagctaaaggggatgttcagaatgtttgtttttctcagctatttaggaactggagctcacaggaaccaccctttacttccttaacttctcacataaatgttttctttgggcagcagctatagaactggaaactaagtaaaaccttactttggaatataaaaactatattaatttttctatagataaattgttgcataggaaacttgctaaatatttttaaattatctgtaacatctaacataatctgacatttatccccaaattcagctttcaattctggattgaaacatactttgatctgttctctaaaaaggacaaagccagtcactggtgttttgcaaagtctgggaccatttttcctacacagaatctcacacaataaacagacaagatattagaaactaagttctaatatctagcagtcactccttccctggaagcctggctgtgtcctgaagccaggtcctatgatcaggcaactcttctgaagctctgcttccactagagacagcacttaccctgtagactctacagatgtaccatccaggatggcaggcatgagccacatgtggctactgaacccttgagatgtgactagtccaaatcgaaatgtgctgtaaggatttcagacttagcacgcacaggagttcaaagactaactacaacaaaagaatgtgacatctcattaataattttaaaatgttgatttcatgttgaaatgataatgttttaaatgtattattaacattaatttcacatatttctttttactttttttaatgtggccatcagaaaaatttaaattacatgtatggcttatatttacgttggacagcactgttctataagatgttaggaaaaagatgtatttgctttaagtactttgcattaagacatagtctgacctgaatcacagttaatcctgtggtctcatagcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccactgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacgaggtcaggagttcgagaccagcttggtcaacatggtgaaaccccgtctctactaaagatacaaaaaaattagccaggtgtggtggtgtgtgcctgtaatcccagctacttgggaggctgaggcaggaggatcgcttgaacccaggaggcagaggttgtagtgagccgagattgcaccactgcactccagcctgggcaacagggacatactctgtctcaaacaaacaaacaaacaaacaaacaaacaaaaaaaccagaagaaagcactggcagtctcttaccgccatatcaatccatctacacatctcgggttacattctctgtctttccacttataaccatagatcaactatccatgctcctatctaaagccaaaccttccacttatgtattaattaagtcctattccccctacctctcaaaggcaacacctagaaggtctcccctgcttctctttatcaatatttcactttctaatggaaaattctgttggcatacgaacatgctattattcatttatctttctagaaatcccctatggacctcatacccttatcaggtatgccccattcctttgctctcctttgaaacaaaactcaaagtaattattcatcctcattgactccaattcttctcctcacattgtttcttaaacccactgcaagcaggcttttgtcttcaccactccaccagaattactttaatcaagatcactaatgacatccatgttgttaaatccaaaggtcaattcttttttgagacagagtcttgctctgttgcccaggctggagtgcagtggtgcaatctcggctcactgcaacctccgcctcccgggttcaagtgattctcttgcctcagcctcctgagtagctgggattacaggcatgcgccaccatgtccagctaatttttgtattttcagtagagaccgggtttcaccatgttggtcaggctggtctcaaactcctgacctcaagtgattggcccaccttggcctcccaaagtgctgggattacaggcgtgagccaccacgtctggcgggccaaaggtcaattcttaatcatcgtattactcaagctctcagcaggatttcaaaaggtggatcctgtcctcttcactacacacattcttcatttggcttccgggactccagactttttctcctacttcactggtttgtaccttctctatcttccttttctgattcttcctcttttctccaaattactaatgttggagctatacaggaccagtctctggtccttttctcttccacctggaaaggtctaactccaactcctttggtcatctcctatggtttcatggctttaaatatttaaatttaatatttaatgatctatttgctgataactcccaaatttatgtctctagccctactctatttcctgaactttagacttacgtattcaactgcttacttaatactgccacataaaatgtctagcaaatagcttacacaccaaatttccaaaactgaacccctactctccaccttcaaatctgctccatccgtagccttccctatctcagttatggcaactccatccttccagttgcttactccaaaaaccctggaattttccttgattcctttatttctctcccattctgtatccaatccattggcaaaatccttttagatttgctaccttcaccacttgttcccacatgcatcactattacctaagtctgatcactatcagcccctacatacattactgcagtgtcttcctaagagtcctcctggtgtctacttttgttctacagcctatttgcaatactgtaaccagatttatcatttcaacaagtcagacaggactggcatttgttagacccctcctctgctcaaaacccttcaataggttcccatgtcactctgagtaaaagctgaagtctttaaaatcatctacagggacttactacacaagccccataccctctggggcctcatcttccagcatgcttaatcttgattatgctgcatcagccacagtggctttcctgatgtttctctgcctggaatattcttcccccagttctctgtttggccaacttcgtcatctccttcaagttgctatttgaaaattattttctatggcatagccactttgaaaaatagttagacagtatctattcagaaaataggcagaaataccgactgggcatccctaatctaaaaattcaaaatccagcatgttccaaaatccaaaactttttgaggaccaacatgatacctcaggtggaaagctccatacctgacctcatgaaaggttgcagcaaaaatgcaggcacaacacccagtttattcagcatccccaagagaaaaacataattaccttcaggctatgtgtacaaggtgtatatgaaacataaataaatttcatgtttagacttgggtcccatccccaagatatctcattatgtatatgcaaatatttcaaaatctgaacacatctgaaaatcttctggttcaagcatttcagataagagatatttaatctatatatacttattatataacctaacagttccactactgggcatttacccaaaagaaataaaacaaagacttgttacatgaatattcatagcagcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttgaaacacgtggcaccagtaggacatatggaaacttttttggtgtgatggaagtatttttttatcttgattgtgtggtgtttgttatacagtggtatacatttgttaaaatttatctaactgcatacttaataaagtttatttaaacaaaacatgaaaggaaaaactaaaatgacatagcaagtggcaatgcaaactgccaagtgcaaagaatgagtaaagagcttggttggcatggagactaccagtctaggatgcttttattgcctcaggtcagcttggaaggccataaatgctgtgaaggtaaacctagaaacaaatcttcctgcactggtaactgtcatgtttatttgcttccctttccatcccatcctttcaaaaaaaaaaagtaaaaggtagtgtggtccacaaactaccgtgtggctccccatgatccccgcctcttggtgtttgtgcccttgtgtaactccttctctttgggtatgagcaggccctgcgacttatttctaaccaatagaatatggcaaaggtgaaggaatgtcactcctgtgattatattaaatttcaaggctctcttgcttgcagatttgctctagagcctctccttgctgacttgaagtggccatatggggaaagctcacatggcaaggaacactaggtgacttcaaggaaccctggacagcctctagccaacctctggcaagaagtcaaggccctcagtcctactgctacaaagaaatggattctgttgacagcccaagtgagctctgagtcagattcctcagtcaagcctctagaggagaatgcagcctggccaataccttggctgtagcctagggagaccctaagcagacaacccagctaagcggtgcctggattcctgacccacacacactgtgagataataaatgtgttggggggtgaaggagggatgggggtaggggtggctgtgcatttgggtatggaagggtgttttaaatcgctttctaaacacggcctctcctggccactccttaatactgcaacctgctctccactcctgtaattttttttcaacatttgttttaggttcagggggtacatgtgcaggtttgttacatgggtaacttgcatgttgcggaggtttggtgtatgaatgaacccatcacgcaggtagtaagtatagtacccaatagttagcttttcaaccctcgccccccttctaccttccactggggtaggccccagtgcttattgttcccatctttgtgtccatgtctcaaagttttgctctcacttataagtgagaacatgcagtatttggttttctgtgcctgtgttaattagcttaggataatggcctccagctgcatctcttttgctgcagaagacatgatttcattcttttaatggatgcatagtattccgtgctttatatgtaccgtatttttcctccccagtctactgttgatgtgtatctaggttgattccatgcctttgctattgtggatagtgctgcagtgaacatgtaagtgcatgtgtctttttggtagaacaatttattttcctttgggtatatatccagtaatgggattgctgggtcaaatggtagttctcttttaaattctttgagaaatcaccaaactgctttccgcagtgactgaactaatttacattctcaccaacagcgtataagcacttttctctacaaccttgccaacaccttattttttgtttttcacagtaggcattctgactggtgtgcaatggtgtctcattgtggttttgacttgcatttctctaatgatcagtgatattgagcatgagaattttttcaaatatttgttggccccatgtatgtcttccgttcatgtcctttgcccattttttagttgggacaaggtctcgatctgttgcccaggagtgcagtctgatcactggagttcagtgatgcaaacacagctcactgcagccttgacctcctaggctctagcaatccttccaccactgcctcccaaagtgctggagtttcagatttgagccaccacacctttgctcatttttgaagtggggcaagacccccacttcgtaggactattacttgattgagattaaatatgtgtaaaatgcataacatggtgcctggcttatagtaaacactaaatggatttcttcttccataggatttaaatagggagcaattttttttctatcaagagctgatcagaaataaatgggaagcatttaaatgctctccttcccctgtcccaagaggactttcactttccaacattctacatactttatttataatatttattgtttattttctgtctactcatgacagactataagttctatgaggatgggaatgcctgtatgtgcttattatatgacctaacagttccactactgggtatttacccgaaagaaataaaacaaagacttatacatgaatatattgatatatactccagtcacctccaatagaatctagaacacagtaggggcttagtacatatttttaaatgaatgaagactaatgtttagtttaaactaggattgacctattcttatcttcggcagagacagagaataactaattaccacttgtcacatattgagacttcagtacctaaaaggcattattaggtcacctgtaagtctgttttcccccaaagtaaaaatcccaattccattgcccttttcacataagcctcattttctaacctttttagtttggtttaacgaatttcctatttcctctgaattctggagttccaaaccagactcagcacaagcctaacagggcaacctatacagataaggacagcccaggcacattgcacacggcaagttgcacctgttttaagagtaaaaatgaggtcaatgccaccttgtactgcaggtacctcaatgagacaatgccaccccttcctgccacaatcttggcaaaagtcactacgaaagtaaatatcattttactagagtcctttctttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaaaatgcataacatggtgcctggcacacagtaaacacaaaacagatttcttcctctatagcatttaaatgggaagtatttagcgtttacttgccatgtgcatgagtgaatttgggaaaagtggggggaggatatggggcaaagaaggacagaaagggcctaagagtaggaagaatttaataccagaagatgggacaagacctgggtctagaaacctcttctgcagataaagtagctgcaaattatagggaaggagtcctcaggctgctttccttataaccatttattttcctgcaccttatatcaagaacgttaggcactggttaagaccctgtccccttgcagcagtagagaaaacaggaggaaggagacgggaggtagaaatttggaagctagcagttgaaggccaactcagaaagcgtcaggtggaattccattcctaattgacatcaccatcctctaactgcagcaattctctccagcccttttatgtgctccctacagaaccaagcttccacacagctgaaggaacctgtctgctctcaccccagcttcacagaagatggcagggactggttattactaacctgcctcctagtcttctgaggctccaaatggttttgtcagcaagctgagcttccccacaatcccacagactagaaggggttggaaagaacaagccttagaacaatactgctccccacctctaagggatctgctcctctgagtcccagaagttcaccgccttcatttgatttctgctacaggaagactctgggaatccagctctggacccagcacttcctgatttttgaagtagagagttgacaaccctgttgtcatcaatacaactgtgctaggtgggtgggaaaggaaaatatcttgggctcccaaaatcactaagctaaaaggaaaactcaggatcatggtggatggaagtcaggactagattgcagctccgactcggatggacagagaagcatgtggaggctcatatcatgaatttttgctccagaacgactggaggaataaattacaaaacctgagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagctcgaacacaaagtcttcaatttgacccaatccaaccaagacaaagaaaaacaaataagaaaatatgaacaaagcctccaaaaactctgggattatgttaaatgaccaaacctaagaataattggcattgctgaggaagaagagaaatctaaaagtttgaaaaacatatttgggggaataattgaggaaaatttccccaaccttgctagagacctaaacaaatacaagaagcacaaagaacacctgggaaatttattgcaaagagatcgtcacctaggcacattgtcatcaggttatctaaagttaagacaaaagaaagaatcttaagagctgtgagacaaaagaacccagtaacctatgaaggaaaacctgtcagattaacagcagatttctcagcaggaatcctacaagccagaagggattgggcccctatcttcagcatcctaaaacaaaacaattattagccgagaattttgtatccagtgaaactaagcttcatatacgaagagaagatacagtatttttcagacaaacaaatgctgagagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacagaattgcagaatggataagaattaaccgaccaactatctgctgcctttaagagactcacctaacacataagagacttatctgacacataaggactcacataaacttaaggtaaaggggtggaaaaaagacatttcatgcaaatggacaccaaaagcaaaagcaagcagaagtaactattgtttttttgttttttttggtttttttgagatggagtttcactcttgtagtccaggctggagtgcaatggcgcgatcttggcacactgcaacctccgcctcccaggttcaagcaattctcctgtgtcagcttcccaagtagctggaactacaggtgtgcaccaccatgcccagctaatttttgtatttttagtacagataggtttagtacaggcaggggtgatccgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaggccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaacacatatatacagaacattccatccaacaactgcagaatatacattctattcaacagtgcatggaactttctccaagatagaccacatggtaggccacaaaacaagccgcaataaatttaagaaaattgaaattttatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaagggaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccgggcgtggtggctcacgtctgtaatcccagcactttgggaggccaaggtgggcggatcacaaggtcaggagatcaagaccattctggctaacatggtgaagccccgtctctactaaaaatacaaaaaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttataggtgggaattgaacaatgagaacacatggacacaggaaggggaacatcacactctagggactgttgtggggtggggggaggggggagggatagcattaggagatatacctaatgctaaatgacgagataatgggtgcagcacaccagcatggcacatgtatacatatgtagctaacctgcacgttgtgcacatgtaccctaaaacttaaagtataataataataaaataaaataaataaaaaataaaaaataaaaataaaaatacaaaaaattagccggacgccatggtgggcacctgtagtcccagctactcgggaggctgaggcaggagaatggcatgaacccgggaggcggagcttgtagtgagccgagatcgcaccactgcactccagcctaggcgacagagcaagactccatctcaaaaaaaaaaaaaaaaaaaaacctagaagagatggataaattcctggaaagatacaaccctcctagcttaaatcaggaagaattagatactctgaacagaccaataacaagcaacaagattgaaatgctaatttaaacattaccaacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccatgatcaagtgggtttcataccagggatgcagggaggtttaacatacgcaagtcaataaatgtggtacaccacataaacaaaattaaaaacaaaaatcaccatgatcatctcaatagatgcagaaaaagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacacgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcacgaccaagaacccaaaagcaaatgcaataaaaacaaagacaaacagctgggacttaattaaactaaagagcttttgcacggcaaaaggaacagtcagcagagtaaacagacaacccacagagtgggagaaaatcttcacagtctgtacatctgacaaaggactaacatccagaatctacaacaaactcaaacaaatcagcaagaaaaaaacaaacaatcccatcataaagtgggctaaggatatgaatagacagttctcaaaagaagatatacaaatggccaacaaacatatgaaaaaaggctcaacatcgctaataatcagggaaatgcaaatcaaaaccacaatgtgataccaccttactcctgcaagaatggccataatcaaaaaaataaaaaaatagtagatatggatgtggatgcagtgaacagggaacacttctacactgcttgtgggaatgtaaactagtacagccactatggaaaacaatgtggagattccttaaaaaactaaaagtagaactaccatttgatccagcaatcccactacagggtatctacctagaggaaaagaagtcattatacaaaaaagatacttgaacacgcatacgtatagcagcacagttcacaactgcaaaaacgtggaaccaacccaagtgcccaccaatcaatgagtggataaagaaactgtggtgtgtatatacacacatatatatatatatatgatggatatatatatatatatatatgatagaatactactcagccaataaaaggaataaattaacgcattcacaatgatctggatgagattggagactatcattctaagtgaagtaaggcaggaaaggaaaaccaaacattgtatgttctcactcataagtgggagctaagctataaggatacaaaggcataagaatgacacagtggactttggggactcaaggggaaagggggggaagtgggtgagggataaaagatcacaaatagggtgcagtatatactgcttgggtgatgggtgcaccaaaatctcacaaatcaccactaaagaaattactcatgtaaccaaacaccatctattccccaataacctatggaaatgaaaatacaaaaaataaaaggaaaactcaagctggaaactgtttagggcaaacctgcctcccattctattcaaagttatctctctgctcactgagataaatgcatatctgattgcctcctttggaaaggctaattagaaactcaaaagaatgcaaccttttgtctctcttctgtgacctagaagccgcctcccccactgcaagttttcctgcctttgcttcaagttgtcccgcctttccagacctaaccaatgtacttcttacatacattgattgatgtctcatgtctccctagaatgtacaaaaccaagctgtgccccaaacaccttggtcacatgtcataaagacttcctgaggctatgccaggggcacgtgtcctcaaccttggcaaaataaactttctaaatttactgagacctgtctcaaattttcggagttcacagtgggcaagactagatttacttttgtgttgagcagatactgagcttgactgatgagaatctggagtgtgaggtctgacggagtaactctgagagaggaagctacctgtgtggtctcagggagaagatctgagacttaccaagaaaaagtgacctgaaagaactggctgacttcaggcccttgaccagtgcctagaccctctttctgcagctccagatcatagccatcatgctggcagcctccctgccgctcatccaggcaccttaaagaagggcttcctcttcccaagcctctgggtgggctttctaaagccctgtgtgcatgaagaggtggcttgtagccctttgcagcagcagggcttacatgaggctgggatatgaaaagctggcattacaatgcagcttgtgccttgcattcactccccacttcatcaagccaagtttctaaataacagggatagtaactgcccactgtggcccaatgtcacttctaaagttgcttggcaaaaagccacatgactattacttagctctccacagaacggcatgtaccaagtcggatcactgctgtcggtgtgtgggtggattagctgctattgaacatgatagggcgggcccctttccagtttgcaccagccccgctctgtgcctactccatgtatcatagagcctcctctctctgtgcagttgaacttgatcagatgagatggcaaaagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtgaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttaggcaaattactattctgagctttagtcatcttatctttaaaatgaagggtttattctttagaggaagctgagtgaatggcatacgggaacactctgtactatttttataactttgctataagtctaaaattatttttaaataaatggttttcttaaaaagtgaaaggattatgtagattatcttcaagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcctacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacaggacttcagaactgggagggatgtgtgcgtcaatcctggtccagcccactcatttaaacacaaagaaccagaagcccagaaaaagtgacttgccttagcctggccttcctcttgattcctttccctcaattctcccgtcctgatcaatcatcaagtcctacaaatattttacctcttaaatattttaaagatgagttgcctcccctctattcctactgccacagccctcattcgggccttcatcttctttggcttggcaagtctgttctcactcacttcctgccttgactctcttgaatccacctttcccatgcatcagagggatctagcaggttccctgcagcttaaagcccatcagtggtgccttgtcttcttcaggataaagtctacactctttaaaatggcacaaaagactgtgtccgtcatatcagtctcattcttcgcctagtacttaaatccaccaacaccaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagttgccttacactttgtacacagctctgttactgccttttactatactctagcacctgtggtttactcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatactgaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaggagattgagaccagcctggctaacgtggtgaaaacccgtctctactaaaaatatgaaaaattagcgtatgtttcacagcatctgtaatcccagctactcaggaggctggggcaggagaatcgcttgaacctgggaggtggagattgcagcaagccaagatggcgccactgcactccagcctgggccacaaagtgagactccatctcaaaaaaaaaaaaaaaagaagaaaaaagaaatgccttttcccatttcttgttatgttactaccttttaggattcaatgcaaacttcaaacacttggcaaggcctttcctggtggattttattgcactatagcaaaatctgtccatacctctatggtagcccttattataccatttttatttatttgttgatgtcttctccaccagaatctagcacagtagctggcatatagtagataatcaatagacgtttgactgaatataccaatgcatatgcgcaaatatgagcaaaaaaatgactaaaatgatattgcaaacaagggaaacatttgagacagaaatttagaatgtctatttttttcaagtgtaacatgctacttctatcagtgcataaacctgaatgtacatacactatagaaagaagtggccttgtaataagttcatgcagaagtataaattatgtagacattgttagggggataactgaaagtggattagaattaaattagggcccagaatttagtctgggatttgttttccagtggttgaaagaaaaattcctaagtattcaaagggaagaagcatttctcaacaggcaagtattatgaattctaattaaaagctctgaaaaaatgagataagttgtgttaaggaaaagcagaaaacagagttgcctttggttaagagttccactatttttataagcaactgacttttttggggaaagttgctttaagcatttttttttctgtgtgtatgtgtgagatggggtctcactctgtcacccaggctagaatgcaggagcacaatcatggctcactgcagcctcaaccttctgggctcaagcaatcctcccacctcagcctcccaagtagctggtaccacagccacacaccactatgtcagctaattaaaaaaaaaaaaatttacagagatgcagtcttgctatgtttcccaggctggtctcaaactcctgggctcaagtgatcctcccaccttggccttgcgaagtgctgggattactgacatgcgccaacatgccaggcctaaacattttgtgtgtgtgtgttaaaatatacatataataaaatttgccattttaactattttaaagtatatagttctatggcattaagtacattcacatagttgttcaaatatcactatccatctccagaactttttcccaaatgaaactgtagccactaactccccattccctcctccccacaacccctggcaaccatagttccactttctgtcttcattatttgactactctaggtacttcatttaagtgaaataataaatatttgtcctttagggactgactttacttagcatgacatctttaaggttcactcatgttacagcacatgtcagagtttcatacctttctaaggctaaataatatccagtgtctatatagcccacattttgtttatccactcatttgtcaatgaacacttgagttgcttccacctgttggctactgtaaacaatgctcctatgaacacagaaatacaaatatctatttgagttcctgttttcatttattttgtgttatacccagagtagaattgctggattatacggtaagtctatgtttaattttttgagaaactccatactggttttcacagcacctgcaccatttcacattctttctagcaatgtgcaagggttccaatttctccacatctttactagtatttgttattttctgggttgtttgatttttagtataatagccatcctaatgagtgtgaagtttgaaaaaatatttaaccaaaatcataaatattggttacaaatatttaatggatggattccctctatttctgccaactttcattccctgaaagaagaaataggtaagcatgacctcacgaacctcagaaggctgagaatggggaattggcacacacagtgtgcgtagacacagacacacatggaccatgttcatactaggcttccagagaaccatttaaaaatagtttggctaatgtaatcttgtctgtctcttatgttcctcctttcccatcatacacatttcttaaagttcgtgtaagtaaaacataggagaaaaaaacatagccactaattaaataaggcatccaagtgtaaaagaagagcaaactctgctacatataagaagacaagcattaattctggcaacagcagccacacagccactttagacaataacctgagcaggtgcatgctttctagtatgtgtctccagctatgcaggatagaaatcacaatcctttctatttatctaacgtctaatacactaaaacatgtttacccatgggggagaagagcacgacaggaattgatgactctaatttaggaaactaaggttcacagaagttaagtgacttggccaagatcatgtagctagaaaaggcaggttaagaattcaggtttccttagagttcaaaacttttatcacaacatttttgataaccccccaagatactcatccttctctaatagccttcctttggttcaagtccagcttcctaaatcctaccgcctgatggagttcctgagcttccttgtaagtctgcaggtatattgttcctcatcatgttgcccaaagcctaaagaaatcaggctaggaccaaagaaaatcagtcaatgagccaaaaagaaatttaatcaacccagcctttcttatttattttctttgaatgaacatttgtatctgagaatgccaaggtaaatttgatgcaatagggacacttggattatattatgttatttacacacaagcaaacaaaaattgagaattgagacaaataggacaaatggtcccaagtccactattgaggaaaaagaaactgatttggaataaaaaatagtccagcatgaatgtgtcagtaattaagacttatctggataagtttgccgtctctcaatttgtcacaataatggcaaatatttattgagagcttactatgtgataggcattatgctgagttcagctaattgactcatttcatcctcctctagaccctataagataggtgttattactgcccttgctttagctcagagaaattatggtatttttcccaacacaaatagtaagtagaaaaatcaagatttcaccccaggtctcgccaatttatagctcttagccgttatgcccagcaataacagaatagtaaaaacaaggacaatttggtaggcaagtaaaatcagtaggctgtttaccatagctatagaagtatgctatgcataaacctcaaagattgcgcaggaaaagtatcatccaatctcaaagatgagaaaaccaaagaagtttcaatctcagagaagtcaggcagcttaagggtcataaaacaacgcaacacaactctctcaactcatatctaagggctaagtccactttaaccttccaatatcattacatcatatttaaacattgactctatctggtcaaggacgacaacattttatttctcctgacccttttgctatcagatctggccttgtcagtttttcaatttcattcttagaatggaaacttaattcacacaagttgaacaagtagtcatcagggggcaaaacccagtggatgatggttttgtgtgctgtttggagactgggtgtttaccacacagcagtggatttcataaattccagggtcagacaagattccagtagcgacacacttgactaatatgagaaaatgcaggattaggcaatcaacaatgaggaagtcagccaagttgccacccaaaaattacttaccacagcagctgcagtccagaaatgctaacaagccagtctccctaggagtgggccatactcagctgtggaccactcacaacattttctcactttattttgcttcagagtcagtgtactgcaatgatttctcctttgcttgctttatatgtttaaaattgtcttccctaaaagctgaacttaaaattaatgtttgctaccaaaagggggtagcagtgcctagtcatgtaggcatatgtcccactctgtcggtacagagggtaagcagcctcttcctttttaaaaaatttattacgatgatttacaaaaattgaagcttacaggataaacactcaacaaaaaagtagccagtctcaagaaaccaatttttatgtatgaattaatattattttattaatccatggccaggatgattcttaagattatttcttaattctctgaacagcttaaaagagagaaactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaaagagaaagatagcacccactctccagttctcttctcccaaagttgcccgtatttcccttccctgaagccaatcaaatactttattgtttctcgctaagagtaatttttcactcttaagtacaaacagctcaacaaaaattcccggtagcataaatatgcacatcaataaaataattactactcacaatagactttccattacatatgtttcacaagcattggttttcttaaaaagaaccacgcatacagcactcaaattattgcagattctaactcagtagagtttgatttaatgtttttacaatattttttttaaagaagtgtccttccaacgctaaggaaaaaaatcagaatcaagaaaattctgtttcttagcaacagaaaaatcaaacttctgttactaagtttggtaacagaacagtactctaaattatcctctgaaccacctgatttaccatgtgatgctgggcacattgctgctaattaatcttcctaatctcgtgggatcacaatatgaataacaagaatgaacatcagacacatctgtgggaattatgagggggagattataaagagtcaaaccttgtccccatatttaaattttataataactataactactagtagaaatataactactaccctctcatatatatgtgatgttattaagtttataaagtgttttgatatgtttcttatttcatcttcatggctgctatttattcatagaaaaataattctcagtatctgtagcattattgttaatgtcaatcctatagaggctggaacaggctcagagaggctaagtaacttgcctaactaagtctcctggttgacaataggtcttaatgcagtgttttccgaatccctcgttcttacatcaaaacagaactgtggctgggtgtggtggctcatgcctgtaatcccagcaatttaggaggccaaggtgggaagatcacttgagcccaggaatttgagaccagcctgggcaacatagtgagtgagacctcaatctctgccaaaaaaaaaaaaaaaaaaatacatacacacacacacacacacacacacacacacacagacacacacatatatatataaataattagccaggtgtggtggcacacctgtggtcccagctacttgggaggctggggtgggaggatcatttgagcccaggaggtcaaggctgcagtgagtcgtgacggtgccactgcactctagcctgggtgacagagcgagaccctgtctcaaaaaataaaataaaccagaacggctctagttcctatcaatcactcatcatgacatagtgtggtaaactaatttcaactctgaatgattgataatggctttatgtgttctgtttcccaagtaataagaacattttagcacaagcctttagcgcttttcaaataatcatagccaaatgagaaaattaatatgacaggcagattgaacaaacatttggtgagaaggaagaggaggggatacagtagtttgagatccctcaaatcatatgatgcagtagctgcctgacaactctgctaacacgtaagactagatagagacagggccatatctacttcctgtatgggacccatggcaatactagagtctagcaaaagggttgtcctctctgcatgtgacaataggctgtgttccactccccccacatacaccttgtgcagctcctataatctcatttatcacacttctccaggtgagaaatggtgccttctcacaccccacccaaagttgtttcctaaagatctttcgctagggcggagcagagagtgagatcaaatgattcagacagccatctgattcagctttaaaaaaaaaaaatcctggtgggggcgcagtggctcacgcctgtaatcccagtactttgggaggctgaggcgggtggatcgcctgaggtcaggagtttgagaccagcctggccaacatggtaaaaccccgcctctattaaaaatacaaaaattagccaggtgtggtagcaggcgtctgtagtcccagctactccggagaatcgcttgaacccaggaggcggaggttgcagtgagctgagatcgtgccactgcactctagcctgggcgacagagtgagactctgtctcagaacaacaacaacaacaacaaaatcctttccctcaaattacctaagaaattgtcctttccttctttgccctgaagacagttaatggggaaagttcctccctctgcacagtgaataaatccatccactattcctaccctaaccctaaggcaaaacctcccactcatcctctgtctctcgccatctctctgttaccaaccctcacttggcaatatccttcttgacacgtggcagctccaatgaggcacactcattacatagccacgtaaaagataaaaggtgaatctggaccaacttctggaaaatttggacttaaaacatggaaatgcaggagagacaggaaatagagttaaatcccccagatttagctatacacattaattgaattaactaaataatcatttgggtctcatagacaccagctatttccctgatccaagatgttatctagcagcctgtatcgcttcccagtcatccatcctcttgacaggacagagcacacatagaaaatggtatttgtatagtcctctggggtaaacagttggagagttagaatctctgataaggtcagaggcaaccagtccccggtcacttgggccacttcaggtcctgcttgtccagacacagagagggctgaggaaaccaatattgtggtgaccagctacgaggcttaatcctcataacccatagcccaatgtcctcttatcaaggtgctgtcctatctcacccacagctcagccaatccagtaggtcttccttccccaccctgatcactgacccatcaatcaagatagccctcccatccaaggaagaggccatttcccctcccactccacccaggccaactgctatcccacaggttactctcttcttcattttaaggcaagctattccaaagactaaaaatgcctaagattctgtcttaaaagcttatctgcatagtcatcttcaaaagcaaacatgaatttctcaaggaacggaaacacccttagcccctgcccttttctccatagcatcattctctgccccaccaagccggaactaggagggcactttctctaggagaggtatgacctggagatgatctgcttcagagccacctcagggatcttgcttaaaaatgcatattttcccaggcaaagtggctcatgcctataataccaacaacagtggaggctgaggtgggaggatctaaaggccaggagtttgagaccagcctggacaacatagtgccacccctttggtacgaattttttttttttttttttttgagacagactcttgctctgtcacctaggctggagtgtagcggcgcaatcccgtctcaccgcaacctccgcctcctgggttcaagcaattctcctgcctcagcctcccaagtagcttggactacaggcatatgccaccacacccgctaatttttgtactttttaagtagagatggagtttcaccatgttggccaggctggtctcgaactcctgacctcaagccttctgtcttccttggcttcccaaagtgctgggattacaggcatgagccactgtgccctgccaatttttttttttttaattatctgggcctggtgtcctgtgcctgtggtcccagctgctcaggaggctgagccagaaggcatcacttgagcccaagagttggtggctgcagtgctatgatggtgacactgcactccagcctgagcaacagggcaagaactgtttctaaaataaataaattttaaaaatgcaaatatccaccccagccccaccctctccccccaccttcccccacattactacatcggaatccctagggtgaggcatggaatctacattttaaaccagctcccaaggtgattgttccgcacagttccacgtcagtgtttgagagaggctctgatttattccagtcctctttctttacagagaaggaaagcagaaagcaggcaccagagaggtgaaatgagcttgtccaaggtcacaggttgttaaggtgaccagagctggacgaaaccccacctctctcgctgactagcacagcgccagctaggaagagcctagaatagcgaccaactggcaggccaaaccgtcccctgcccctgcccctgcctcggagaagcgggcccctgcactcacccgcttgtagatgtcctcccggctggcctcatacttctgttgcatgcgctcctccaggaagtagatgcgcagcttgaggctgaagttctccttcttcaggtcattgaggtgctgggacagagtgcgatatccattagacatgatgggcaacccatggggaggagcgtgcccgattgccccctcaacccaggaacatggtgcagctgcaccgcagcatgaagccagccggctgggacgctgctgaggctgcggaccgagaggctggggctacggcgacatggcccctattgctggagctctctccgggactcgggactgggctcactgctctgggtgctggagcgcagcacactttccttttttacctcagggagatatttgcggaatccctgacagaggaacatgctgcgtgaactcagacacaagtggtgtaacccgactccaagccaggactctgctgtcaccctcctggagcctcccaggcccaactgt

SEQ ID NO: 1122 - DNA, 188569 bp, Homo sapiens
cagtgaaagaaaaactatttatttctttatacacatcttgctttaacaatcaccaaaaagactttcattttctgtcacccaccctgtccaccagttatgttggccttcaatatatggcgttagcaacatatataaatctatatcatatatttatacacacaaacacattctaccagcactgtgaagacacagactaggctttactaggcttggggcctctcccatgccacttaaaaatgagcacaggtttgctctatgcaagaatttcaacagagttggtctggccatcagtctgcaatttccccgagataagatagggtgacaaaatgggacagcaactttgaagtgaggtcagtccaatttggatatcatagaagaaaagaaataggatgtgctaggttaagcctgagatggtatctgggaagtcaccacattcatgatgtgaactcaaagaacacaggtgctacagtgcagaccaaggcccagcctgactcgacccaacagggtcaggtgtggatctgtgagtagtgctcactgagcccccgccagcagtgtccggcagggcaccgctgctcagtagtgtgcttttagaacctgccagaggagctccagcattgggaccacgtgcccctttcatcggaatcagggtcctatattcactgagttttccatctcaggacagctgatgaggcaagaaatgtgctcttgctagttcccaagctgctggggctgttgagaggcaggatcacaaaaccttctgtgcaaactacgcatctttttcttagtgctgggccaagtggaccttggctaatcgtattccatagccgtcagaaaggctttctgcctttctcccagctccaccaggatacatctctgactccctcttctggaccctcccgtggacttggaggaatgaggcccagatgctcctcagcagataggtagctgcacaaaagggggacaggcccacctttcctgctgttttaaggacttctggtggctgcgcttcttgcatggttcctggaaggcaagggtcacaaggctggagtacatggcagagcccttagggatttcacctgcagacaaacataaaacaaaccaaatcagtgtatattgccaggccctactgatggctacctgaagctggagtgagagctacgtggtgaccaaagccaggagcacggtgagagccagttaagaggatgagctaagagcatgcgctgcagtctggaggagcaacaggtgcccgaggttagggggagcctccccacctccctgtgtgctgagatccctgctccaattcactgcacactgggtggctggatcctaccactcccccttcaggggccaggtgactctccaaatcactttgtctcagcagaaagaggcctttgccatctccacccaagaaagaagtgcttagcatgaaacatgcacatatagaaacagcctgtttgtaggaagaagaggacattttgctgggaagccctctgttaagtttatgtccagttgccataatgagggtgtggaggggccaagtccacagggacctcagagctcaactaagtccagttccatctttgacagatgagggtgcagcagtctcacagagactaagggacaagccaaagccacacagcagttagtgataagccagggattagaaccgaggcctcgggtcctttccagtgatctatgggaggtggaggggaaagcttccacactggagaaagccagtggatactagagatttttgggttaccttttagtggatactagagactttttggattaccttttctgggacaggaataaggctttacagaggcaatcctgtaagtgctgctctaaagaggctcaggaaagagaagaattatcagagaaaaacaaaagggaattagtgaaaaaataaaaaaaagagcaagttaaactggcccaagtcattttcacactatggagatcaacattctctcaggttatggattagaaacatttctaggaatatgctgaattgcttatggcaaagctttgatgtccatgttaaaaggtttagtttctgatttttaaccatttcatatacctcaagtttttcttcaaagcacttcctagggaatgattaacacttagtgttttaagtaaatgtagataatgtctggtacatatataacattttttccctgaaggttcagttgttatttattaacaaattcgcttttagaccaatgagacccaacagatctcttttgtcatgttacttaaagatatagcaaaatcaaattgctgttcttaacccgggaatgtgcagtgaaatcagtttattaggttgcaaattgcttttactttttcatgaagagtagaacacataactggcctcaagatccctctactagaagctcattcagaggcagactcccgaatgtctaatgacttcaagagtcagctgaattgcatttctccagtctctgaacttggcctcaaagaagaaaaattggagtaaaaaggagagatgatgacaatgtgagagtgaaccaagatacaggggcaggagctgacggggtgggagggtgatggggacagaaactagcaggatgctcactgaggacctgtgatcttgcaagtggaccccaagtcttctcctggaaggccaaagcaggccaagggtcacctacaagatctgctaacggatggtgatgggtgggggacaggcttggtgcctctgactggtgcagtagtttccttacctctaagttagtccttgccttctttaaaacatcatgtgttctggttactgaaacaacaaaagagcaccacagagtagaaaccaccagcagaaattaaccctacttgcttagcatgagaattctaaagcatttatttctttctggctattcagcttggagtctccttctatccaccccctgtcctccactccctctgcagccacaattgctcctggtacaggaggtttggggatatcaaatcagtctcaactcccaacatccccaagcccccctgatcacttctcatctgaagcacaagtggggcatcgggaagactgcctgtttcttcccccattccctctcagggaacctacgctggctgacaatgaactgttccatgctctccttctgctggttggcgttcttcagatgctcagttgtgctctgaaggagtcgctcctgtttggatactttggttctcagttccagaagttccctttctgttgattctccctggataagaggaacagactcttactgaccaggcagaaggcctaaagcaccctgtgctttgtggctctttccaattcaaagaaggattctacagtcttctcaactctcttgaactggatttcctccttcacagcctcggatacctccagctgaggacagttcaggatgaggccattaggcaggaataatgagactctggaattccccatgcagactagcacaggcctacacacctgtagcttaagagaacctcgcctcaggctggtatcaaactcccaactctgaagaggaccttgctttagtcctgatatcagttctgtcactctcccttcacaggtaagattgagagttcagaagtgttatgctggggtgagagatctggactcagggaagtctgcaagtttgtaaatatttgtgccaacatgaagatggcaaaacaccctctccctggaattagcatagttggatccaaaaggtattggtgccattgacctggaagtagaatccctggggaggggatcctgaaacctgcctacatgagggtctgccaatcagagttagcctgagctctgagcagatcctgaggggtggctgactttccccaggcctggtccagcgatgccagcttaagttgtatgttgggattccaggcagtggctaaaaaggctcagtctcatggggcattctgtgatcatttaaccatgggacctgaggggtgggagatgggtgctgaagctttaactgaatttcagctcagtcaaacttcagagaagtaaataaactgaacatttatggatggccagggttatgatgtctccgccttcttcacaccccttcatcttctttgatttcttaaccaggggacagggggctggtggggaatgggatatattcagagctgtaatgaaagcagccaccatgggtcagagatgtccctccagggacactcctctaagttcctgtctatcccaactcactatgtggctcctgattttctggaaaagctgtgacattgaggagacagaacagtattggagggcaggagaactgggtttgaaccaagaaagggcactggcatcttaccactttgccaggcagcacagggatgtgggtgcttggcagggccgctctccagaacatggtgaggagggaagctgactcctctagggcatggtgcagggcactggtgctgctccgaagctcatgaatacctttgctgcctagcacctggggaaaggtaacaccacaggagcggagagattactttcttccccctgcatgggctcaagcttcctttgtgagtgaggcatagaacatgggcctgcttgaacctgtgaagccctcacacaaccatttgcagctctcagaactaaggtgctgctccctttaccaggaatgccttcctccacctgcagaacccacaaggctttcaaaactcaccccccttgctatgtcctctatgagcctgttaccttccttgcctgagataaatgaccacatttgtattggcgctctcacagcacagaggatgacttctcatactgtgcctgtagccccttactgtgcttatctacttgggtgtgtgtcttgccctctagtgtgggggctccgtggaggcagggctgtccctacgcatccatgggtctccagcagctcagacagcacagccacaggttcctggtctctctcactggcaaggtgctctcagaagctttgctgactgccttccctccctctatgcagtctgcacaaggaaatgacatggctgccaggcttctcaccccttccacatgtgggggccatacacctgcaaatccttcagtttctatccatcccattgagttgactctgcccacagatggtcatgtgcctgcatgactatggtagataataagctaccaaaggctgctaggcaatgccacatgtttctgtggggctgaggggaaatatccagtcagctacatctggaacagagcagaactcacagtgaaaataggagatagagaagaaagggcctggctgctatacatggaagaggaagtctcagctgttgagagatgcaaagcatgaaaaaaacaaaaatggtgggagaaggagttaacatcaaaggaagaaagggcacagggaaagagtgcacctaaagcttcaggtgtgattacctctgtgccttgggcttcaaggccagggaagctgcacgctgatctcacaagagacactatctttttgaccagcagcttgccctccgcaatctgctgtcttagggcactgtagtcatcaatgtggccaatgacatggcggccatgcttattggcaaaggagccatcagtagcatcaccctctagcttgggaggggtcttcattactggagaagtatccaaacccaagcctgaaaaagaaaatgacaacacaacagaatcttctgttattcataatgatatcctcagtttgctccaactaaaaaagaggtagggaacaagaaaaggacgaggccgggaacaagaaaggaagcctgggaatgtacaagggtggggcaaagtccatagagatcttctggcttctatatttttataatctttcttacattatctcttaatgataaatttgccaggagacaattttttccttattggcaaatgaaataggatgaatcataataaataataagtttctgagtagagaagacacagacaaggaagtcaagctggatacagacagcattttcaagaatagagagattatggtgcaatgaagcaaaaacagcagtaggaaaactacaggaggatgaacaatggcaagaaaggcagccacagaaggtgcagggagtagggctaaaggccttggggcatgcagagaaaactctctaaatacagataatatgtttagagacaacaaaaggttgtttgcattaatcactttccatcatcagtccctgggccctttagttgccatatttaccatttgctctgttgattatgggcgtttctgagccaggagtagaggaagcagagctggggaagaccagagctggggaattcataccaacatcccggactggaggggacacagctgaatctagggggtaaaggcaaccacagttttcaggagccctggaacacactgcacatgaagcacatgcacacctagctgtccccactgagacctaaggtggcaggactctcctcttacagaattatccataccccacaagccaaagcaaaatcaaaagcctatgagtcactgagttcagaatgtttccattcttcagaacaaaaagatattcctgtaattgaggggtgttccatgagaacgtaacttctagtttgaaaaattattaggtgtatttttataaaccgagtcttaagtataatttgtgtgtggtatctaatatgatgccctgtaactaaatgtaatatgtataaatatacatagtacatattaaaatctagaatcaaagaatcaaggaatgaatggattcatgggggactcaacattctagtcatcattctgatgaggtaatactgaaaaaaattgacttgtatgagaagaacggagacagaaggcttggtgggttaacattgtcttgctggagactaaaaagcaaccctatggtggaggaattggaaaatatcacaaagaaggtagaaaaggtcctgctcaggcaagtgtggcccagtgcctgctttccagctcaggcctccggggtgctagagaaagaggggcagggactgcatcagtggggctgagtcttggctgctgtatgggaagccagtgagagaagaaggcctggttagaaggaagagttggagacataactgaacaccacaaccatcagggcagcccagaggagggcaaggtgtccaactaatgtaagctgagcagtgcctggtggtcaggcggtttgcttggtggaccacatgtgtttttttattgaattgccaaaacagcataatcatgttattgtcaccttcatttgacaaataaggttactgtcagataaatgagaatctacaagaaccacagaaaaacaaagattaacatgacccagaaatagctggcaggagagtttgaaagctcagctttagagaaactgaacagaagtggttcctgatttgaataaaattgaaggtatggccatggaggtgagtggagatggtgtactaaacggtgtatcaaaaggagaaaaggacagaggaagtagaaattgaatgatttaagagactagggggacaccattgacatttcaatgaaaactgggagaagtgagattgatagaggatattgagaagggggacctggtcaaacacgcctatctgaaaaggcaggcaaggggtggggtagagaaagcgaatgatgaccacccgaaataaatcacccaccatccaggacttccccagagccctgtttccttaggggcaggaacattttaccatacactgagttccccacctgtgagggaaagggggactagagaatctgggaaggtcggcaatactgagacagggcacaatgagctggaaggaacacagactgaaaatcacaacatctggttctgatcctggctttgtctataacttctctaaacccccgcttgtctgttaatatctcaggacctaagttttcttatgtgaaatacagagatagcaaaacctgctttacttcagatgaaattatatatgtgaaaacacttggctaaaactaaagcaccaagcaaatccaagaaaaagatatgaacatatacagctgctaattattgagtaattcttagtgtgccaagcacttgtaaatgatttcatttaatgctcaaaatcatataaggtacatatgatcattatcctcatcttaaatataaggaaactaaagcttaaacctctgagactttagacaccttgcccaaatcaaacgacctctaagtggtaaactcagaatctggagcccagtctgacctaaatcccacgctttcactcaggttgctagactagagcatctctgatttcaacctgaccctaaggagcatggaccaggcagattacaccttctgccgcagaacttcctggtgatctcccgactggccaagggctttctaagtcccttttccttcctaccttggaggagcagctgcttgtttccagggtcagtgctggctgggaagttctggttaatggaggaggggctgaggctggctttgccagcaccgctctccagctgctgttgcagctgcagtcgcagacaattgttcccctgaatgctctgctccagctgccctctcagagctcgtacctctgccaccaggtggctcaggtcactgctcaaagggatttggtgacaggcatccaggctgtaagctgagagagaaggagtctggtaacattgacccaagtatttccaagcacttgtcagaaccctcctctgtgacattcttttctgccaaggaccccactatcatctgagtctcatgcaacccatctgtgatggagatgtcaccatttctgtgtgtggcctggggatggcactgagctggcacacatccagtctgaaacttccctgcggcttaagttacacacatgcacctatagagcatttgattggcagatgaagataagtccatatttcatctccatagtaaccttaatcctgtaggctaaagtataggatactccaaggtagaaggtcagcactgagctagagaagggtaggggatgaggaagaaagagatttcatagtcctcactctcaaaaatgaaagagaaggaggaggtcttttggtagcatgtgagaatgtgagttgggcaccttagacgagggattataactgagtttttcaatttctctctctctctttctctctctctctctctatatatgtgtgtgtgtgtgtacatatatatacacctacatatagtgtgtttatatatgttgtgtgtatatacatactatatataggtgtatatatgtgcacacatatacatgtacatatatatgtgcacacatatacatgtacatatatatgtgcacacatatacatgtccatatatatgtgcacacacatacatgtacatatatatgtgcacacacatacatgtacatatatatgtgcacacacatacatgtacatatatatgtgcacacacatacatgtacatatatatgtgcacacatatacatgtacatatatatgtgcacacatatacatgtacatatatatgtgcacacatatacatgtacatatatgacatgtacacacatatatatacatacacatatatataaatatatatatgtatatatatttacctccattcaccacatggctatttctttgtactggggatgaagagatctaagaaatattctacgaggctacaatcccttatctgaaaaccttaaggccaaatgtatttcgaaaggtaaaatttgttttagtttttagcaaggcaacagggtgcatatatcatatataacatgtacccagttgcatgtgagccacaatcctttatcaaacatataactatttccgcaatgagctatgtgaatattctaagtagataaataaagacttatgaatatcctcatgtcagatcatctagattttgtcactaaatgagtatttgaaaaatttaatttggaaatcttactggattttgaaattacagataagagattatggagctttagtggttgtagctttgaaatgagtcctaaaaggcagggagaaaagcatgaaaggaaaggtagctcaggatgaaccaattttagggactttggtaaataatctactcttgaattttgcccaaagttttatgatgttcctctctctctttctcaacccaacttctcactaaattttgcttattttttaagagatgttttaaaatctatctataccctttcatcttcccaatagcaccttatattagactgtcatctcttaatgtgccagaatatcactagacccatccaatacgtttcccagattctaatgtctcccaattccaggacatcccctaagacttagcatcctaaagttctgttttcatcatatgcttatcttctttgaaaaagaacagacttagtttcattatctactatacagaatgtcaacttttaccctgacctgtgagctttcaagatttggtgactctgctccaccatcctgacttctcactccaacctcaagcttctcctgtggtcaggctggtcccactgacccaacactcaccatgactgtgtacttaaattattctcccagcctggtgagccccctctatttcttcaggttccagttcaccttctctttagaaaatcaggaaactaaatcaggatttatgataattctaatctaacttccactgcccttcactctttgtttagccttctggagggacataaaatacatgagttctttttcacctgacacttcttcaaatatccgaagccagttctcatgtcctcaagatcttttgaaagcctacatttctttagtttctttgactagttggagatttctggtccacaccattgtgcgccctgtcttcattatgttccctagtgtgtcaacgcccttttcaaagatggtgccccttaatctaacaatattttagacatggtctccacaggcgaacatcacacttacactactgtagttccagtttgagctggcatttctagcaacctttgtcctacaccttacttgtgtgaacatgtttctaccaaaccccaaaccctcatgtccatgaatggctgcctgtcctatatttctaccctcatcctatatttctaccactgatatttttaatcaagctcaggattttgctttttatctttgctaaatttcacgacattgatgtcgtcctctgttccagcctgctgtgacttattcacattatgttttgaatacccttctccatttaaagaatgaagaaatatatcaaaattctcaaatattagattattatttcagcaggcagcaaagtcttcaataaatgtccttaatatttaaatccaggattgaaatttaggtcctattagtggtatttctataaggtttttttgtttttgtttttgtgtcttttaattttctcctgtgggcaggctggtccccactgactcaacactcaccatgactttgtacttaagctattcgcccagcctggtaagcccctgtatttcttcaaattccagttcaccttctctttagaaaatcaggaaactaaatcaggatttatgaaaattacatgagagggcaataagctgagcgccagatgtcactagggaaagggtcagggtgggagcggactgcctgctgcattgggctgaatgggttgtcagtatgtatcaccgacaatattaaaggccttttcaaatgatgatatcattaggacagttcttttgctttcaaaaatgttacaatctagacattgataggaatgtctagattttcttaaagtaattaggaatgatcaggccggatcttgctcgtgccaccaacctgtcccgttgggctttgtgtttgagagctcctactgggagccccaggctcgggtgggggtttctgcaacagaactctgtagcttcccatgatctccacaactcccaaaggaaagacctcactagcatcctatgcaagggcaaaaagctcatggggtgaggggagaagaacacatacctttcagccccttcttggaattgccataaagtgcctcgtagatttgtagctctgactggagggactcaaagagctgctgtttctcttcacactgttgctgcaggagaaccagcttgtgctgcagtctgaccagggagaggcaaggcccactgagatggcagagctactcagccacaccagagcaacaagctgagagccagatgtcaactcagagggtcataaagggttacagttagggttacatctgagccccagatgtcaactcagggggtcatgaagactatcacttttatttcgcagatatggaaatggaggctgagggaggtcaagtaactttgcttgaaaacacaccattacctacattagttcagagcagaacagacacaccagcacagtctccttactgttcctacagtgctctttgcattctgacaagcagttacagggcttatgctgggaccaagcatcacagccagtatagaagcttcctaggtgatggtgagactaatgtcctatatctaattggaagcatgggaacccttctttttcatgtctctgatatactgaagacttctataacagagttttactctctcaacttgggagtgacaaggcattcccagagaagtcctttcttctgctcaaagcgcccctccccccaccccactgacacacaaaaatcaggaatagcagagggaacatttaggtttccaaaagaggacatcaattgtcttgccaatatcccttcctcttgtaatgtaagaatgaatgtaagaatgaagaatgctaccttctctgtcaatgggtcccctcttacctggagtcgttttcctggagggaaagacgttcctccctgaaatgcaagacctcttgctgcttctccctcaagtcttccaaaagctgctgcctttccaccttctggtgctccagctccttttccagctcttgaaggtgggatcgagaggacagcagagcctccctcaggctttctgtttcctgggagtgctctggtgagaggaacacaggattgatttattatcatggggccagagctcagctggaagatgaccccaagcacatccaccctgacagacagagctaaggagcagggaaggaaggccctatgttggtgggaagagcatgctggctcaacatcccccagagcctggagcatggtgcctctctctctttgcaaaacccttcatgccacttatttaatctgtcctaccttgctcttagagaaattctgctttctaatgatcaccactttccaagtgctcacatatcgtctgttcaataatccattcttgaattttgacaaagatcaacgtcaagatttctttttggatctcattttcattattttgaaaactgagattttttgtttttgaacttgcagcacttctctgatcttcacaagttgtcaaagattattgaagggactctaaaaatacagctgcaggctcagtaagtcctctggggaaagagtcacctgagcctggcaaattgtactcgtttaaatctcttactgtcttctcacctgctgaggtctgttctattctctccaagcatgcaatggtagctcagtagttctgccctctttcttatctgttaacttttgttatcgtcccccagcagtgacctttcctctcaaatcttctcgctaatacagaaatcaattaattaaattaattaatttgggtggctaatttagaaatatctcttggtggctttttccttttccacaagcattccttcattctgggcttaatccttttggatactaccctcagtcttttcatggctgttcataaatatttgtgaataaaaatactttgttatcgataatacattgatctgatcaagtagactaacaccaaggtcagctgcctcccagccacacgagaaatgatgcccacctgtgagcgccccctggctagggctgggaaagtgctggggggcatttgctagtgccactcggcatggagtcatgggagtactgaccagagggaagccctgagtctatgagtgagagatgtggtgaggaggcagagggatggcacagcagggccaggagcgacacatgctgctgcagtaaagtctggagaaacttgagagggaagataggcattcgcactccctcctttattggttccaagtcagttgtgagtgaagggaggtagagcagataccagactggtatccaaattgatagcttgtgactctggatatatgcaggtgggcttgtacagaaatgatggatttcctagagctcttcgcttctggggactaggagtctgaggggcccatagttggaacatcttagaaagcagccttctctagactgagaatagctgtgagtttgggttggtggatctgagtagctctgttacctctaccttcttctgtttgcttctccagttggtgattagtgtggccagggaagaaagaaacttaagagtgaccacagtttgtgggttttgaccacgtacctctggaaacatgactcagttgagcctgaagtcttcgattgtcttccctgaggactctgttctcattgcagagctgaggtatggactccaggccctgactgtagaagttagaagtggatcctgtcccagaaagtagacatttgggtaacagaaactttcaaaagtttcccattcgttatctctcaaagatactgccccaacccagcagaaaaccccaaggactgaaggcctggccctgaatgaagcgtggggggctgggtacatgttttctgtgtgcctcttctcagtggattctttgcgtgcatcatcacatgccgtaactgcaatggtgcaggaggctcgatctccctaaacagctgctgctgtggtataggcaggacaacaacatatggaaagactggcctccacatgacagcagcttggaaggagagtgtaaggagaaaggccaccttggtaaagaggcgagggtagaggtgggaggacccttacagacctggttccaccacttatcaatcacacaacaaaggcacagacatcagcagtatataagcagattaagtatggggtgagaagtcaggtgactctgggcatcagacgtagttctgccttaaagagagttactctctaaactcagatatattcagaaagtagggatgacagtacttgcccacctcccttgctggactgttcataaggagcgagtgaagtaaagaatatctgtgaagctctgcctaaaagtccctaaatagagccagaaacaggaaggtctgggcctctcctaccccttccacgagcagtagaggtcagccggtgttccagttgctcccgtaggcggtcattgatgcagatggattcctccaggcgctggcgcaggttccggatttcaccaagatgctcttccagcaggtcagcccctgcggccaaaccaccaggacatgaagagaggtgggagatggagaatcctggttactgatgggggtggggctcggctaggggacctgcagcaagacctgtaaatatcactagccttctgccaactgtgtcctctcacacggacacccaaaagaatggtagttttgtttaaacagtcaatgtgctttcaaacacatgacagtcacttgctaaaaaatctccatgggcctcctcccacacaggggtcttgtgagagttccacgttttagaaaaataactgagggctctggacaaggcctgcctagcatctggaaaggtgtggccacctcctgggtgtgactatgaggatgataggtgagacctcactctacctttcttcttactgacacgtgagtgagcattctttagcaagggacaaagcccttcctcccacccttagaaagaaggcctaaagtaaaagtacgtgatcttacactcaccctatgcggttaatgactgacactgaatgcttccctgaaatcacttttaatatggaagatgaaagaatagcctggaaggatctagagatctgaaggcaaattagagaggggatgacaccccccttccccctgccaaacaaagcaaaaatatccagaaaagtcagacggatgcttacaccggacattaactgcaccattttgctttgggctcagtcttttcctgaaaattacgattgtcttactgttggaactgcgcggcatctcagcatttatgagcttagctatacctctccacttgctgtgactgaattttgtgcacaggatatatttgcagggtcagggagctgcacccttacaccctttcctgtgacaagtcctgactgatggaagaaagtcccatctatgcctggcattctggaagggtctaagagagtgggctgcaaagaggccaggctgcagagggatggaaggacatgagtgtgacagcacaagaggtgggtccctgactttcccatatccctacagagcactgaggccctgggcaggagaatgaagaaatgtacttggaaaggattgagccctgatacagctcttgcattttatatccactctgtgagccagggatggaggaggaatgaaatagtcctgcctgggtaggaaaagagtagactccaaatgagacttcttttcaaaggctgccatctctgctttgtgctttacctgtgggtttggagttaagctggtacacagaggagcctgaggataggtccccagatacactccctttctgaggcctcatcacatcccacttgccactgctgcccaggtacccaggctctaggattcttcccagttctatggtgccccttggaggagagtgaggctgggcagagttgaggtagtaggaagagtcggcttccaagtcgttgctcagcaatgtagctgtggaagcaggaggaacagtgctggcacctgggcagaaagaaacattagtaagaagcaaatggggtgtcagaagggaagaatttgcaaggaagtgtgtgattgctaagaatagagactaaaaggagacatgtggaatgtcagagatcccagttcactttggtatactaattagactaaggcttgtaacctagaggttgtaactcttaccctttgtatttcctagcaggagacacaagaggtagagaataaagtatcttaaagtcatcagtatatacaatggaaaagtccagtggccccactcctggatcctactataatccttcatgacagactccaaggaaagttctaaaagtaggattcactcccacagttagaagttgtgagtgcagtggaatgcaggattgagcttacctgtgaacacgaacatctgtttgtctacatgtacttgccttcccctgaaactaactagtcaatatgtccgttccacgttggagtttttcagaagagaaaggggacatgaaatcaagctggatatggtggccctagttcctccagactgaagaactctttgctgaggctggggaagggcctatgtaaggcaagtatttatttggatcccatccaacatgactcaaggagctgcaaaatgtcatcactcctgtctaaagaatcattgaatacaattccacagaggcaggtaggacctttcatttaataggctgatactttcatagatcctttgaaatcataggcctttcccttgagccccatcatctccacttctctgtaaaaagaagcctagcatgggggagatgaggaaagaggtgggcagagacacagtttaggagaaaattcagaagcctgctttctttcagggattatgaacatgggcagcagaatagacaggtagctcctcctaagcaacaggagtgaggtcactgtttcttccatccaagccaaactccttggaggggttagtgtaaatgccacttgccagtttttagccctacttgtagctggttctcaaatgtgggtacatattggaatcacctgagaaagtatggaaacatatactgattcctggattccagagattttgccttagtctatatgggatacatcttgaacaatggatgttttaaattcattttaggtaattctaataggcagaagtttgggaagtcttgtcatgagtctctcttctaatttgcaaaatactagatgttcattaggatcacttagttaaggaagaaggttaaaaatttaagcacctacattttagaaggaatgcaacaaatacatgatttcctacctctttcaaactgccttcaaccccatccgaacacaaggcaaagggagaaatcagtggttgcagatagtcagcttactttttaatcaaggccatgtgaggttttaagtctatcagtaacaatgatcagtattctcatgttccagtccattggccacacaatacacagtacatgctctaaaccatgcaaagataccatacagactcttgcacaagattttaacccagggacctgagaggccaccatgcaccactgtccacacggaaacttggctcaaagcaaacaatgagcatgtataagcaatggtcccttggagaggaccttgacttcaggtggagaaagaaagggctacaatcttcctcatctaggctgggaccatttgaactccggtcaatggcctcagacttgatgtaattccaatttaacccaaaacaacagaccctttttcatggacagtgctctccttccatccttccgtttgggcaaagacaaatggacaaatgtggaaagataaaggaaaaggaggcaagataaagaaatggaagctagaaaatactcttgccatttgtcatgggacacatttgttgcccattcattgttggtgccagaactgctaaaataacaagttttaggtcagaaacagcagcacttcctactggtctctaaagagagggaaaaaattgttgcaacgagtccccagagtttgatcagctgagctcagctccatactctaagcaggatggtgacaaagccatcctaagtagaaaagatataacagaaacataaaacctggagcagaagaccagattcaaccccatctctcccacttaccagtgaccttgaacaagtaacttcacttccctgagctttacagttccctgcattagacaaagtacccatttcctgggttgacaaaataaataggctaagctgggtgcagtggctcatacctgtaatccctgcactttcagaaaccaaggtgggccaatcacttgagctcaggagctctagaccagtcttggcaacatggcgaaaccctgtctctacaaaaaatacaaaaattagccaggtgtggtgacacacacctgtaatcccagctacttggggggctgaggtgggagagtcgcttgagcccaggaggtagagactgcagtgagccgagatcgtgccactgcacttcagtctgcgtgacaaagtaagaccctgtctcaaaaaaaaaaaaaaaaaaaaaaaaagaggaagaaggaaagaaatatgctggtccacatgacatttggggctgtagggagggggatgcaaattcttggctgttgtcttgcatcactagaaacttctggcatggtgaccctatcagtctctggctcacctaagcttctttacaggcacagaaagtgcctgacaaatgagtttaagttcattcaaactgctttttaactgttgtgcctaaggtgctatgaaagagcaaattcatgtgaaggttgtcatttttttctaagctatcagtgaccaccagcacactaaatttatgatgagcatccagcctacaaatacatcaaagcactttctaaaaggtgactgtccacagtctacgtaactacatgagatcaattatctttgggagtcagaggatgggattcacagtcagatgccatagctggtgctgtggttctaagctgcctacgtgtcacctgtcccagggcagggaccaaccctgtgcagtaggaaaaggggctcatcatttcctcttctgaatccctctatcattaccctttttgctccaacctaatgatatcaggaactgaacttgattaacagcatttcacagcagaaaaacataatagccacacaaaggagcccactgaatgtggccatctttttcttggccacttcatcctgcataggcaaagcataacatctctctcccacccccaaccaatgagcagtccaccagtctgtcagggattcagcatacttggtggtatccaacactgtctacagtgtgagagcaccaggtctagagcctcgtgaacatatctacctgttaactgatgagacatacacaccacagaaataacagtaaatacatttccaaaaaataagcaaacagagctttccctccctcttacatttgtaacgtgtacccgtgttgtttttttaaactctgccatccagcccgagccatgcagagcaacacagtgtggggctgccaatcgcaagcacacaaatgcagaagtgctcactttctcccaactgcttctgcagcatctgtagctcctgctgagcctcagccaaggagaccactggtgtctcacagcagccaaggaggagagggccagtggggctgaaaggcaggaagctggatggagctgagggcaatggtgcctgaggaaggctagccagcttgggtatggagtgaaaatgaaagcctaggaaaagaaagttaaggagaaaagagacacatcatcaagagaaaatgagagaaaagaatgggtaaaagattgagaaggtaaaagcattccctgaccagacatcaccctgcggagtggctatcatctagtgtggtacaggataagacagccaagggtgaccattgctaccagaggctggcctggctgaccttccctcttctcccctgccagggctatcctgcatatatcctctgtgttcatcttgaaagcaattggctaaagaaggtaaggtggcattattgagccccaccccagcaatcctggacatggacaagtcagagagcctgaatgctttcaagggcccctggggctctgctcccagcatgtatcagtccttggccctgggacaagactctttctctacctagaactcctctttgacagcatcaggtcccatcctgagtaggagagatgtgaacaaaggctgtggggaaattttcattactagtgcatgcagttcaggactctgatggaaacaaacttcagaattccaaatcaacgtgttcattgaccaaattaaaaatagatgccttggtagagtggcttagacaaaatggcttgcaaatccttctgggcatttaaatcacatagcaaaaacttctaatatatgtagattctttaggccttcttgattctgtctaggccttaatgtagacttacagaattataaattcttggaacatgaaatttacatttaaaaaaagtcttccctggtgatctttaggcagcccatctacagacaggtttttagaaaccctggcaaggttcaatgtttaaaattgtttcctcttccctaaaagcaattaaagggcaggtagccaatggagagggagcagaaaccaaggctgacccatagagaatgtctaatgtagaagacaatgattatatcctaaaacacatcccaatggtgctggcaccatttcagatcaatactgcaaatatactcaaattgccaggtaacacagcccaggcattctttgaggaggcattctgattttaaaatcctctgttctttacctactgctctgtttgaacccacaacatttaagcagatgtctataagtctggaagcacagcttttcctcatgattctggtccagctgctgcctactctggcctagaaactttgaaaccaggctcaggaagcattggaacacttcctcttccttaagattttagttgaattgctttcagggaaatgagggcagcagaagaaagcactgtgctttctgggagcacctctactcaagtcaaacctcacaacaaaccacactgaaggcagccagccagctatggtgggaggtaggaggcgaagacaaggtttgccttttcttgccatccctggtacagggctgtgaatgagcagtgtaccctccggcaactaagctgaacttgtaaatgaaatgcacccctttaactgcccccaagatatgcactatgtacatatcaaggactgccaatccattcatacatccattaatggtaacgtactatgaacagaaccttgtctgaggctgttctcaccatccttggctacaagtagcactacctcttgcagaggatctccatgcagatttaatgggtaacacatacagtggatcaatagatgtgaatttcttttcatcctatggctgttgtaatcctgggagaaacattttgcctctttgctcccaggataaaatgagagaaaaccaataaaaatgtttctttttaaatgattagccaactactggtcagaactggtatgcagatcaaaacctgatgtggattacttattttctaaaatattttcttaaatcagacacaactggaaaatgaggatggtttctcgattctgtctaggttttgatgcatttaggcccctaacagtccaaacctctgtcgttgaagaaaaatcaaacaggcagcagagaaagaggagatgaagcttctgccccattggctgttgcatacctgaatgggcctggttggcctccttgggggtattctggggagttggcaagctgatggggttgctgttggattcggccttagccccctgagatgcactggttgatgatggtttagaagacaacacagcagaatgactcgaatgatggatggaatctataaaatccatgaatgaaagaaaacgtatgatgttctacagagaactggaatcctggccttatgtttacccaggggtaccagggctagagtcttgctttcagggaaagaaccaagcacaagcactgttagcagtgttcattttcttgcttgcagacagctcctatagtgaggcaaaccaccttagggatgacagcggtgctctgagctctgaaacatgaaaatggcaactccaaaaatatcaggcaagactagcagcatctgtggacacccaaatatacttagggaacactgctcaggaataagtagcaagatcattgtaggagagatgaaggaggttttccatcttaaagaagatctatctgacagagtcaccaaggaagaagagtctgccgtgatcttctcactctccccacagtggctcactttgtgcccaacagcttgtacgtgcccatggaggccacggtgacagaggtaacttgtagagtcaggagcagagcaaagatcctgatccactggtgcctgtgcatggcacttggccccacagccatgttcagcctgatacacaccatggtggagctataagccctgtttcctgagttctccactcagcctagacaaagatggtaccacccagaaagtggaggctacctgagtgactgggagaagctttcttctcttcatagtgtgtgtactcgctgactatgtccatgtcagagcaggcttccagttcatcagacaggaaagaggtgctgctgggagagcggtgggagtcagacaaggcatggctgctggagggtgtgagggaccgagcatccagcttggcctgcaggacttcaatcactttctccttctcctgcagctccctgctgagcctggtggggagaagggggacaacgggtaaaaccaaggtcaccgaagccaacctgtcctgactatggctcataggaaaagccaagtaagccaaggggaccatgcctgcagataattatggaaataacccacctctgcttagggatggagtgtaggtggggtgtagatggagagagaatagctacctagtgctctggccacataatatgctgaggacaagcaaagacatagctagccctccttttaaggcactgctgcttaatgtatgatccctggaacagttgcagcctgcgaactgtttgttaccatctccaacaagacaagtataaaaattgaaagcaagcattgagaaacacagaacaaaccactgtcccaacatccaagagcatgataagtggaatcatgtaattaactgaattcagaccatatatgtttctatgatagattagaaataaaaacaaaacaaaacaaaaaaaaccactgtgtccttcactacagatactttcagaagcatttatgtagtctgagacacaagcatgacacaaagaaccccaactagtggctacaacggactctgagcccgtatttcattgatcattatatgaagcaactcactgagaactgggtcctgaggcactgcagcctcctggtgatctacaccatctaggcctctttcaccaggtcctgttatatgattccttttttcccccagggcaattgagtgactattaaattagctgtcaacccaactttggaaaaagctcatcctgcttattaaacacacagcaggaaagcaggacccttagtggggcagaagactcttgaaacctagttagttcacttttagctcagactgtttctaggttactaagcctggagaattaatgtgccaatatgattcaaccaaaagggaagaaagaatttagttaaaaacaacagtgaggtgttcaatgaatgcctgaattcaatacattcagcactttgctttattccccttgatttgtggagttgccgccacccttgaccctttgggcctcggtcccaatctctttcccagattctcctctgaattacctgagggccagtggctcaagtccagcttgatctttctcacttttatgatcctctgtaaaccaaatttagaaagagacgataagaaattaggctggtcccacttcccgcattacaaatgcaggagcctatctggagacagagtagtgagcatttcatgtgtgcatccagaacagttattctgggatacctcagcttgtgtctctagagaagtgaccccactgtccctgacctgccggtcaccatgatgacttcctctgccctaaatcagggtaaaacatttataatgtcttttgttccattaatcatgaggcccttgcccagctgccctgcgggacactccagcctccatgtcctgctgcagactagctccccaatgcatatgccccaccacagctttcatgcagaacctgcactggtctctgaggagatgacaagaagccctgccccacctctgcatctgccaccaggtggtgggctgggtggctcccaagtctgatcctactttactcccttggatagtcgctggaaattctgagtagaagaccccaataataaccaatgtagcccttgaactactgcagccagtgcctaaaccatgtataaaagagcatggcgctttatccatatgtggagtacctgcatgcacattaccatgccataaatggagacaccacaaggataaggcatttagcgagttggtggcagcatccaggccagagcttgagtcttgtagttcttggttcagggctcttcctcctataacaaagcccttccatctcatgtcccctactccctcttagcatcagagagatgctgcccctgccccacaggtcacattccattagtggtgaagtttctatagttgtaaccatggcatctccagccctgtgttttcctctccatgctccccactgagcagtcttgatcctgtattagccccaggaaatgaaatagaaacaggaccttaggataaaaagttgcagtggagatgtggtggccaccaggggctggaactgtgggggtgactgagagtattccaaagccctgtggccaacttactggtgctgagtttgctggtgagcctctctgtcagctggcttccctgggcgagttgctcccggaagctctgtcccaggtagtagtcaatgtcattgctccttaggagatcctcaaaagattttactgtatcttttgcatgccgggtgataagataacaaatacctctcccttctcgtattttttgccgtaggtaagacagttcccgggcctgatcctgaatcagggaatcatatttcctaatgcaggacagaagaggaaagagtaagtatggaaagagtggaagctaacttatggagttatgggggcttctgtagagatttctatgagaacatctctaaggaactcccccaagctgaattctggcacataagccataggaggtatttaagagtaaattctaccctgataaagtattgcattaaaaaacttagtacgggccgggcgtggtagctcacgcctgtaatcccagcactttgggaggccaaggcaggcagatcacaaggtcaggagtttgagaccagcctcgccaatatggtgaaaccctgcctctactaaaaatacaaaaaaaatgagctgagcatagtggcacatgcctgtaatcccagctactcgggaggctgaggcaggagaattgcttgaacctaggaggtggaggttgtagttagccaagacggcaccactgcactccagcctggatgacagagtgactccgtatcaaaaaaaaatttagtatgtcactgttcttcaactgttatacatgtgttaattatatgtccctagataaatcataaggtctgtgagaataaacatagttctgcattttacatcccttacagcaccagtatcacatagattcacagcagttactcaatgaataattagcatcatttcatcctaagtctagatagaacctttcatgccttctgttttaaccaccacctgatgcctgaatttcttctatgttacgatactgtggctgactacattttgcaatgatggccatcatttaaacgctcataccatcaactgatgggacccaaaacaagagaccctaagtgagaaccacccagctgagcccagtcaaaccatagaaccatgaagcataataaagtgttgtttgaagtcactaagttttagagtggttattacttagcaatagataaccaggacacaccaagatgaatgtctgtgttttcaacactaagtatcaataacacttataactatggcaaatagcattgagagcttaacatatgctaggcactattctaagcacttgtattaattcttttttttttttttccgagacagactcttgctctgtcacccaggctggagtgcagtggtgccatctcggctcactgcaacctccacctgccaggttcaagcgattctcctgcctcagcctcccgaatagctgggattacaggtgtgcaccaccatgcccagctaatctttgtatttttagtagagatggggtttcaccgtgttgggtaggctggtctcgaacacctgacctcaggtgttctacctgccttggcctcccaaagtgctgggattacaggcatgagccaccacgcctggtcagcagttgtattaattcatttaaacctaatatccaccctttgagatgggttctcttatcatcctcatttaataggtaaggacaaaggctcagaaaggttaagaaggttgcatgggtagtaagcaccagaggtaggtagtctgattccagtattactactatactataccatctttactaatatatccctaagaggaaatccctgagacccggtatctcccagatactggaacatcatcctatgccctcctggttgcctacctgtcttttctgcagacctgtatctaccatttaaatcagtgtccctgtgaatacccagacatgttctttcttccaactgcctgagctaccctacgccaagcatgaacttacacattttcaatcaagaaagtacccaaacagtgccatccttacccaggccacgaggctgatctcagctcctcagccagcttctcttctagtccattttttgggagctgggcctccagctgggatactctctggatgagactctccaggtcctttttggcctgaagccctggagagtagaaagccccagtgccatcagacagccacccctcatcctcatcagggacactatgaggtgaagacccctccaaggtgccaacagctctcagcttccagggtctttccagactagacgaataatcacttgtaactgagagggaccggacccggctcttgaggttttgaatgaccttgttggcattctgcagctgggccttcagatctttgatgtcctttcgtaggaccaagatgttttctgactttccatatacccggaactcttcctgcttccctagctggttctccaagggcttcctctcagaggaactagccagtgttgagccccggcgtccctgctcagagcacagcccctccatcaggaccatttccttgaggctgttgtgctcctcacactctgaaaaaagacaaagatgtcttcctaaataaaagttggatgtgctgttgtggccactgcctttgagaggaggcaggtttggtcatgaggacaataattactagggaaaaagttgaagtagtactttattcaaccctgacactgtactaggcattcaaatacaatatttcttatcttccttatacctacaagttaggtttcatcactttctattttactgactgggaaaccaaaacttaaagagaggtggtaaactagcttgttctagatcactcaaactagcacatggcagagccagaattcaaatcctccaatgtcctgtgttcattccacacacactggtgtttcttaagacattaacatggccttatctatttaggatggccacaagaatgtaggacaagctattactgcatgctgaaagtttaatgctctttaaattttactataatttaaaagtttattgggttacaactgtatgaaaaataggcataggaaaataaggcttcaaaaaaatatatcagcatgttaacatcagtgtattagggcagtggtagtcagaatgagaactaatccatggcattttaccagatgccaggcactgttctaaagcattttataagaatttactcatttaattgaccttagtacctgatggggtaggtagttcctttattactattttaacacatgaagaaactgggacataggaaagttttcaaactgggatttgaaccaaccagtctggccccaggatcttgtctcttaactgccacactacactgcctcaagaatgagagagattgtgtttttcttctcttctggttttcaatgtggtgggtggccctatagttgtagtctttttataatgcaaaacaaaattatttttaatttatggcttgcatgtttctaaaaccttatctggtctctaagtaggccttagtatttctataataatcagttggatagaattttatattattattgttattagcagtatgccaaaaactaattgtagaaattcaaacttatactcagcctcattttgggtaagatttctcctattaacctcctgtcctcctcttccccaatacttgtcaggtgtggaattggccaacagcatccaaatgtgacagctgactccagggaggggtgagccccacaccctgtgctcttaccaggactggtggtttcctcccgttcagcctcattctcgcttcggccacaagtctcatagcccaggtcctggaggtccacctggatctgcttgctgtcctgcttcaccaaggattcacctgcttgggaagagaagcaggtgttacagaatgtctgaatttcccacatatgccctcagcctcaatggcacataccctaaccttttgaggcacggaaggcagatccacagtgggagagaagcttctctgaactggtgggagaagagatcaccagctccaggaagcagaatttctttccaaaggaggagcctgcatttgccattatctccccttcagataacccaggctttagttgggaccagatatctgtaagtcagggattgtacactatcatctctagcagccccattgaagctggcaagtgctttatccgcaggggttcaataaatgttgaatggagctgaactaatttagagtcccaagaccctagacctgtactgtccaataaggtagttagcagccacatatggccactttatactacatcaactaaaattaaataaaaccaaatgtccaagttgcactagccacacttcgtgtgctcaataaccacgttatgtcggtatagaacatacagaacttataagacatataggctagttttctttactagtaagtcatagttacttactaagcataactctgtatttctccagctcgttagcctgagcaaagacagtggcttctgatagcagcagcttctcctggagatcttgatagcgttgtttgcattgtgacagctgggagcgcaggtgctgggtggaccctggtaggctaaacgctgactgaggcccagggtcacgaggctgggactggttatccaactgtgaaaggggccaatacagggatcaggacagtctgaggtcacccccatgcagtgacgaccaccgccccttctgaaccctgtggactttactcaagtctgtcacagcacttctcatgccatttggcagtgacttgctttccagatggagctcctggagcgctgggataatgttttcttcatatctgtatccacagcacacagcacagcaccaatcaagtctacagaggagctctcaggaaatgttttctcagtggtcaaaaagagaccactcatctcccctcacattctgtcccattgattctctcagaatccctgtattctccatttcactgaatcttcagcatggctccttccctaaagaggatcccagtaacccatctgaagcccaggaacagacacctgtgatgagctgtgacaaaaaaatggcagtgataagggatgtcattacataccacttgtctgggctgcctcataacctgatgcatccctatgttacagcagttaccacatcctgttaaaattacctgtttgtgtgccatctttcccgacaatattaagtatctcaggggcagccattggttttattgccccatgccaatgcctagtgtgttatctgaaaaattaagtactcaagaaatatttatgttataaaagcctttctaaaggctgaatgtaggcagaatattactattattgtttgtggtacaaagagacccttctcttggtacctcctgattcatatgggagaatgttttaaggtaaacactgtcatctcaagcccttctccaattgtttttcactcaatctaagcccacacttacttggtgggcatccactgtgaaggtagccccaaggtcaaggctctggggtctggggaaaggcctcacagtcacattcccctcctcttggtgttggtgcttcccaggggaaccaaccagttctgtgtttattctttcaatggtgctggtcagatgcacaaggagctctggagtaagtttactattcccttccttgctactcagcacaagttgttctttgaggaggttgatgatattgtgggcattcttcagttttccctggagctttctgaactcagcctgaaggctactctcactcagaccctctttggttaccacagtctcaaccatcacctcgcccttctccttgtcttcctcgatctcccatccatcagacattgcttctcccatctgctctttcagctccgcattctcaaggcaaaggctcagcatggtgttcctgcaggaaacacacttaattgagggctaggtctggtcctcacaacagttcctaatactacctcttaccaacatctcagcccgcaattaactcagacttaccccagagcatgaagcaacctgagacctaccacagccccctaattttatatacaagaaagccaaggctcaggaaaagtaagagacttgcccaaacttccacagcttcttggtggcagcaccatcactagaaaccttggactcaagacatgcaggctagttttctttacttgtgccccatagcctcatatgttctaatttttagtagcctctggaataaaccagagtacttacactgttaaaaaataagaccttttctgtaacaaatttattgttataaattttacagttctattatttatcatcagtcagtttcaaaccattgggacttaggaacacagaataaataaataacactaatcagaactattaatataatcaaaatgtacttagataattgtttgctttatgtctggctcacgtgatagagataaccttcttgagagcaggactgtgtctgtcctattcatcccatatccccagtgcctacacaagtgcctgccacataaatcattcatatttgttgaagaaataaaattgaccaaaacagctaatttgcaccaagacattccagataaattctttccacaacaacaaactcatactagggttgagtggaagcaaacatggctgtaacaagtctattcacttaacttttttgagcctcagtttccttttatataaaataaggatgataacacttacctagtagagttagcagatgcttaaatgaaattgcatatacggtatggctagctcagggtctaacagggaagtcattcaatccctgctgtactagctgcagacctaagaaataccaacagcagaatcccataaggtgcttgtttaaaaagctgtagagctaaggcctatgaatccacattttacttaagttccacaggtgattttttaatttttatttatttattttttttttttgagacagagtctcactctgtcacccaggctggagtgcagtggtgagatcttggctcactgcaacctccacccctgggttcaagcaattctgctgcctcagcctcccgagtagctgggactacaggcacgtgccaccacgcccagctaacttttgtatttttagcagcgaaggggtttcaccatgttgggcaggctggtctcgaactcctgacctcaggtgatccgcctaccttggcctcccaaagtgttgagattacaggcatgagccaccatgcccagtccacaggtgattcttaagcatgctaaactgagaacccctgagctagaggatgcacaggaaatgggtaattcacaacttgaaggatcagcagtgggctatgcacctagattgaatttctcagaatccaggagtcttggaacctacagcagagcttatctggtgtgtttctgggaggaaaataggacataggatacagacaatctgtgagatagtttctcaataaagaaaaaggggataggtattttaccaaaactgggatgtggaaaggggataaagagggcgcatgtgtatatggaaaagaatatttaatattatgttctaacttcatattaaaaaaaactgatatttttaaatacaaacaaataaaagaaaaactcaacaaaaccttcttgaaaggaagaacaatgcattagattctaccttctacagtataagtgattctgtaggttgggtggagggttgaacaaatcagagtttcaggttagtaattctgaggacaaaggaaaataatccacagggatagctatagatggtttgattgtaggttcaacaatagaatcaaaagagatgtactgttcttacccatgacaactcaattaagtttacacatacaaaaatttaagtaaaataatatgctttaagtagaacttaaggaaaaagttattatgataattcagagcaaaagaatcagcacttagaacaatcacaagaattttttaaaaattgtttgacaaagtatgtagtatagaagcaaggtttagacgttagaaattgggagccacagatattatgcaaccttgagcaagtcacttgaaactttctaggcctgagtttcctcagctatgaaacaacgacatgaggctagatgcctgggcccttttcaaagtgctaacattattcagggaaatttaagtggtatgtaacatgcagggaaacaacagggcatgatttagaagtcatacagctgtactttaaacaggcagtgatgattatagtcctgggagtgaatgaataaatggatcagccctacagtatcagcatgttctccaaggagcttttgacaaaaagccatcaaagacagagtggccaatctaaccaatcaatgagctacctgctatttttgtaaaattactaaagcagcagagatgattaaaattgatactctatgattgaaggacttatgagtgagagctgagaggagagggaggggcctctacacaaaccctccagccgggtgcggtggctcactcctgtaatcccagcactttgggaggctgaggcggggggatcacgagttcaggagattgagaccatcctggctaacatggtgaaaccccgtctctactaaaaatacaaaaagaaaaaattagacgggcgtggtggcgggctcccatagtcccagctactcggcaggctgaggcaggagaatggcatgaacccgagaggtggagcttgcagtcagtgagccaagatcttgccactgcactccagcctgggcgacagagcgagattctatctcaacgaaaaaaaaaaaaaaaaattcctcctccttcgtgaactgttctggttctgtatacagcagtgagacatattaggtagcagggattccttatacgttttggtcaattaaaaacagcaatactggtcatgtaacaaggaggtttccaccatgactgtcatatgtatgactggcagatgcacaataatagtgggcactgttatactgaattaagaccaggattatttgaataacagaaagtgattaccattagccaatattacttacttttatctaaagaatttgtagaaatattaatgcatggagcctgggataggcaccccttggctgtggtgcctcatgacctgcaagctccccttccctgggaagaatgtcctacctgatgtgggacactgaggagaatcctgcttcctcaatttgagcctttagctccttcagttcctcctcagctttcctcttctcttctaagtgctggtggaactcagccctcaggtggagcatttcttcctgaagacacctgttactgtcccctcccatcggagaaggaggggaaaaagatgggttctgggtctccacagttgccagacttttctccaaagccaccttgacaagctaaaagaaaatcatggtttgaagaagttaggccattaaagaggacccaagagaaacatgagattgcaaaggcagttttaaatgagaacaaaaacaaacaaaaaaagcagatctaaaataaactccctaaccagaacctccttagtcaggcataagggccctggggactggtttgggtgggaaggacacacaaaatgagcaggaggaatttccccatggagaagaggagaatccagagatggtgagggagaaaagcacataagaaattaaaacaaatgcaaacaaacgaggttgaaacaggactggagggtgtgaatacggtgattctttctcttcctgaggagacagagccctgcgagttttctcacaattcaggaagcttcatcagctctgcaacacttgagtcctggatggcgggagatgatggcttaagatatcagggcgcaaagcctaaggccctgcctgtaactccaactccctcaaggacagctgagagggaggactcagggcactggggaaacagtcggcagacacagttacagaattagaataaggtggagcgacagggaagacaacaccaactatttcattggcagcagaaggatcacactccgcagctactgggagatggaggtgaagccatcctgccaagcagccaacctcactttttggttattatctttgtgctgatgctgccagacaaactctctctacaaatctcagcatgtggaagaaacagaggcaggaacaactgcccagcacctttctatttcttgaggacactcttgaagttattcatcaatgttttaattaaagcagatcttatggcctttgctcaaatgggaatttgttaacttttagactttgttattgttcattttgggcttatctttggtcttttcccacgctcttaaaagtgtagaaatcaaaatctgagtatgataatctacttagcatatgactaattactttagtacaaggagttcctgcctgtctgtccaatattaatcttaatatgtcccaatgtcacattggcttctttttcttctcagtggcagcatttggagcttttacttaactttgggtcaattttggcctctgaattttccacccctcccccacagctgttgctgagtcatgttgttttcttttatctctacaaatattgtgacttgtaattgtcacttataaattcattctggctatactgaatcattccccaattatccaagtcatccaaatatttgatgtgcatttccacaaatcatgtagtggcccccactacaagtgattggggataacttgtagaattaattatatgctttatatctccattcaggtcaccaatacattgaagagagcagggcccagaacagcttatatggatcaacgactgacagagctgctggggttggtgcgaagccactgacttttgctattccccgtaacaaagtatgttcaaatgtaggtcacaggtttgtggtagggtcgattcacagtatgcatgtgcaatggtgttcagtagcatagcagttgaggttgtgaagacatgcgcacccaggtcaaagaagaaagatccttagacaaagccactcaagtcccaggcacccaatcttacttggactttgtgagcctgagatttgggaggctcctgggaatgtctgtctctaagactctgctggcaggcttaatcaggctggtggccatctccatatgtgcccccagcatttgtgacaaaataaaggaagggggaccaaataaaaccacttctgaaagcttacaatcccatcccttatttaaactatgtgatgttgtcattctatataaactctttccgagtaacttaactaaaacacactttgccattagtcttgagtgtgggcacagcattattcttttctaggccttaagggttccttctgcttaaaaataatgtctaactttaatgaagtttacccattattaaagtgccttctggatatatgttatcttgttctattggtttcaatacacctattttctttaaaaagaaaaaattatggaccatgaatgttaacaccagaaaaaccttaaggtacatctgatctaatttcccactttaaagtgagaaaatcaaacattgcctagggatctcatttttccccaggctaatttgggttttcatatttccatctcaaagtggactttctttggctaactttaaggtttttttttttttacatatatacaacttttattttttatttctttttttattttttatttttttattttattattattatactttaagttttagggtacatgtgcataatgtgcagcacagcatggcacatgtatacatatgtaactttaagttttaaatgtaaatgcctgaaaagtaactcaggatctagccttttcattagttttgatcatgtatgaaagcaagtatttctttcccccaaatgaaaccccagggcttccagtatttgtagtgatagtgtgaatccattaggtctatttttaattatatctgtcttattggtttttttttccacatttcctaactcacttgtgatattgcttcatataattcaactttttgtgtgctgggttcccatctgccccacaaaggcctctgtgcaaatctgatatcctgtttgaatgacattgttttgcttttaccctattgcttcgtatctgtcccaatgttaagtcagttctcaacattaaggcattaaaaattagcttttctcaaatgctcagcatcactaatcattagggaaatgcaaattacaaccataatgaatatcatctcacacctgttggagtggcatttatcaaaaaggtgaatgatatgttagagataatgcagaggaaacggaacacagacattgtgaataggtatgtaaattagtacagctggtgtggaaaacagtatggagtttcctcaaaaacctaaaaatagaatctaccctatgatccagtaatcccatttctgggtatatatccaagggaactgaaatgaatatgttaaaggtatatctgcactctcatgttcattacagcattattcataatttatgttaagatgtagagccaacctaggtccatcagtagataaatgggtaaagaaaatgtggcagataatacacaatggaatactatttaaccttaaaatgttgggggagagctcctgtcatttgtgacaacatgaatgaatctgaaggtcattatgcttagtgaaataagccaggcacacataccacataggctcacctatatgtggaatctaatgaagttgaactcatagaagcaaagagtagaatggtggttactagaggctggtggagtggggagggagagtagggggaattgttgatcaaaagtattgacaaaaagaataggtcttaagatatattgcatagcagggtgactatagccaataaaatgtatatttcaaaataagagtaaattttcaatgtttcaccatcaaaaatggtaggtaggtaagtttatgaatatgtaattagcttggtttaatcattccatattgtttgtgtgtatatatatatatataatcatataccccataaatgtatacaattacgatttgtcaatcaaaaataactatttttttaaaatagcttttttcaagtttatcacactttgtctactaacgtctgttcttcatatttgaatcttgattttttttctttaagaggtaggggtctcattatgttgcccaggctggccctgaactcctgggctcaagagattctcttgcctcagcctcctgagtagctgcaactatagatgcacactacctgggcctgaatctttattcttgattaactttttctccattacaaaacttcacataaaaaatgcaatggttgattactctagtttctttcacagcaatttcataggtatttattatagatcttacatctgcttgagaatagaattttgtgggagataatctagggaaaattactatcatggccagacttgaggcttcctgaggtggctgagtccaaaacataaggagcaagcaacttgtattggccaaaaggtgattctcaccttggaagaaagacaaggtgggatgtgtctgttaggaaaagcatatgaatgcttggagtaggaagggaacttggtgtcaggcaaaaatttaccttccaaggacataacaaggagaagctcaaaatctacctttaagggaccattttcctggaaacaagcaaacaaattttgagaatctggacacaaaacagttatggcaaagtaagctttatttaattggtagcaggagagtcacaacttcaaactccagaaaagatgaagtaaatttgcaatgatttcatacaccaagattcctcctacccaaagctgaagatatattttcaaggaaaggtgatggaaagaaaaatggtgctcgcccaagagattcttccatccagcaggcatatactttgtctatcatgagtcaagccctgatccaaaggcttgttaacttataattacactaagcatctctcctatgccaagtaatgtggcaagtattgtgagggaaatacaaatgccctaatgtaaaaagttcattccagtgtaggctgaccttctcaaaatggggtctggtcagattctccatgctaggctacaggaaagaaggctgaagaagcaaatttacaaatcagtttgcctacaattgagaattagagcaaatgacttgcaataccaggagtacttcagaccatatcaatcagaaactttcttcatatctgtgtctcctgttcatttattctgaagttaatcctgtcccacagtcattataaccatcagtgaccagccaacctcccaatctagctgtcttagagtagacatttgttcatcctgcaggtccctctctctcacccaagatcctcaatgaaatcagagagtgaggacagagggatctgtctggagggacagagatgtatataattaaagtcacaaccatcggtaaggaggactcaggagaagctgttcaagcaaaaggaaaagtggagctcatgcaagcactcaagggagaagggaaggtcgggtacagctatagcaacaagaaggtgatcctattataagaaggtgatcctactactacaaagaaactgttgagaatatgacgtatcccagacaactactcatgtccccaagtgccaaatcccaaaagatttgaggatgcttatttgggctcttcttattggttgattcgatgtctcttctttgtcttatgcagaagacatacaggcagacccagaaagcctcatttcttgtttaattttcctaatagccccaagaaagctattactggaaagtccagctgcttgtgcaggatatctaccaatgattcactttctccttaagaatcataggcacagtccatttaggagatgagattgctaaatggcatggacaaagtggagacattataggagttccggtgagtgcttgtgagatcactattggtgacttaatctctgaagtccagattattcactcttgtaacatgctagttacatcttcactgatggtgggtggaagcaatgtttcagcctcaagttctgaggtttgacaggggattgctgttgaagtaccatctgctgatcactgagtcaccatgacctcagtggtttgtcaggttgcataaggttctctttgtataatgagatttcactgagaaagattcttgctttggaagcattccaatcttcttggagtttcttcccaagcaggtcctccgccctgccacctccccgagcagcccttcgatgactccctgtcttctgtggtgcgtttcagttacaaaaagcccaaggggaatgtgtccatcgtcttgcaagtaaaaatgcttctgaagctatagctacagagaataaataggggcaaaggtgggtaggagggggaaggaagcagaagaaagagatacaatacaaaccaaagggtggattggagagaaaaatggagtgaagatatgggttggaaaggcagctgggaagttcaaggagaacaggaagatgactgagaagtagtttatgtaaaaagatatcttctcactaagtccgcaagggctgcaggagactatcagacctcagaagggctgtgtgctgtccaccctggaagtcccagaccctgacactgacttacttgctggtgactatggtgtgcagcctcctcctcaatactgtcagtgaactcagtgcttgtatcttcggtgtcatcccctgcagctgcacctggaaacaagtccagaaaagaaaagtgattcccttcacagatggcttccagacagcaggttaaattatactctttttgcccgctgactctgatttcttcctttctccatatacatggggcagaaattctccctagccagcagggctggaaagaaaaatagaactttttgtatcacagacactttcttactcatactccagcctgagcctcacaacataagctgactttgcctgcacagacccatttctaaggagccgactgtcggatgcactggttaccccactcgaatgtcaagaaagcctgaattattccccactgcctggctacataaaaactttctcttccataatatgagtccaacatgcttaaccctttccccaccactgagtgcctggagattagagctgccctgaatctctcagaggtatctattgttgggatcagttgtgcatagggtgacaatctctctgaggaacttccctctgggggtcctgtgtcctagtaaggttcaggtctagtcaagattcaagacaccaaaggattcagttgttccctaatttcttcctctaacctcccttcctcctcacctctctcaaactcttattctatgcagacaccctttgcctgaagggtttcttgcactgctttatccccgtgggatttaacccatcctttcattctccagagatggacacagccactctagggcccaaacatctacaccttgctctaaggtacaagtagctgcagtttgtggtatgggcaaaggtctaaggcagcactgaccaagaggactttctgcaatgacagcaatgttctgtgccagtgttgcccagtacagtggacacagtcatatatggctattgagctttgaaatgtgggtagtatggctcacatttcaaagcattgaatcttaaattttatttaaatttacttatatttaaatgactgcatgtggctagtggctaccctattggacagcacaaatctagggtgtgtcttcctccttatattgattaaaattaagactgttcatacattttaagaccaagagctatgttttatatactgtatttttcaggaagtgtagaaatttattatggttaatttgtcaaagaaaatttactgtgacactcactgtgtcttatagaacctccccaacttaagaatcttgaaatcttgttctgatcctagcctcggcaaccaaccagttacaactccacttctgaccactgattaacctggacctctaagagattacgtggtgagtccaaggttacacaactagccctcactagagctgcgccagtaagtcaagactctggactcttagacagaagccactcacttttccttctggtgacaaatctgatctttatctttgcttcttcctccaagaccaaagaaccttctgttgagttcagacatccaggcatgaaaggctctgcttgaatcatgagcattcactacccaatacagataaggggcttaccttatctccgtaaggaattcgacggagacaaataaatgctcatctcatctcgacactgccacacaggggttttgtttcttccccttcattctctcttttttaagctagctcacagtcttcttccattatggcagctttaagggttgctcagccttttaccaatttgaattaaaatgctgaaactttttctcccatgtttgagggggcagttcacatctatatatttgcaatggcccaggctgatctcatggaagtgctaagaggtagtaagtatgctgtgataacagcttaggtttcctcatctacaccatgaactttatgttaactttggatcaaggaagggtcctgttcagtgaagcctctaccacctctaccacttagcatctttagaggtctgtggcagacagtgtacaagagttatttccaatacttactcattcaaaccaaccccagaaaccatctcactcaggatactagctgagtagaggtgtatggacacattccctaatctttggctgctttaaaaacttactgaaaaccaggatactaatttacctaggacacccacatcatgttatgcttactttggaaaatctttccctgtacaacagtagcgatcacaatcttttatgtttttccagcaaaggaaatgaattgtctcactcagtgacagaaaacagactgttcacattgtttctcttttgaacatggggctagagaaggatcctgtagttgaagaaagcacagctctatgaggtcaggatcctcatcccctaccattgttgctgggttgtggagtcaggctgggcccacatcccaggaccattcctgccaggttccagaagcgagaattggaaagggtgactatcactggtcttgaaggtttttatctgacactttctgccctccacttatctttggcagcctttctggtgccacgtctgcattcttggataatgctccatcttatttcacttaagagcaggatgctatggttctggcttcataaggaattcgacggagacaaataaatgctcatctcatctcgacactctgccacacaggggttttgtttcttccccttcattctctcttttttaagctagctcacagtcttcttccattatggcagctttaagggttgctcagccttttaccaatttgaattaaaatgctgaaactttttctcccatgtttgaggggtaaagctaaaaaatttatagaaaatatgggaataaaagagtaagttatctcatacaaggtccatacaagacattagacatcttttaccattttccatttttttaaataaatgagagaacttctcttgtgtgatacccttttctaaacttttactgcacaacgaaacactgtcttcagaactaacttggaatattttgaatttctaatttaaggtacctatgattttatattgatgactcgtctgcttattttttgataaaatataaaatagcctgccgcctttagattctctgggagctaagaatctgttcatttaacttgcttcttcgagattaagttttacatgttagactggcaattttataaaaaacttttatttgaggcttcaataaaagttctcaacttgtggttcttggaagtttctaggctctgaacaatacaaaatggaggtgataccaagatgtcccttatttagaaaagtattttctatcagctatctaattctacaaagtacacaaaaataaacctctaaaacataagaccataaaatccttgggtgaaaatgtaagcgttatgcaaatataaggtattcttatcactgaagcaaaaattcatacttttgtagaactttttaaattgagtatggcataataattaagaacaagaactatggagatagactgtcttgatttgaattgtgcttttattgttagttatgtcacttcaggcaagtcataacctttccataactaagtttcttcatttaataattagggttaagagtgttacccactccatactgttgtgaactttaaagggtttgctgattttgaagtgcttagaacagtgcttggtacacagtgtgtactcaataaataccatccttaaacaatattattattgttattgtaagtaaactgaagtagtccatgggcttataagttgaagactgagaaagttgaaggccacagaacctaaatagcatcagcagaaggaagttttatacttgatgttactatctgaatgatcttgattgattctacctgcacttcttcatttctgaatacttgtttccccagcaggaggcttgaaatgacactctttgctctctgcctcacaggacattgaaaaggtaaggagtgacaactctttggctgaactctttggaataggtgccttacaaaaaggactaatcatcattaaatgataactgtcttaaaactccaacatgcacaaataagccttagggggaacttcatgacctctttttttgttttattttgctttacagatgaggtctcattatgttgcccaggttggtcttgaactgctgggctcaagggatcttcccacctcagcctccaagtaactgtgactacaggtgcatgccaccacacctggctcatgacatgttctttagtaatgagtccaaactgggtggagtcaagaccatttccccccaattctactctgtagtcattatcttcctttaagccactaatatgggataaacagaaaaggagtgatgtttttccatatagttacttagaacatagcaagagatcatattttattaattttaaaaggtgatctgaagaactaaaactttaagcatgaataagttggcagtgccaagtgttctttccttcggtaccgggcccttgtgtctaatactctcagcccaatttcactctgactcccaggtacactgccatgcgttcattacaagaacgctcacattttcacgtcatgaaccaactattgctgactttaatgttatggtgctgtaatgttatggagagaatcaaggaaaagaggcctcctatcaaactacaatttcacctgcacacattcccttcaggatcataagaaaactattaagattccatatagtcctccatagtttctgctaagaaataaaattctctatctagacagattctgatcgtggaacagaagtggtagaaaactgctgtctgcagtcaaacccctttatggtgtatctttgtctttaaattgcaacatctcttaagtagccttagggctttccagctcacatgtttcagaaagtagctgttttaagttacttgaaaaggccaaatcataatctaaaatacttttgggggtatgaaatcccattaaaattctggaaagagtttctacttctccaaaagggtaattattcaatacaactacagtcttctatccttaggctaaccaaggcacatgtaaattaggactcccaggcagaccaggagatatgaccactgcacctattttgtgatgccataattctgtaatgtcaagaaattcttcctgctcatggtctcttttattcttcaaagaaaacgagaaataggtttttctaggaatgtttagagacagcactacccaccacagttggctcctgaaacctctgtcgtgctttctgctattctcctacagcaaagaaagcaaggagggtttttaaggtaaagtagcctatgtgacatttccggggaaagtataacactgtttctttagtctcacttcttcgagaggagaaaaattcgagtttcttcttccttcctttagttaaagactcattctacgagccttgctttgacttggaatttagtaaataatcaatagactgattctcccataaggaaaaaaaagatacaagctttctctactttttttataaatatcttaagaataaaaccaaatagtttctgttggcctttgataattttattggatcagtaacaactttttgtgtttcaactaagatagctaaaattctaacacttatatgtaaaaattacactccattttagcacaaatgttaacagaaattaacagcacagtgccatgaagaaatgaaaaatacacagctttggtagggaaatggtcctggaaataatgtaatgccaagtttctgatcatttaacatatcactcacctccttcttcatctgatgttatgaaccactttatttatttatttaagacagagtttcactcttgttgcccaggctggagtgcaatggcatgatctcggctcactgcaacctccacctcccaggttcaagcgtgaagttatgaatcactttaattcttcttaacaacccacaaaagtttaagtgaaaactagtaagacttcatggacacagatagaaactcataatttataaaacatgctggtataaatgcatgcctacaaaggttatagattgagaaagaggtcaatatcttggagctatgactttgattattgtaaaaagaagcactacatattcatgttatatactaaaagtaaacctacaaggaagccaatatggtttatgtacttaaaacccctattctccatattattttaaatacaacattttctgatgttgctgaactttctattttacccttccagttttagtaagaggaaaacagtatgataaagatttttacttctggaatttgactttaaacaaaaaaaagggagagtaacacaaaaataatcagtatatcactttataagtttaattattcttatttgaaaacgggtagaattagtattgtcaggaccacagttttgtgttcccttccatttcccattctttgttggagacaaattacaaagctattttttatttagaaaattgatcttggcccaggtgagaacagggagaagttgaagacttaccttctgttaatacttagattacttaaaagcaacaggcttgttatttgatcataataaaatgttttaacaaagctactggtgcaaagggtgagaaggtggcttaaatccacattctaaaacacattataactgaaataactgaaatatacactatataaaaaacattataactgaaatatacagaaatcactcgaatatattatcctactgactcattccttctgtttattactgtattgccacattggagttccatatttccagctattctttctacggtacaaatggttccacactaccaaagagaaaagaaaagctcactgagctttaaccctgagagaactcagagaaaatactctgtgctggtatctcacaggatatacctggaaaagaaaactaatttcatttgttctatctctagtacaatttctacaaggtaaaatggaaaactcacttcaagtgtgtgggttactaatatttcttcctaacttcacaggaagtttgtcacctttccttgcaggatactgactgtaaacctgcagaatactacatgataccctacttgaaaaggccacttgagcttttcagggatgccaaatgtcaagattttgtgactgttttctataaaaagaccatgaaacgagaaaacaagtttatcctatcaatgggaactagagttttctaatactacctcaagaaaagcaaaggtattattgttctctctaaggcttacagtccaaaggaaagtgactttaggtagctcagtcaacctttatttctcaatgaaaaggacaattttcagtataatgtgatctgctactcctttccacaatcagaagactccagattcaactggaagatcaacatagagagaactgaaatcagtcttcttgaacagtttttgaagctatgaaccaaacatctcatgacccagacactgaattaggaggatgaatgagcataaaagtgataggtttttttatgtacatcggccacagagtttacttatgcataaactgtgtaaatagaatatactaaagaaccctcaaggaaactaattcttatgatgaggaactcatatcctctacaggttaagattttctggatccttaatagatctcttgctatatataatgtaatagaaacatcttttaaaaatataaataaggaaaaatgtatttcctctaagaagcaaaggtcctgaaaaaattactgctgtccacaactgaatgaagagaagagggtgtggagaaggttgggtgacagataagagtacacactatcaaaggaaaaggctgacctactaacttagtccaataatgtcttttcaaaaaagttataacttggctatctaaaaagagaacatcagatgaatgttgatttatactaggtactaataatcatcaaattttcaatactataaactttcaatagaaaagagtttagggacaatatctatctaaggacatttatttcactcattaaataagtcctcttggaggttcttttcaactctatacttctaaaacctacagacttcatctaccctgaactcttagaaccattactctgcattatttgctattattcaaaagggaagcatgagaaaaacaaaatctatcatatggatttttttctcaatttaagttctatgcttccaattaagcatggcctaagtaaaaatttacttcattatttttatttgaagactatttttactcaagcacaggttctataagcacacgatgctttatttaaaattactgtcattgaaaaatgactgtcaaaggtaaaataatccagtatgagaaagagtctgtgctcctgtagagaaaatggaatattatatcatgctaaatattattaaatgatgtgtccaaccacagcatgatctctgtgtggattataaaatttatcagactcatgctctctaatcagatgccaaattatcacacaaagttgttagaccagcaagctctctccagataacactgtttgcaagcctcattccagctatctagacccgaaaaagttagtaccatattctagtcacatttatgacattaagatcagacttttaatttatcctgctatcaatttactcttgctggaggttgacagaagtaggagtgattattaacataaactgtaatcactatgagccattagaaatgaagaatcacccagagctgaatcttactagcgattcagaaggcttccttggttggtctattagtaaaattaaggaaagatgttccctaaatgccttgttgtaatgacacgacaaactagtctttgatgggttgacatttctacggctccattaccttcctctttacttatggaaagttacaaaaaattttgtgcaagaaagggtctcttaaaattgggagactaagaaaagtggatggatcggcctacacttcctatctccttccttaaatgactcctttttcctcaaaagccattgaaactgaaatggcagatccattaagagtaaggcttatggctattaatcttttgcaaatgacttaatcagaagattccagagtgcttccccagtagagcattttctccctgtccactctagtttgactgatgctctatctgttatagacacagctaaagttacagaaacagatgaaatttagaatgtaatacaagccatgtcaacatgtgaaagaaataaagtgtcatgtaaaaaaaaaatggaaggaaaaaaaatcattgtgccccacttagtttagaaagggtattcagtcacatttactgtgctagaaagcctcaatccctgttcccaaattccatatttaaagtaactgaaacctcagcttctaacctaggaaacttccaaccagaggaaatgaaaacaaattcatgatgttgatctcacaaagctgcaaagcaatcttggttacttttcacacttgacattcaagacatcagaaatacaatctccagtgcccctctccttatacctgtcacgctgccacaagaaagcactgaggcaatgattaaaactataaacatacatctgtaacatttctttctaaactattctagcacttcaaagcctgaagcctattactgttatatggagaaatgtatacatactaaatagtgaaaaacataggaccctatctagtgccacaaatgaaagaagcaataccctcttctggctataatgagttatttggtgaaacactgaatgtaaagagggatactacatttgaaattatctttgtaaacagagaattctgactctggaagaccattctagaagtcatgttctgactaaatagcatgagcttggtttaaagaaacctaaaggaatcaataaagaacaaattttaagtagaatttaatctgtacctaatctaatttcacttgtgtacaacagtcaactctgagacagtattggagataaaagttgactatgatcactttcatagttcttgcctctgttctttaacttggccttcccaatacttgcagtctactattacaagactactctcctggttttgattaccttctgataaggattatatcacttttgcaaagtcattcttatagactctcaatctctttcccgctctctcatcttaaaacttgcatgcttttgatttaaaaaatgctctcactcaaagaggagttgactgaatggcaaaaataatacacacacatgcatttatgatatgatatggaacatatgaaatggattgtgaaagttggggaagaataaactttattggcccacagaagggatgagggaacgagaaggggctagggataagaatgaataaaagtggaaaaactaaaacagaatgatttaaaatgtgcaaatacactttgcaacctccaccattcaatttagggattgatatgtatgtacagtgagatccatgtaggctaaagtgagtttcactttgtagttgatgctacttgtaccagttctatcattagtaagtcaccgtttaattctgccaaaatcagacaaggatctttctggttagtgcaaacaaggttttccatcctgggctgcagtctgacccgccagtgctcagtaggcatgcttgtgatgaattcgcacactttccagttccccacctccaatggcggccagggtctccagcctgtttaagcgctccaagcttcttccaagaacttcttctagccgactgcgtaacacctgagccccttccagttccacctgcagagttcggtctctctcagagctgattaaacatgccacatggaaggaaagtggattagccatcaactgtagtgagtccacatttgtttccaaagaaccatcaataccactttgagccacacgactttgtaaagtaattgttctccaggacacaataaatgaatgtagtctttgtgtggcatttgtgttcactgctgatagattagtaaggactgttgctttttttaaaagcttgccccttatgctagattctgggccaatttcacataaaattatagctcctaagacttatctcacacccctatagcccaaacaagagaaatttcattatttggctaaaagcttttgtttctgaaaaactaaaacccaggacaaactaaatataaactggagcaagactgagccaagtagaaccactactgaagatatttgttttctcatttgttaccaaacttgacggtgggatggtgtgctgaaaaggaatctggttcataaaaactaaagctccagaggttctttaaaaagtaacacaatcaactggtcctatcatacctttcctctgccttcattttcctggtagaaagaaaacatttttaaagcccaacaataaattacaagaaactgaatagcaaaaataataataataataaaaattgaaaaagaataaaaggggctagtagggaaggcaaaatgagaaaacaaaaatgaagagaatataaaatgatccagagaggtatcatatatgtgaccaaaaatcaagaggtagaagaaaaatatattcatcatgatagctattggtggtcccaggatgatattagccatcccaattaatatattttctttgatgatattaaatgaatatcagtgcccattatagccttactctttttctttttttttgagacggagtctcgctctgttgcccaggatggagtgcagtggtgtgaacccagctcactgcaacctctgcctcccaggttcaagtgtgtctcctgcctcagcttcccgagtagctgggactacaggcgcgcgctacctcacccagctaatttttgtatttttagtagagacagggcatagccttacgtttataatagaacagcctttaacaggacatggatcacagaaaagaaatgaacatacattgagtgcttactacatgcaaggcattgttttagacacaaaagctgtcttcttatttaatctctgcaatagctgtgtgaaacaggcactaatcccaacttaagattttgacactgaggctcagagcaatccataaaacaaatgacaaagtgggtagccccggtaattgtccctcttttttctcccctcttcagtatcataagcatctgcacttaatgaagaataaaaggcataaatacaatagtaaaagaaataaaaatttcaataaagaataaaagaaaaaacagcctctctcttacctctctggatgggcatggaacttcaccagactgctatagagctgtctctctgcttgtaaggcctcattgagccgactccgttcatctactagtccttctagcatcagcagcaactgagtaaagaagagagaggaagcaatacgcaaatggcacagtgagacatgaataagaaacaagaaaatgcattagcatgtactatgacttaaaaagcccactatcttagtacttaagcttttgatactattttatagttttcaaatcaatgtcatattatcttttttttatctttaaaacctgtaaggtggaattcaaacatgggagcaaaaagaagaaaaagcagagagaagctggaagcacaggaaagcagctaagaaaaaggagtaagagggaaacaggatggacaagagggaaatgtatataataggacttactagtattcttcattcattcaattaatatttactgagcacgttctacgggacagactctgttctaggttctaggggaaagcttactatctagtggaggaaaaagacattcattaatcatagatgtgtgtcattgtgagtgtaataagtgctataaagataatgagctatgacaatgtataatcaacagagttgtttaaggtacagttaaaagccagaatgcagtggggtgagtagttagtgagacagatgataatggagacagggagtacaggcaagtaagtcttttggaaaagtctggcattgaagaaaggttaaatggggctgtagctacagagaaatttggggcaaatgtaggggtttctttctcttttttttttttttttaactgggagagatctgaacatggttaaatgcagataaaagagaaagattcagttgagggaggtgacttaggtatgagtgtgagggataactattggtatgtgtccaaaagaactgctgctcttttcagaactacaaatgtcagaaaggggcatctatagctgctaccgaccaaagtaggaaattttagagcacagtttctctaggaaataccatcaactaaccctccacaaatagctgagattgacagctttaccatggtttatttcacagtagaaaaataaggtttgagccgggcgtggtggtgtgcacctgcagctccagctactcaggaggctgaggcaggaagattccttgagccccagagtttgaggctgcagtgagctgtgatcataccactgcactcctgcctgggtgacacagtgagaccttgtctcaatgtggtgactcatgcttgtatgtaattccagcactttgaggggccgaggaggatggatcacttgcagtcaggagttcaagactagcctgaccaacatggtgaaactccatctctactaaaaaaaaaaaaaagaatacaaaaaaatgtaaataaataaataaggtttatattccagtaacttacctgttgtcttcggtttcctgaaatttcttgaccctgggattctactgaagcaactttttcccgaagaagtaagacttcctgggtcaggcgttccatagctggtatgtcttcaggatcaaccagttgcatttgcaggtcctagaagtcaaaaaataagtatggatgtgaaaatagtaataaaaggattattcagcagagtagcacgggaacaaatgtcttgaaatattctgcctatactttcaagtgggatatggataatcactggccaagggattcgatgtgtgcaaatattgtctgaagaggccctacaggtattctgagctgtgaacatttccagtggtctttaaaaagttttgaaagacctttatgagatcttctttaatctgtatgttcctggtcagagactccatatcagcagcctgcacctgcagctcttcttcctgcacagccatcatggactgtagagcagaaagttccatctgtgaaaagaggaaacaatgtctgccatgtttacattttaacactgaggcaaatgcttttgcatatcctattactatcagccagtaatggaaaagaaaatgagaacatgaatagggctctacagcatcaaaccaataatccatgcagtatagtaacaaaggaagttttatgggaagatgtcatagttgttcttaatgatgtcttctactttagctggcactataaaacacatcaaatttgtttaacaagcttattatgatactgaaaaagaatggttaccattagcagaagcaagaagagatgaagtttttatgtaagtaaaacttcacctaacagatgaaaaaatgatagcattaggatatctccattttgcaacccttaatgaattaagggataaggcatcaaacagcaacagctgctaacatcacgagagatcaccaaacattacatgactcctgatggaagaacacgccaccacctgtgaagaaatactgccaaaagttggcactacatgccctaaactttcagtgttctcatcagaaaatgacaagtacttggttatgacaaacttcattaaaaatcataataggccaggcgtggtagctcacacctgtaatcccagcactttgggaggctgaggtgggcggatcatgaggtcaggagttcgagaccagcctgaccaacatggtgaaacccatctctactaaaaatacaaaaactagccgagcgtggtggtgtgtgtctgtaatcctagctactcaggaggctgaggcaagagaatcgcttgaacccaggaggcagaggttgcaatgagccaagatcgtgccactgcactccagcctggcaacagagcgagactccatctcaaaaaaaaaatcatgataacaaccatagctgctaacacttactatgccctgggctctctaataaatgctttgtatagatttaatccttttaacaaacctagtgatctggctcctgcctacttttcctactttaatatctgccattttactgctcactcatgactctgtaggcacattagactttttctgttccaggaacaccagactttctcttgactcggcctttacaactactccctttgcctgaaatatctttctcagggctgcctccttttcatccttaggtcccagcttacgtgtcatctgctcagagaagccttctttggccaccctatttaagatggtctccatccatgttgctttctatcatttccctcatatcacttactatactctataactataatgtttatttatttattgtctgtatctccccaatagaaattaactacacagagccacagaccttactgatttcattcactacctacctcatccccagcactagcccaagcttagagaaggtccccatatagctaatgaatgaatgagtgaatcctcacaacaatcctatgagataactactcttttatttatacataaggtgacttcttctactcttcaacttacagacaaggtgatttgagtctgagagaaattaagaaacttgttcaaaaatcacagggctggctagtaagtggtaaatccagaacgtgaactcagggaagctgactcagagccactaggctataatatctttcctgtagataccacatatccatacaatctttatggtaagacaagttattttaaataaaacctttaaaggaatttagcaatagctaaatatcacccaaaatacccattcataggcattacaatttcatgatcctgaaaacaggacagaaccaaaaagtaacattactctggatttgataaatgtgagaaaaacaggaagaggatgtggaaactaaaatatctgacatgaataatcagataacggctaaggtagaaccacaaaaaggaagggggactaggggatttttaaaactggtatttcttaaatgccacacattctcatatcctgaaaactaattgagtcataaaacatgagtctgtttgtaagcagaaatatgacaatgaaatcaaaagataaaatatgataattctgtcacaaatacaaacacaggttttatattatagatctagctatggcaaaaggtagaaaaaaactaagagctatttggactagctagctaaactgaatttaggaagccatgacattgagtgatcttctaaaagagatgccagcatagtaacaaacaagcttttagtttcagtctgtaactctgagctgtggtcctagtatttcttcaacatcatagttgaatatgcaactagctgtggaggaaaggcagggggaagggaatctctaaggctgaaaggcctcttccaaaaaaaattgaagagaactctatgctagagcgagttaaagcataaggtgggaaaaatgtgctctaggaaatgaatcttcttaggaagtatgtgaagtcacaaaaggcttgagtttgaatcatagctctggcatttattagttacatgactattctccactcccattttaaaagagaaatcagtgtttcagcttcttcgtctataataattgggccgacaccacttactttgtgtagagttgtgagcattagtgctaatttaaatacctagcacagtacattgcacatgaatacttgataaacactgattatactcaaatttctcgtttcatgtttctaaatctaatttcacggatctaatgtcataactctaagcagcaatcacacagcgcttccttttttcaccagtgctttacaattattattattattattattatcttggaggcggagttttgctcttgttgcccaggctggagtgtgatggcacgatctcagctcactgcaacctctgcctcccgggttcaagtgattctcctgcctgaggctcccgagtagctgggattacaggcgcccgccactacacctggctaatttttgtatttttagtaaagacagggtttcgtcatattggccaggctggtctcgaactcctgttcgagcggatcaagtgatccgcccacctcggcctcccaaagtgctgtgattacaggcatgagccactgcacccggcctttacaattattttattccagttagcaatggggagagagggttacgtttttccagcatttaataagttttaatggtcccaatctaaaaacaggagcatctttttgagataatgtatatataaaataacttatatttttctccaaaaagaaaaaagtcatacctggcatttggactcagatattatacatggagaattatatgcttttaaatataaactattttgaaagaaaaaaataatagggattttggaattaagacttaactaaaaaactcacctgactttctctttcttttttagccatgagttcaagttcctctttggcattactcagttctttttccagccctgcaactgtgtccaagtctcctaaaatgaaaatatagcactagttttaattgctattaacataatgtggtatctgctgcctcctttgagtaatttacagaggacacattccaataataagaaaaaagaaaacatacacacaagttgttctttatagcattatttataatagcaaaatactgcaatcatcctagatgctataaagaaaagattgaataaactatagtatattcacagatggcactatatactgatgtaaaaaaagaataaggatgatctttatgaatttatatggagtgattttgagattttaagaatatgttaagtaaaaacaagctatgtgcttaagaatacatctaaagtagtaggttttctattaggaaaaaggggaaataagaatgtacatatatacattacatatacgcagatgattcatttgcttatttttgcaaaaagatatacaggaagaataacccagaaatgaaactgattacctgcaggagatgagtggaaacaggagagaaggaacaggaaaatattggacatctgagtatatcattttatatactagagttttgaactgtgtaaatgtttaatttttaatgtgtaagtcagtttgacaatgaatgagagagaaaaggtctaaaattgaatactaatataaataaataaatctatatagcaaatagataacaaaaccatccagaagataataaaaaaattaatccaaataatttttgaactcactactactctaactgaacactgtcagtgcaaaatatcctaaggataaaaagaattacaaaaaaatcttaaacattacttaatacatttattgttgatggtgatatttatgtaacaattccaaaaatacttttgcatattatagtattctgcaactgtgtaaatattttgaaatatattgatgctataagtaaccagggctctcaaggagatacaaatatgaaatgagggaaaaaagaacctatattgttaaattggaattaaggaaatcagtatcaaatcttcacatatatacaaatacacacatacatacttaaaaatattcattgctagttctgttctcttaaaagggcctagaagcggctgggcgcagtggctcacatctgtaatctcagtactttgggaggccgaggagggcggatcacgaggtcaggagattgagaccatcctggctaacacggtgaaaccccgtctctactaaaaatacaaaaaaattagctgggtgtggtggctggcgcctgtagtcccagctactcgagaggtgagcagagagatcgtgccactgcactcccacctgggtgacagagcgagactccgtctcaaaaaaaaaaaaggtcctagaagcaaaaggcattcatgtagcaatgaacacatcttgtgtccagatcatagtttctgaatgccattacccaccaaaaggaaccagggagctctttaggataatggctgattctgggactgaggcaggtaaagcaaaaggtaatcatagaacatcttattgtgccagaaactatcaaactatgctaacattatatatatatataacattagtaggtgatgtcaagttacagtgagtggccccagacttgaaacgatacccaggaaaaggtgtcagctcatggccctgctgtgcaggattggaacaattacctcctgcatttctgaatccctgcaaagctatctgaaaaggagagtaaggatagaatttctctgggccgaattgtgaacccagagcaatcagctcaactcaacataaggtaaggacagttcttcagcctttcagaggaattccaaacttatttgttctattaaggtaggaagagaaaagagtcttggccaaacctataatacagagattactagaagaaaaaacaagagaaaaacaaagtcccttaatgaaatgaaatttgatacttacctaatgtggatctgggtatgctgacatcctctttggcagtcaatgaagtgctatcatctctggaaggtatctgcattgaaccctaaaaaattgcaaaagtcaggggacttaggaagatgcaggaactatgatcacaatgacagtactgagaatattctcagaatttggtattaaaattatcaaacttacacctcaaatgtaaaaaggaaatggaatcagcatgaattatgtaagtctatagttcttacttgatcagtctgttttccaagacagccagtgggggtaacttcagcttgttggttagagatgggtgcttgggacatcagggagtctctccctcctaaatattggcgcagggcctgtaattctgaatttctttccattaaggcttgcaccaacttctctgcagcagcctagtaagaggaaatcacaaataacattataaagatattctagtaaaacaaattttttgttctggtattatttcttcaaagtcaaccatttgtaaaaaacaaacaacaatgacaacaacaaaaaacagtgggtccttaggaaatagtttccttgctttcagtttacagggaaaaacagagttaagtgaatggaaagaaagtctcataggcagaatattgggaaaaaaaaactgaatttaacacatctgtaacagataagagaatctgaaataggttctgctacaactatcaggctaaggtgttaagattctggtttgaattagtataacaaatgtctttattctcggatagttgcttcttaggggtggattccttttcactcaaacatttgtgtggtttgctcccttcaggtctttgccaaatgtcaccttatcaggttggtctttcctgcgtatcctatccaaaacagcaatcttgctggccaaagtataagatgaatatgttttggggatccaatgatagcatggtgactttagttaataatactgtattatttacttgaaatttgctaagagagtagatcttaagtggtttcaccatacacgcataaaatgtgtagtgacggatgtgttaatttgtggcaatcacttcaaaatgtatatgtatatcaacacatcatgctgtacaccttgagtatatacaatatttgtcaattatactttaataaagctgggaaaaaaatttttttaaaacccagcaatctcttctctatctccaacacttcttactgtgcttaattttttttcgatgcacttaccattatctaatagatctctctctctgcttcccctacatggaatgtaagtttcctaaaggcaatttggtgctgaatctcaagcacccagtacggtgtctggcacataataggcacacactacatatttactgaatgaatcaattacgcacataaacatgtttatcagaccacatgattaggataatctcaacctcaaaatcacccaactcagcttgtttcatttcaaatcccagttttctaagacagatgatgacacactaagggaaagatctagaacatttttaactattaatgcacaggaagtctgcatttaaacagaaaatctggaaataataaattgatattaaaattactgagggtctaagatgatgaatcataacaccaactgtctctgaggaaaagtactattgttttagggcagaagctgagctcttgtcacaatttctaggggaaatatgaaaaaaccttccacttttcagtaagtaaaatttgggctctttggagatttgaatttaactattttagacgtatcagaatattattaaagtaccttaataaaaatatctgtgaaaactgtggggaaaaaacataataaataatatacaagatatatactgtgctctatctgccttggcactccttttctcgtagtatttaagagtttttagcagtgctcctccaatgcagtccccgaacctgcagcatcactatcacctggaaacttgttagaaatgcaaattcttaagtcccacctatacctcgtaatttctttctctggagttgagctccacaatctacatctttaaaaagctattcaggtgatttcttttgcacgtaaatttagagaagcagatctagaagaatacaaccattaatcttcttgagttgaaaaatctcctgtaatttccatcatctccattattctattaccagcagtgcataattttttttctgaggtataataaagaccaattgtcccaaatcacaaagaagttaaaaagaaaactcaaagatcctagcctcttgccaaagatttaaataatttagaataattttgttaggtctattttagaaacaatttctgaagcacacagcaggacctttctagaaagatgtgtatttacttcagtgggcctaacaattagaatagtggagtataatcctttcacaacataagaaaacataagaaaatattatggggtcaaataacataggcaaaaaagagtctatcttcctctaaaaactgactacggggattctgagctactggtatctgaaatgcagcacaagtcaactaagagtttttagccttgaggagaaaacacatagaaatgaggaaaaattaacactttactatgggcagggcatggtggctcacgcctgtaatcccagcactttgggaggctgagatgggtggatcacttgaggccaggaatcgtaagccagcctggccaacatggtgaaaccccatctctactaaaaatacaaaacttagcgggcatggtggtgcatgcctgtaatcccagctacttgggaggctgaagcagaagaattgcttgaacccaggaggcagaggttgcagtgagccaagattgcgccatcgcactccagctgggtgacagagggagatgccatctcaaaaaaaaaaaaaaaaaagaatttacttcttaaatattgtgaaattaatataccctgtactattatgagattgtttattctcaccatgacctctgaaaaatgcgatcttttttccctcttaactcagattttacaaaaactaagagtaaacatgttgagtgtaagttttcccataccttgactggaaatgcaaaatatcactcaagtcttaacaatttagaatcaaaatcgaaacactcacaacccctactcctttctctcaaaattatcagattattaaggaaaagaaaatgtatgtaatgaagttaatggatacatgtattgtttaggcacccttccaaatgcaaggttttcaagaaatgtgtcatactttgatgattaatgtaaaactgtggtctaaggccaggcgcagcagctcacacgtatagtcccagcactttgggaagccaaggcaggatgattgcttgagcccaggagtttgagaccagcctgtgcaacacagcgaaacccccatctctaaataagtaagtaaataaataaaactgtggtttaggtaataaatagaaggaaagaaactaacagagttgacggtaaaatatataaatatacacacatctatagtctgcaaatgcttcctatttgcagactataaatgcactacatgacacttgtctgatctgtgcattaatccttacttggctttcctgctccctggtgctcacagactgaagcaggccttgaatctccatttcatgttccagcacttgtttatttcgatcacttagaaggtcctgcagcatcctttcctttcgctgtagacgctggcacagctcctctgctatctcactctgccctggtccaagtttgcagagcagtgttgcactaagatcctaatgcagaaaggacactgtaagcttctggaggaaagaaatgcctctgctaaatatcaaagggcttataagaatctatcatagaagaaggaggtgtgagattcttgagaataagtatcatgttttactcatttttgttttaccagatctagcacaggcctgctacacagaagtctctaaatacatgtcccaggaatgaatacaaaccatacagaaaactatctctggtggccacttacatacatattgttttctgaaataagtctttttcctatttgttcagggcatgtaacaattaatgttagatgaggataaatggacactcagttcatttatttgttttctccccagtgtaacttaacagggggaagcataaaacgataagctgaaaggaatactaaacactatatttgctatcatagcgatggtttctatttctgtactaactgatggcacatggtggaggaatggagccatactgcctaggttgatactggatctgctacttattagctatgttagcttggacaagttacttagcttcagaagtctgtttcctcctctataaaaaggaataatagaaagtacctcatggacttgtgaggatccaatgagttaatatccattaggatcttaaaacagtacctgacccagcatgaagactataactaataaaggttagctatcatgttaaagatgcaatttttgggtctcattaattctcacataagttctttgagaaagttaattgccaacttaagtttctagacgtggggaaaaaaaaaatcccagtgaaagtcaatgacttgcccaggcacagaatgaaattaaagacttgggtcacagtcctcccaatctgaagagtcctaatccaaggctgagattacataatcactgaaccaactgccttaaagttaactgaagtcttgcctccacttctttgttcctatcatgaagagacgtctgtaactgctgaatgatactctcttgttccttctgccaacggctaaatttggtttccatttcttctttcagccactggaggttttgacaggtagtagataactgttccacttccaggcctttggccctcaggagactctccatactctacagccataaagagagcaataatcagtcaaaatgattaccccatactcctcaggataaacaagaaattagatccacttttaaataatctcccatcaatttttttttatttgcaagatgagaacattgatctaacaatgccatactaatctatttttttggtttttagaaacttttatctagtttgtggagagattaaatatagaatatatgataaaaggaagtattttggaggaagtgcactaagctataaaggatttctcgaaaaagtggcagatagatacataagctctaaaataaatatgcaaaaaagtccacagtaaatatagataaacaagtgttctaattatggcaattcatggacatgtagataatattaatgtagaagacacaatttaataattgcaccctggtaatgcttcagtaaaagtaagagagagagagaagagcgtgtgtgtatgtatacttatgtatgaacaagaattggaaataaatcagaactatgtaaacagaaatcaatatttactggctctcctcacaaagttcatattacaaaagaaaagtagaagcgctaaaatctctcacttgctaattgacaatgatggaactagtaactgctctttttggttttcttcccccttataaagcaaaatccctggttttcagaaaatgatggaagggggtcatgcttcaggctcaggatacaagtgggagaggaacaccaagtcagagataggttttgctcttacttgcatagtagcttcattggaggagaggacatcgcgcagtctctctaagtcatgatctcgctctctcacagcaagacgaagctggcgcagttctttttctttctcttctagagcagagaatttttcatctatagcccgctgcaaggaaaggaagactcctaaagctctgtaagatttactatcctgatcactcttattcaacaagatggcagaatagaaaaccaaatcccaaagcagcaaatttaagcaaacacaaatttctataatacctatgtagatagaataatccatagcatagtgggcgaaatgatgatacatacctccagagcaacagctttatcatgtattcgctggcgaagtttctcaagcaacatttcatttgcttcaagggttttgtctgagttatctcgatactgtaggagctcccgaaattcctgagaccaaaaatagtttcttttattcttttatccaatattaactaaattaccaagtaatttgctagttattcaggataaaaaaaaaacaagatgtgatcactctcctcaaaagtaacaagtttagcagagataacagacatataaactgtaaactattctgcaacatacaacagacacaacacatagaattaactgttctgcaacatacgctagccaccaggggaacacaggatgcactgcctaactctgcctgaaggtgtcagtaaagacctcacagaggaggtaatatttgcagtgagtcttaattaaaggactaggatttcctaagtgaagaagggagaggaggatacgttagagaaaaaaaaatatgcacactatgcatacaatgaaaaaattgtacattcagtgaaatgtagtggattcaatgtgactgaagcttagagtaggtggcagaacagatcagtctcttcttaatgctccatcttcccctcaaacttttattctatcatcaaaattactctgtggaagtttctgtacagtttgtcttcatctattaaactgagatcagtagccaaatcttttgtcttcccaacacccagaaaagtgtttgattcacagaggtgcttaataactattttctgaatattaagtctttataaaagacttcataaaagactgcttaagtcagggctatatgtactgtttcttatacttgttagtaagcatcttaattcacaaattatattttctatttattttaaatcctcctgattcccacctctctcaatgttttccatatggcagggactcagcacaggtggattaatatcttaaaattatataaacaaatttcagagttctatgagcccagttttcattgaaatcatgtaaactcacctgaagcaactgctccttgtgactcagactatggtttaggtgctggatgttttgttcctgggttcgaatctcattgtatttttcagcctcccaggcacgaagctgttggctcttattctgcaattcttcttgtagctgctgcaaggcttttcgcaattcctgaattaaacatattacctttttaaagagatctaaaattgtcacatggttattagatacagaggccttaaaattttcaaggtatataaactgaaagaggagcagagggtgccattattaaaattgctatagaagtattatacatgaattgaataggatatggaaaattgtaaaagttgtgaatggggtaggaagtaagcttgatattatagttcaatacttattttttggcttaaaaagaatacatctatagaaccattaagtgagaatctgtcctacggtaaacctggattatttacaataagctcaaggataaactattcctatcatccttttttctaaagatctcatagagaccatcactcttctttcttagtttgccatatttatttttctaataataaagtcagtaatctttaaatcatctgttactttagaaagctaccaaatacatattctcaactaaacaaatcttggggaaatgtttcctttagctaaataacaaaaagttaagaattatttctacctccatccctccaccactccccgaccctgcccagacatctgaaattttaatatttcttttttttgagatggagtctcactctgttgcccatgctgaagtgcagtggtacaatctcggctcactgcaacctccgccttccgggttcaagcatttctgtgcctcagcctcccaagtagctgggattaaaggctcctgccaccacgctgggctaatttttgtatttttagtagagacggggtttcaccatcttggccaggctggtcttgaactactgaccacatgatccacccacctcggcctcccaaagtgctgggattacaggcgtgagccactgtgcccagccaaaattttaatatttcaaaaggaaattcagggctaatatttgatctccaaaccactaaaccagggagatccttcaaaaattacttttaaacctgagtgttaaagagcttaagaagagaccacacacaaaaaaatcttttaaatcttaaacaaacacatacactctgacctaacaagataaaggaaccatttaagagttgtgtattttggcccagcgtggtggctcacgcctgtaatctcaccactttggaaggccaaggtgggcagatcaccagaggtcgggagtttgagaccaacctgaccaacatggagaaaccctgtctctactaaaaatacaaaattagccaggcgtggtggcgcatgcctgtaatcccagctaccaggaggctgaagcaggagaatcgcttgaacccgggaggtggaggttgcagtgagccgagattgtgtcgttgcactccagcctgggcaacaagagcaaaactctgtctcaaaaaaaaaaaaaatgaaagaaagaaagaaaagaaaagaaagagagagagagaaagaaggaaagaaagaggccgggcgcagtggctcacgcctgtaatctcagcactttgggaggctgaggcgggcggatcacgaggtcaggacatcgagaccatcctggctaacacgatgaaaccctgtctctactaaaaatgcaaaaaaaattagccgggcatggtggcggccagtgcctgtagtcccagctacttgggaggctgaggcaggagaatggcgtgaacccgagaggcggagcttgcagcgagccgagatcgcgccactgcactccagcctgggcgacagagcgagactctgtctcaaaaaaaaaaaaaaaaaaaaaaagaaggaaagaaagagagaggaaagaaagaaaagaaaagaaaagaaaagaatcgtatatttattattcaaaaataaaaaataaaaaacagggctgattattatgcatgtcattcctctgaccttagtggttcttccccacttttctgcctggttttacccatccttcaagaataacctcagatgtctcctccttcatgaagttttccttgattccttttccttgactcctttcctagatattcctgtaggaccccatatatacatccccttcagaatttaccacactgaaactcagcttatgtgactgtctctcttactgaactataagtaacttaaaagaaaggagcctgtgctattcatccttgtatttccagggtacaactcaatacggcagtcgccccttacccacaggggatacattctaagacgcccagtggatgcctgaaaccagatagcactgaagcctgtgtatactgttttttcctgtgcatagataactatgataaaggtttacatacaaattacacatactgacagattaacaataacaataaaatagaagaattataacaacatgctgtaacaaaagttacgtgagggaggccaaggtgggcagatcacgaggtcaggagatcgagaccatcctaacacgatgaaaacctgtctctaccaaaaatacaaaaacaacattagccaggcatggtggcgggcgcctgtagtcccagctactctggaggctgaagtgggagaatggcatgaatacaggaggcggaggttgcagtgagcggagatcgcgccactgcactccaaccttggcgacagagcgagactctgtctcaaaaaagaaaagttacgtgaatgtggtctctcttaaaatatcttaatgttttttgtctgtggttgaccccagataactgaaaccatggaaagtgaaactgtggataaagagggactactgtaactagcatatggtacaagggcagcaagtgttgaactgaaatacttagattatgcaactgactcaagggttcaacacaaactgtcctgctaaaaagttatgatcagggcaaagtcagcatttagggcaataaaatagttaatgatttacctggttatgtttccaagaagcctctttctgctgttcactctcgtgtgctgcagcctctacaaattgcacacattgtttggcatcagccagttggcgctctttctgtcgtaccaccctctggagcttctgtatttcaagttggctgcagaataaagcactctgaagatcaagcagagctacctgttgctgagctggagaagtaccctctgagctctgaaaagagagtagaaatcacaatcacaaggagggcaagcactgagctcccacaaagactaaaaataaaatcaagactgcaaccaaaatggcacatccccaactgaagtctctcctgtcctacgtgaccctcacatacgtgaagttgtccaagctggctttggtgcagcatttctcgaagctttgccattgtgtcattttgaccttcaattacctggtacaactcctcagtctgaaaatgagagagggaatatcaaatatgttagtaaactaattataaattccattatatcacctgtacacattttagtaacaggactattccaaaatatcaattgagattaagctacaacttctccaggctaagacatgctagtctgacaatatccattttgacaaaatataaaatacttgtctactttgaagggaccaattgtttccacacaggtccttgattggtaaatatgttacctcacgttccctgcttttcagagtttccttgaggttctgaattgtaccatcttgcttttgagacgactcctgagcacactttagttcatagctcatttcattaagtttctcttgaagaatctgaattcagcaaagaaaaacagttttttaggtcaatgatgtcttttagcctcaaatgaataaagcctttcctcaaatctaggatttaaagaatttcttaggggatattaccttgttatttttcctacatagagtaaccattaaagtggtaagtcaatcagcaacaaaaagtagcaggagaaatgaaatacttccttcaatactaaattgtctcaattttcacgcactgtgatctctctatgatggcagccatactaggaacttgtccacatggaccaagtaggcaagtggtttctaatatggatcccttatacaaggaccaaagagcttctgctatctagcataggagagggcactataagggcacccaggccacaagttcagcatcccaaattgtagcaattttcttctaagccagacattaaaattcatgggctagaaagtagtaacaagttaagctaaaataaaaaacacagacctcctatctcagtgccttttacagtggaagactgcatgcaagtgtttttttgagacagagtctctctctgttgcccaggcctgagtgcagtggcatggtcctggctcactgcaacatccacctcctgcgttcaagcgattgtcttgcctcagcctcccgagtaggtgggattacaggtgtctgccacaacgcctggctaatttttttttattttttagtagagacagggtttcaccatgttggccaggctggtctcgaactcctgacctcgtgatccgcctgccttggcctcccaaagcactggcattacaggcatgagccactgcgccggcctgcatgcaagttttaattacacacctgaaaagcaccagaaattatgatctgtacagaacaagctaaaatcttcataagaataaagagaagaactacacttttacatgaaatattccctagagcacaaggagtacacagtattcatctcccaagtcctacaaaggttgacagactcaggctagagccagtcacatcctcaggaaaaccttgtcatctcctagggcatagtactaatcataccttgttggtggcctctgtttgctggattttttcctggagttctgccaagtgggaatcagatacagactgctgagttatagtggtctcatgtgaattcagcttttgttgtttcagcaactcttcagtcatgggctaggaagaaacggcaaggaagaaacggcaaaacgagtaaggtgagttaaacatggccaacaaaattttttttttgtcttcaaaaatgtctgttgcatcttttgccagagatttagagaatcagatttgttgcataaattatcagtatgaattcctaaagacaggtctgttccttattaagaacactgattcacctccatttgtactatgctccccagcttccctctccacttttctgtaccaattcacacaaacactacatgtttattcagcgaaagcaagtaattcagagttcaatgagaaggggaggatttaataaaggaaatgcttacaatgaccaaatatttgctttattctatttttaatcaaggagttgaaaaggcatactcatcaaacttacacttcctgagagaagttacattccggctacctttcttacaacatgcttgtttcacattattggaaaaaattggcagattttgatatggactatatattaggtaacagtattttatcaatgtctaattttctaaatttgataattgtactgtaattatataagagatgtccttgtccttaagaaataatgcttaagtatttagggtaaaggagtatactatctacaactaattctcaaatggttcaagaatttttaaaaaatactgtgcaaatacagacagtgggagagtttataaagcaaatgtgacaaaatatttgcaactggtaaatctgggtaaagggtatatgggagttcttggtatttctcttataacatctctgtacgtttgaaattatttcaaaataaaaagagaaaaattaaaataaatttaaaatagatgtgcctaaaggcagatttatagcataagcacagataaataatccatagtgaaatgggaaagagatatattttataggaatatcaattcacttaaaagattcaggagaaaaaagtatgattttatatatgggacaatttatatatggaacaatgatttatatatgggacaataagataaacttattgaactattcttagtaatcattacaagctaaggatgttaaaataaaactacaaatttactgcggcaattaaatttgatcttcccgcctccatacctgcttccattccaattaggaatataaactcattaagagagaaaaggcaactgctattcattttttgtttccctcacactttcagacttgattaccactttcaaggcagtggagttacagcttaccttaaatcccttcctgccagcaactgactggaagcataaaaattgcagaagaaaaatctcttctattcctccagtgctatttatcaacttttctaacacctactaaatgctataataagcaaagcaccatgtgaggcactgtgaggaatacaatgctgacataacatatatctgttgcacactaactatgtgctaggcactgtcttgaagatagagtatcatgcaagacaaagtccctgtgctcttgaaacttatattttgcaggggttggagtggggagtacatgataaacaaacaaggaaatgcaaaaaatattatggacaagccctgtgcggcaaaacaggaaagcataatacagagtgggtggttaaattaccctaaattgtttgatcagagaaaggtctttatgaggcagcatttaaatagatatctgaaggaaaaagaatcagtcctgcaaagatcagcagaacaatccaggcagaaagaacagctaatggaatatgagcctggaaaagagaaaggcctctgtggctagaatagcactctccagtagaaatataatgtgagccatgtatgtaatttttaattttctagtagcttcaatgaacaaagtacaaaataaataggtaaacttaattttaacaaaatattttatttaacccaatatatccaaaatgttatcataaacatgtaaataatataaaaattattaatgagataacattattatctgagataatattacatgatttttcataagtctgaaattcaaggtatattttatactcacagcacatctcaatttggactagccacatttcaagggttcaacagctcctaagactagtggctagcttactggatagcacagggctagagcatagtgggcaaaggggacagggaaactcaatgaggtggagaggcaggcaggcaccaggtcacatccagcttcagacaacaaagttaatgaactggatttcattttaattgaaatgagaatagactgcagttttttaacaggtaatcatacagaagttttgaaaagatcatgctgtggtgaatgaattattggggagcaccaagagaagcagagagaccaggtaggaggctgctgcggtagtgcaggtgaaagacaatagtagcttggatcctggtggttagtaaagggagggggaaataaatggatagatatggatatgttttgaaagtatagctaacaggacttgctggtggactggatagagggagagggaaaaaagcagcaaggataatgacttctggaaaaattatttgagatatttgttgttgtgggtataacaggaagccttcacctgaggcaatatgaactatgtcacaccatgggcaaagtaaccacattaatagatgtttacaatgattctaactaataaataaattcatcatttacttaatgataaaaccatctctataaaatttggcttcttacttcttcagcgtaaaacaacagtaacacctacagtaagatactttgaaattcaaactacaacaggcagaattaaagaaaatagcttcaagtttaaaatggcaaggaaggtggtcatatttatttactttaaaccaaacaatcttacagtggtgaaggaaactttataaactaaccatctgatccaatcctattttacatacaaggaaatggaaacttagagaagtaattagtccaaggtttcatgggaaatcaggaaaaagatccaattaaactgaactggatttccactcaggttgggaatgtatctctcatttctataaacccattgcctaccataatgccgggaatactgcagagatcaaaagtttttgtttaatgaacaaataagaacaataaaaacaaacaaaaacgagcctttagtggctctcttagaaataagactgtatataacatatattcgaacagcaactttaaagccaaagaatgccacaggaaaatacataatgtatttgaatctcatatgaatcaatcttgacatgaataataataagaaacctctttttctataaataatgtactgacctaaaagttggaagatatttgtttcttctttatttgtaataatttactattttgcatctcagaaaaatgtccttgcaggtaacagtctgctgaaagagcacttagcaagtcccactaagccaacaacataatgaattcttgtgaagtatcaagtacataaaacagtcactcctacaatgatagtgtagcccatgaaataagtaatacctgatttggtagaatcagtgttactctctagacactcaggtactaaaatcatgtggaaatgataatataattttaaattaagtcacttttgactcagaattaggacaaaggctttccagtatcagaaaagagaaccgcttccaggcctagtgttgcacaatatgagacttttttttaggctaaggccagtttttagactttttgtgttaacagcagttttcttggcactttctagtcctcacagtagtgagttatagatctcaaactgctataattgtcaaccctattgttaataataggagacagacaagaaccattgactaccataaaattaaaggcctaatcttttaccagcatctaatgccaacatcttccaaagggcctgatccacttcacataactaaaataagagtgggataaatttaccatagtcacaaaggagcagaccttggcattgcaaggtttaaggcaaagatcttctgttctttgaatttagatagaaagggaaattgcacatgggccagagctcattgctgtttactaagggaccacatccctcccatcatagcttttctagttcagggccagacaataaagaagggaattaccagctagaagaaggcttcaaacctttctttagatatctgaacagccttaggtcctcatacataaattctgtagaagggaaataaattactttgtataatatcagaatatcagtaagcagaactacactgttgctatttttctttaataaataagaaaggaacaaagaaaaagacggaaagaaggaaagaaaaaaaagaggaaaagcaatcaggaggaatcctgatgtcaatatttaatagtgcataaaatatggtaagtggaggattaaacaaaggaatcaaaataaccttacagaacaatcttgctctttaagataaaaggttttctccatatttgtggcagaactgaactaaaggaaacatttttttctttcatggtttcgtgtttctacaaactaaaaaagagaactaccaaaaaaaattatattatttctattctttccatatttgttcagagaaatagacaaaaaccagtctgccattgtcccatctagcactggttttgtcataaggctcttaaggagcttaaaagtaaccagatttaaacaatagatacaccgcccattttatttacaaacatgttgggcccaattcatctattttccctgacatcctaaattattagagaaaatggcataataattaaatgccacatttcttgaagctgaatgacattttctcccacctcctaatttttgtttttctagaaacagtaaacaatgtaagtcaagtcacagcagaaaggtcatacactaccatcttaaagctctaatgtccaaatttagtgaagtaaagggacttgacctgaagatacagttaccatagtttatatgtgttcattcagatgacaatttttttcacataatctctaaagaatcctccgagcatccttaggttagagaaagagggctcctggtttaaaataagtacttacttaaattaatatacttcagacaatggggtttaatgtatagaattaaagtgtcttgcctgagaatggtcagaaatctttgtctctgcatgggctacgttagttaaacaaggaactttccatatctccaaattgagagactgcctgaagatgatctttaaaatccttctccactccaaaatccagtcaccaaaatatagtattttatttaaatacggagaaaaaaagatcttgttttggctgttattttctcagtctttatgtaacgttctacaatattggtcatatttggtggcgggctggggggacgagtttatttcccatccatcctggcccaactaattttagaccctaatatgaaaacaccatgtttaatttgtaacacctatgtctagtcacagaaatactgtaaagcccaaatttagctgcgaggctccactgaaagaaaaagcaaaagaaaagaagtacacagtgttaagcatacagtgcttaacattttatacaaaatgaaaatgcactgactttttacctttcatgacactttcatctatgctgtttctcatctatgctgcttctcataattttgtgtaaatttaaaaacttttctcctgttttctgcttaggttcttattgtgatagacagtatacataccatagaactactttccaaaaatttcaagtggccatcaacaatgtcacttatcaagctctaaatttctggaatgacgttgaccagtagcaggctttctaaaaaatgccttctagatcacatctacctttgtgacagtattgttaaataagttgtatcaagtggaacatgccagaatgtttcacaaagtttattgaagctagcatttactgttgctatagaaacaaactaccatagttgaatttaaaaggttggtacagaatcaattgggcagacacgaatagctcaaattaagcaattaagaattcaagactataatgaatgaaactctcctctgatccaataatgggttaatcctttcttaatatcaaatatcttccagtagaactcagtagagttctggctgtgaacagtttatgccttaatcttttgactgacaatactgtacttgaatacttgaattcctgtctcttttatgaatgagtcatcactaatcctcaaatgaactattaattctaattaatatggtccagatgttataatactttactggtggattaataggctttccccaaaccttttaccttatgctctaatcatttacaggcattttgcggatgaaggctttaatgctccaggaagaactaactagagaactaactgccttacagaaaaccattgggaggaaacgtctataaatctgaaaacaagaacaaattttaaaagttggaaaaaaaaaagaggtaagaggaaaagttctagtgccagaaatgagattaaatgtcttctttttataggaaaaaagtgaagtaggaatctttacctttttgttttaaaaggtatacaattttgataatgggaaagtcaacagattttacaaaaaggattgtgaaaatcaaattatctgagtgcaaatcacgtttactaaatgagacagagcaaaaggtgcagcaaaaatggggtcatgactaattttctcaagtccagaatatttctaacctccacctagaccgaaatcacgtgaagccagaggccagctagctataatcagaaaggcactatgtagccgttttgtatacctggacccggagcggcaaataatcttcacagagatcatcccacagctcctgcaggtctgaaagctccaagggataactcacaggtgtcttgtaaaggggtttcaaagacctgttaaggaaaccggaactaactccatctgtcatgctagggccaggcttggctccaggtaggctggatttcactggaatcggaagcctgctccctcgggggctctggatgggcttataatcaagacctttaatcatgctaagagctaattccagcttgtgattacacccatgctgcggagcctgatcatctgaacaacagtcacactttccaagttcctttgcacttctctcagtctcctcatctttctgttgtggagggctagcctggacgcttgcatccaaagattccacagaggaaccaggcgtctcttcctccatgctttctccatctgggggtacctttgtgcttgctaagtcgggtggcccaacctcagacaacgctggttcttcagtgcaaatgctggtcgaccacctgctagaagggccgcaggagatacttctggccacctttcgaggtaccttacaaatggcttcatagtcagaatcagcaacccgcaaagcggcacaaccacggcatctcctgggtcggtttccagggccttctgaaccatggcagctgtgtggctcctggatctgatcctcattctccacccagcactcaaaccctgaataggcgaagtcctcctggagcagtgcagagtatctcgcatcgggtaagacggacatgtcaaccgtcccattccccgccttgatctccgcgccagagtcatcgttattcttccgatacatactggcaatgcagaacttgaggcgatccttctccagtagcagcttttgcaagcgctcaatagaaagcgcttcaatccgggcaataactgtgtcgaatcgatagattcgatcaagcatgaaagcacacttgctgcaagcgaactcggctttgccatcgcgggggacatccttgcccaagacgtgcgaaagcagaacctggagattgagcttggacgccgtgtggaagatccagcgccgctggtttccacacagctctcgggcacagatcctgcaaatctccttcatcttccctcctagcgggtggcaagcttcccgaggcggcggcggcggcggctactgggtgaccactcaatggctcttcgccgcgctctgtctcccgcctcggtggtctccggtcagcatggcacagcccagtggggtccccactctgcaggggcgcgcccctgccccgcgcgccgactccgggtaccagagccgtcagccccgcccctcgggcagggggcgggcgtggaaacgcctaagaggatgctgagtgacagaggcgcaggccgcgctccgaccctgccatgtctctccccagctgtctctcccgccagccgccgcgtcctcaacgtcctccccttttagcagactgggctcccggagcagcagcggccggccgcgcagacgcaaagcctcggggatggaggatcagatttcaagatggcgccagcggcttcgcgtctgcggcctccacaaggctcttctgggagctgtagtccggtcagcgggcttccggctctgcgcatgcgaggtagccagcgcgaccctcgccccaaatccggttgcacacctggctcacggcgagtgcggagcagaaagcactactggcgcgggccacagccagccgctttcatctgctaagacctcacctgaaagtcgcaccagtgccctcaaggatcctcccgcctctgcaggatgtcgaggctcctcctcgcggggaggagaaagacgaatcccctccctgcattctcggacagtgccacgtcctccggctgccagcggggcagcgccgctaggtaccgctgcgcgccgcccccgcttcccgccagcagcctcacctttcccggccccgccccgcctgggttctaagggcctgaggctgcgaggcaggcgagggaaggcttggtaacggaggggcggggccgtgcaacccttacctcgactctgaacaggaatgtccagaaaagagtagaggagtgtttctcccttgatgtgggtgggggagggttagtacccgtgggtgacttgcccttctttagataaaaaagcacagagcagtcacctgagaaagagtccggcacatacaatgtgaatctggttaaccaagatcttgaagatagtagaagagaaatgggcttttttaaggatgcagccagccgcgagtagattaccaccattgaagtccctttccctcaggtagagggcagtcattattttaggacaggggacggtagacaaacactagcgcaaaagacagtgcttctttccgtaagagctggagtgtctgggaatgcagctcgcgccagaaaggactgggaacttcactgacttcggtgaaaaccatgtcttactcagcattgtacagtgataggtcctccacccttgggtccaaaacttagattgcacacaaagaggagggaagctggagccctgactaggtagaatgctggtacctccggccatttttaataaggaattatcttcctggcttgagaggcattcagacacgtaacaagaggaacaacctcagcaatcacttgcagtcccctagagcaggacatttcccagttctaatcatgctaaatttttactaacttgaccttgtaagctaaggccagcaacatctaagtttttctgaacctcatccccaggacagagtccatactcctaagcctgaagacatccaaatgccatctctgagagttcataataagcccccaaacttcttattgaagactaaatgagatgattttgaggaaatgctttaaccgtgtttcgctcattaaataatagctaatattattattttactatgaattggaatattttcagtaactttaaaacattatggggccctgcctacataagattgtattgttctcttaatcaccaaagcaaaatcttgtagctccattgtaagagaaaaggacagttcttagagctttgggcttagtaggtgatatgatttgaatatatggccccaccaaatctcatgttgaattgtaatccccagtgttggaggtggggcctggtgggaggtgtttggggcggtggggggggcagatccctcatgggtttgtgctacctttgcaatagagagtgagtttttctgagatctggtcatttaaaagtgtgtggtgcctccaccgctccatcttgctcctgctctggccatgtgacttgtttgctcccccttcaccttcctgaagcctccccagaagccaagcagataccagcaccatgcttcctataaagcctgcagaactgtgagccaattaaacctcttttctttatacattacctggtctcaagtatgtatagcaatgcaagaatggcctaatatcataggctatagaattttgcatatgtaatttcatctactatgtatattctgactcaaaaaccaagaatagaaaagcagttcaagtaaaaccacagctgcatttttgcctgcctctaggtatgtgagcttcaaagttggaagaaattaagcaacatgctttggaatctatggtgatctatagaaaggcaaagtttctggactcaccctgactgatggaaagacagactgcctgccaggacactaccctgctgtacccagtcttaagtataataaagatctcattttttactgtcaatgcaagccacattttcctattaggaaaatgtgaatgaaacaaagtgctcttcaagagcaaaccctgaattatattttgggttattctctgttcctcaaaaggattttgcatctaactgatagtctccaaattgtaatgacagtatatagatagcttggtgtagacatacaggtcaatacaaatggagaaaaggcaatttgccattgaagaatatgtttgctttaagtaaagatcaatatactaagaaagctatacatatctagacttccaaaaacagatgggaataaactactcagcaatcagaatattcgaagatggcactctgttcacttccagagaaaatagttcaaaactgtatctcaaagtggatataagctattgtactagaattagtccctgtgtgagcatttggcattataaaataagatgttcccaattaaaagatcactggtatgtagataataaaacgtgaaaataaaaatttaaaaataaaacaaaaattatgtgataatcaattttgcactccttggtccttaccattattatcttgtggtcaagagtttgcagttgaactggttacctatggtggggctacacaaggacatttactttttattctacatactgtgtatcatttgaattttggacaatgaatgtttattcaggtattaattttagattttatttaatttagaaaacattttatagttaaaataagggctgccaatttaacacactaatgtcagggtctaagtggtaaaacttgaacctaaaataagaatttttatactacctatgataaatatataatataagaagataacttatataaacaaaagttcaaaggggatccacaagttattagtaatggttatgtctagagagtggaattatggacatttattttcttttttccttattttctataattttttacattatgtattacatactttaaataactttaagtacttactgcttttgtacttaaatatataaaaagaaaaaaatataattgttactaagaaaaaggtagatgaaacacattttggtgtattcatacaatacaatacagtactagccagcgatcaaaaagaatgaactcagatacatgcaacgtggatacatcttgaaaacattttaagtgaaacaagccatatgcaaatgagtacatcctgtgtgattccatttatttgaagtctgacaacaggtctacagccgtactaccctgaatgcacctgatattgtctgaagtctaataacagactataggaaaaacagatctattgtgatataagtcaggaagtggttgaacggtgagagacagggtgagaagtgattgcaaaggggcacaaagaaattttctgaggtgatgaagctgttctgtatcttgttttggatgaagataacataggtgtatagaattgttgaagctcattgaactgggcacttagatctgtagattgtatacatagtatatttcaattaaaaagattaaaaggagtaaataaaactatgtgtttccctcaaaattttaatttgagggatttctttggtagaaagtcacccgcactttaagaacagttttgaaaattagggaaatgctataaaatatagcccagaagaaattctgtaaaagacccaattgcaaattaaaaacttaagcctatccatatgagtttttttttttttttgagacggagactcactgtgtcacccaggctggagtgcagtggcacaatctcggctcactgcaacctctgcctcccgggttccactgcgccccaccttaggataatattttatatgcatatgtacaccaaacacttatgattggaggaaggcatgttgttaaggtgagacttagggcttttgtaatgatgtagtataaaattattacttctaaaacgtagtgaaggcacataacgaaaagtttgagaataagcttcatattatgattaaacaaattattaattttatatatcaacagttcaccctgaacattgattaataaatacatttacaagcatttacttgctttatggcctaggttaagtcacttatatctggcttttaatttcctaatctacaatgaaatatgttgaatttaaacagcagttttcaaacttaagcatgcatcagaatcacctggagggcttgttaacataaattgttgggacctacccccttgagtttctgacacaataaggtctggggtggggctcaagaatttgcattcctgacaagttcccagatcatgttgatgctgctatctgggaatcacactttgaaaaccactgaatgagaactatcctaagctgtatcagacaacagatcagaacttctgcagatagacagaaaagcacaccaatgaagaactacttacaaaatctatgttgaatttagagaactgtatccgcatgtggaacaagatttctaaatattactgtggtatggggtgttttgcactatctctgttttgacctctaaattttgcagtcaccatagtcacttttgcaccccctgtgtggcaactgggttgtagtgtttctaagacctacttctgggctgagagggagtttccaaaagaattggagaggtggaaaatccccatgtcccaaaccagttgtattaggtttcactgccctagttatgacattggaaatagctattctaattactaaaaactatgcaccaaaagaaaaatgtgattctggcagagaaactaaggcagatgagaaaatgcaagaatgtcaaagtaaagccagttaggctttgtggtaacacacaggcagttgcgtgatttccctgtgctctttggaaacctttaagaagtcagaaacaatcatgctttccattaattaacaacacagcatcttgaaatgcttgttttaaagccaggagatttccggttcatctgcagattatagtagtatgcttctcagcaaaatccatctaatagtaaacattagagtctttcaagttattaaatacgcataggttgttaagtaaattttaaagtatttgttaaatcaatcaatgagcaagaatgcaaacatacctttttttctctcttcaatgagctttcagtttagttaaaagggagaaaaggtgcacgctacagttagaacaattgactggtaaactaaatggtactgaattaaatttagtgtgaatacagaaaaagtagaggttagtatgggctggtatagttgaagggacaagagtggcacttgagatgggtgttaggatgaagaaggccaaggaagggactcagcaaaataaaatagcttcattaaaagccacggaacttgggttaaacacagtgctagcctgtaggtaaagagagatgttggggatttttgaatgaccaggttcatccatccatacatctaatcctctatagttgttcattcaaagaacatgtatcaagagccaactgtaagccagacactatgctatggagtgccttgccaattagaatttggttaatgttttgacaaaggcaaaagaatttggacttaatgttatggatttaagcagacaatgacatgatgaaaacctttttttaggaagattacccaggcaacaggatggatggtacttcctttttttttttttttttgagacgaagtcttgctcttgtcccccaggctggagtgcaatggcacaatctcgactcactgcaacctctgcctcccaggttcaagagattctcctgcctcagcttcctgagtagctgggattataggcatgcgccaccacacccagctaattttgttatttatttatttatttttttcaatagagatgaggtttcaccgtgttggccaggctggccttgaactcctggcctcccaaagtgctgggattatatgcgtgagccaccgcgcctggccctctgcttccctcttttctaatctgatggttaagcccttagcattcccttgactctggaacttttgcagagcaaagagcagaggctgtttgaagccagctgcatttctagacttttatgaaattctaagcccactgcaaagattgagccagatgtcccattggggaagagaggagagagaaaagtttttgaagtcagcgaagaggagagagtgacatttcacacagatggaaagagactggaggtcaaagagtaacaagtacccacctccattccatatcagtgccctggagaagcagcaggacctcagagagggaagtaatggggtgacttggagaggctgcactttagcaggggattctggctccataaaaggttaaatatagcaagcttctagggttggcaaaaccatgcttactgaggcaggggtggtttagtggcagatcaacgatcagagtagtctccttggtgctttggtaccaggtaaaacctagggacctttaaatagctgagaaagtagggagaggaggaaatatcaaacgtatgaaattgaatttctcaccatcctgattcagacaggggctttaaattgatgactaccttagatttatgaactaagagtcatacactatgaacttttgttcattggtgctcagtcctagacccttttcacctctctattctcttctggtgtcatctcatcctttcccatctttataccagtggcttccaatttatgtttttattgtagaattctcatctgagtgccactctcaaatacctggttacctatttgatatctgcatgtggatgtgtcatagacatctcaaaattaccgtaggaaagactgatctcctgactgttgtcttccccttgtttaaagtgcctccctttcctcctaatactttatatgaggagtcagaaaactatggactgtggaccaaatccagcccccacctgtttgtgcaaatacagttttgttggaacacagccatgttcattcttatgtgttgtgtgtggctgtttttatgcaacaatggcagaaactttacagcctgcaaagcttatttactatctggccctatacagaaaaagtctaccaattcctgctctttgctttcttcaatgtatttatcacaatttgaagttatatatttgtttcattatctgcttatttatctgcctccttccatagaaggtaattctctagtgcctaccatgacagcaccattgcctagtcatggtaggcactcaattgttattgaatagaatgtatgaatgagaaaatgaactattatatattaaaattttattttggtcttttgccttagcacaaaactttcatccttccttaccctccaatgacttcatatctttgttttgttttgtttttttctgagacggagacttgctgtgttgcccaggatggagtgcagtggcactatcttggctcactacaacctccacctcccgggttcaagcaattctcctgcctcagcctccccagtagctgggattacaggcacgcgtcaccacacctggctaatttttgtattcttagtagagacagggtttcaccgtgttggccaggctggtctcaaactcttgacctcatgatcctcccacctcggcctcccaaagtgctgggattacaggtgtgagccaccatgcctggccctaatgacttcatatcttaagtaacaagagtgctaaaataatgagtcccctcaatttctttgccctctactctatcctcctttcagattaatctttctaaaacagagctcagatatcactctccctcaaagaaacctggagacccaatgacttgtccattaatcctaaacttctttacctgcttcttaaagttctctgaatctggctccactctatttttctgtccccctatattctattcctgctactacttctctaccctgaacttccccacctctatacttcatacacttggaatattcttttctatcactaccacctccacctatcaaaatcctatccacccttcaagtatttcctccaagctgcctttctgagtaccaccaaaagacatctttctcttcttccatcttccaaaatacttttttgtacctatagtaacttgtatgtcatttctccatactgcgttctccccattagctggtaagctacttaagaaaaggaaccacagctttctcatcttggtatctgctatggtttgaaagtttgtattcccctccaaattcatatgttgaaatcctaacccccaacataatggtattaggaggtgggggctttgggagagattagtgtccttataaaaagagacctcagagagttagctaatcccttctaccatgtgaagacacagcaggaaatccataaaccagaaagtgggccctcaccagacactgaaaatgccagtgccttgatcttggacttcccagcctccagaactgtgagaaatgaatttctattgtttataagccactcagtctatggtattctgttatagcagcctgagtggactaagactgcttctgaagtatttggaacagtatctttctagatctcaataatcattgaatgaatgaataaagaaatgcctttccttttcatatctacttggtaaaatcctactcattcctcagagaccaaaatctttgcttctgaccccagtccatgatgatttttcctttctgtactgccttgtatttttttcatcagtgactttctcctattgtaatctctagaaggtagagactaaatcctgcacatctttgtgttcttcttccttcacctaacagtaccttgtgcattacaagtgctcagtaaatatttttgattaagttgtaaagcagctgcctatttttccacttcctttgctgctcaaaaggattagagcaatgattgctttagctgctaaggcctgcttcagagacacattattaatgaaggttgtctgggagacagtaatgttgaacggggatttgtaaatgagtctccagcttcaacattcatcagcaaaagaaggggatactgaaaagctactctaaaaaaaaatctcatatgaagttgtccggagctgcctgagctactaatcactgcaaggttttcagtctctgccttgagcatttagagcacattcttgccttaacctccaagtcagatctctccatggtaacgcaggaatgtttgctattttaggaaatatgcctcactgcatgcagtactatttacattaagttccaaacaaggcataaatgcaacagcttgactgtgctaatttgtgtgagtgggaaggtctcacttacttaatgtgggcctctccctaattgtgttatcctgtctcattttataagccaaccacagtgagattacatgttaataaattttgctcatcttatactgaaggagaaatgcagagagagaaaaaaggcgacaaacaaaacaagaattcctccagacctccctttgcaagggcatcattttttctgccttcacaccctccaggtctggtttcatttaaaaccttcattgagatgaagcttctaacattctgtagaaggaaataatatcaataactgaaacaattgctagcttttccctgcaactttgtagatacctttactgaggaagagaaaaatgctttgtaaactttattagattttctgactccctagtgaaaaagatgtggacaagatgtcacagcctcacatcaaaaagctcctcaacactctgatcacacatactattgatctgaatggacatcaagaaggattggaaggagatatggaatgatgtcagtcaatggcatatctagttggtggtactttttttgctttacaagaagttaattatagacgttcataaatactgtgcaagtgcactcccactaaaatgaatgttgtagaatgttttggtagaatggaaaaggaaaacagctagaaagactgtaagatcaattaaataaaataatctttatcaaaagtgtctgtcttatttgagagaatgaagactctgaagtgaacttcctgtactcagatattacagtgagtatattatactcatactccagactttcatactgggatcacttgagagatagttatctgtgggatgtggagtaaattagcgttcttcacttggacaattcagacctagaagtgcaagatctgtgagctcttctttcttctagggcccaactgtttgtggtattctcagttgtgaagtataggtggaattaaaggaagtgaataggtctttagaacttaagctcctccatactccagctgaatcagtgagggattccagggatggcttcactggagatgaggagattctttagcctctgaagaacaggcccagagcttagaaattgaacttttaccttccacattgtaagggtctttcttctgtggtgacagttggcatggcagacaaggtttgagtagaatacagtggaactataactgttacagtgaaagtatactgttagcagagaaggataacacccacaacataggctccaagtgtcacaaatagcaaggttcaccatacattacctatgcagaggggagagacaaagtgctttgtaattggttttataatattcttttccccaaccaattcaaagaacagacttgacaaagcagttcatagctgtgtcagattatgatttgctctctgaggaggtgacatcaattatctcagatgctcttcaagcaatcctcagtttccacgacaactaggattacctttctaaatgcaaatcatatgcttttattccccttgctttttttttttctggtgcctacaacatgaagcccttagctcaacatttatggtactttccagctatatattttatcattctccaatacttatttttggtaacatcgattactcccaattccttagctgtgttccacatcactgtatatattgctccgtttcctattttctgcctggtgtatccagtctttaaggcccaacagaagggtgacctccaggtgagttcctccttggagttaattcctttcagctgtgggttcctttagcaccatgcgtgtatttctgtctcctcatttatcacactgtattttagttctttgtttacataccagtctttcactggactataaacctttggaaggctaggactccctatactagtggtactcactgagcaactgtctcatctcctagagagcattttgaaattttgtgggggtgtttcttgtttttgatgttgtcacgatgataagtgaggcaagggatgttacaggacaaagtattgtaccaaattccaaatgacttttggaatttgaatgttccattgggtgatgataaaactgtttacaatcatctgaacctagaactttatataggagcatgatgttaatttacactaaatttttccatgaattaaactactatgtaaattgagggaagacactaccagtccttgggcccaattttttttcccataagacgtagacccaaagggagaaacaaggaaatatgctatgggaggctttctattctccacacttgagaggaccaactatcagcggcctcctgtggcagagctttccaacttgggtattccagcacagtgtacctcagcatggtccaccactgtgcaaagatgctgatcccctcagctctcagggtggtgcatgggtcctgaggtggccataagcaattgcctcaaaccatgagcagccatgggcacttatttcagaataccatagatgtacactcatttcctatgaaaatgaattttctatgaaaaagggtaggaaacattgtcttatagaacaaacagcgcaatgtatcaggttttgaaatgtacaacgtattgggtaataacaacaataaatttttattaggcaatgtttaaaaagcatatcaatttagtacagtttatatgatttgatgcatttcttctgcccaatggtcatgcaatattatcccctggatgctgtacttattcttgttctaagcatccttttagagtagaatataaataatttagtctctttgaaattataatcttttggttctttaagtctgttctgaaaactggtaccaaaccaattccttaattagcattgaaaatactgaactaaatatattcatttcagtgcttaccaaagatgatgaaaataagtatatgtacaaaatattttagtatttatgtgcctgtaaatacaaaaggagcaataaaagtgatttcatttcagaaggtgaacattttgaaagaaataatattcatgtaaattctgaactaaaatagaatgaaataaaattctgaaataagataaaaatagaatgttagcattataggaaactatagagattatttgagctaatcttctcattttatgtatatggaagctgagaagtgacatatccatagtcatacagctaataaataatcaggatggaatcgcttctcggccttttggctaagatcaagtgtagtatctgttcttatcagcttaaataatcaggatggaaattcaattcttcttattctcagttgagctttttctaattaaatgtattacgaaatattttcaagagtcccttaagaaaatttccacatatttcaacatgtatcttgcaaaaagcctatgaacttcaatttgtattcatacttgtaaaattatgttcacacattatttcttgagtttgttaaccaatgctttccaaccaaaatggagctgcagtctaagaagtttgtaattgtggccaagatagtaattttttcctgccctcatagtggcctaagcacccaaattggccacctccaagtgagaagcttcatccatttacctctataccttacaaatattatcatttgccatgaaatggaaaggttgggaagcagtggtttaaactaattcttatcattgctcttttatcttgaccccaacctttccatatgtgaaccagtaaagtaaaccacccacattttgtcttatcagtagtctaagaccagtgcaagaatgtaaggataccaggtaattgcttttgttgtttgggtgcaggtatattctaaagttcttttagaaaatatctttttagtaaattaaaagttgaatgaaggagaggagttcccttcgaggtaacttcccagaaaatcaatgcaattattttttaccacagtgagttctcttttcaatattaaaactacattatggccaggtgtggtggctcacgcctgtaatcccagcactttgggaggccaaggcgggcagatcacctgaggtcaggagttcgagaccagcctggccaacatggtgaaaccccatctctactaaaaatacaaatattgctgggtgtggtggcatgcacctgtaatcccagctactcgggaggctgaggcagaggttgcagttagccgagatcatcccactgcacttcagcctgggcaacagagtgagactccaactcaaaaaaaaaaatttttttttggaggcaaatttctatcattatctgatacacttggacggaaatagtaatcaccatttcaactagtacccagcacattttcaaggacctggaaggttcatactccaatatatacaaacagagaatatgcctagctcatagatgatcaataactgtttatttgaacccatagtttgtgtacttcggcacagtattttacaacttaaccctcaaaaaaacccctaaaacattgtatgttctgtataattataaatcacttgatgtggctggcaaattctaaggtggtccctataattctcacccactggccatcacatctttgtgttatcctcaccccttgaggatgggtagaacctgtaacttctaaccaatatggcaaaggtcatgaaatgtcactgcatagttatgctatgttatatgaaaaaagtaaagaggtcatatagatgtaattagggctgctaatcagttgattttaagttaacgaaaagggatattatgctggtgggcctgccctaatgagccccttaaaagaaagtctagaagtgagaaaagtaacagactctttctgctgctggctatgaagaaggaagctgccataacttctacagctacacagcaataaatccttccaacagcctgaggagcttagaagccgatccttccctaggtatgcctccagatgagaaaagagcccagtctacatcttgatttcacacttatgagactccaaacagatctcagctaagccatatctggactcttgactcacagaaactgtgagataacaaaaataaggtgttttaaactgccaagtttgtagtaatctgttacacaacaatagataacaaatacacttagatattaaaaagcagggcttatgaaagcatgaagcaagtgcttctggatgtactgaccaaaccttacctgcacttccatgctagttggctcctccaacagatgtagcagttgttgtttctcccgagatagctgttctacaagcctctcctgggcagccaggctctgattcagttcttcaattctcctgaagcaaaggaaaagtaaggacagtaattatgatcatgatactattattaccttattttttcagcccattccaaagatagcatggtctagtatagcaggtttttatccttttggatcattgaaccttttgacacatttgtttagaaaaccatgtattttctgcccagcccccaaatatatacacaaacaactttttgcttacattttcaccacgttcatggacctcctgaagttaatccatggatctttagaccataggaatttaactcttggaataagggcctagaattttttggtggtggtggtagtggctgttccattcaataaacggttcttggataactattttgtgtactcaatgcactctaccaagtactggaaatatgaagttggaaaagaaacaatcgctgttttgcaaaaatttaaattccaccagcatgtgtttgctagtgatttggagagtaagaagacatacagctacagtcacgtaccatatactgtttctgtcaacattatgtcatcatactgcatgtatgatgatggtccaataagattatactggagctgaaaaattcctatcacctagtaaagtcctagctgcagtaacatcatagtgcaatgtatttctcacttgtttgtggtgttgctggtgtaaagcaaacctactgcactggcagttgtatacaaatataacatatgtatagtatgtaatacttgataataaatgttactggtttatgtatttactatactttcattgtcgttttagagtgtactctttctacttattaaacaaaataactgtaaagtagcctcaggcaggtccctcaggagctattccagaagaaggcattgttatcataggagatgacagctccatgtgtgttattgtccctgaagaccttccagcggacaagatgtaaaggtggaagacagtgaagctgatgatcctgacactgtgtaggcctaggcttgtgtgtatgtttgtgtcttagtttgtaacaaaaaagtttaaaaagtaaaaaaaaaaaattaaaaatttaaaaacagaataaaccttttctagaataaggatataaggaaaatatttttatatgactacaaaatgtgttttaggccttcacattcatccacttcactactcactcgctaaatcacccacagcatgttccagtgctgcaagttccatttatggtcagtgccctaaacaggtgtactgtttgttatcttttatacagtatttttactgtatcttttctatgtttagatacacaaatggttaccattgtgttacaattgcctacagtattcagtacagtaatatgtcatacaggtttgtagcccagaagccataggctataccatatagcctaggtgtgcagtagcctatcccatcaaggtttgtgtaagtatgctctgtgatggccacacaatgaagaatgaaattgcctaaagatacatttctcagaacatatccctgtagtttgtgatgcatgattgtatataagcaaataatagtaatagaatataataaatgctaccagaatagaggcaccatatagtacattgagtgctgccatagagctataggatgaaagataaagaaataattcatttgacttgaaggagtatagcgatgctcaggagaagaaattttaaagattgagtggtttcagagtaaacagacaacctacagaatgggggaaaatatttgaaaactatgcattggacaaaggtccaatatccagcatctataagaaatgtaaacaaatatacaaaagaaaagcaaccccattaaaaagtgggcaaaggacataaacagacacttcaaaagacgtacctgcagccaacaagcatatgataaaaagctcaataacactgatcactagagaaatgcaatcaaaaccacatgtgataccatctcacaccagtcagaatgactatggttaaaaagtcaaaaaataacagacgttagtgaggttgcagagaaaaggaaacacttatacactgttggtgggagtgttaaattagttcaaccactgtagaaagcagtatggtgattcctcaaagaacaaaaagcagaactaccattcgacccagcaatcccatttctgggtatactcagaggaatataaatcattctaccatgaagacatatgcatgcaaatgttcactgcacactatttacaatagcaaagacttgggtggttttccaggctcagaaggaggagattgaacaaaggaacaaaggcatgaagacccagtgtacaatttgggaagagtcactggaacaaaggcccagggaagaggcaatggctggagaagagactgaaaattcagaccctcagactagggttaagttgtaaaatactgtgctgaggtatacaaactatgggttcaaataaacttattgatcatctatgtgctaggcatattctctgtttgtatatattggaacatgaaccttccaggtccttgaaaatctgctgggtactaaatgaaatgtttccagttgtgattctttttttttttgagatggagtcttgctctgtcgccagactggagtgcagtggcgcaatcttggctcactgcaacctccacctccctggttcaagcgattctcctgcctcagcctcccgagtagctgggactacaggcatgcgccaccatgcccaaccaatttttgtatttttagttgagatggggtttcaccatgttggccaggatggtcttaatctcgtgatccgcccgcctcggcctcccaaagtgctaggattacaggtgtgagccatgattcccaggagaaataacttttaaaacttaaaaacattgggctgggtatggtggctcatgcctgtaatccctgtaatcccagcactttgggaggctgaggcaggcggatcacctgaggtcaggagtttgagatcagcctgaccaacatagtgaaaccctgtctctactaaaaatacaaaaattagctgggcgtggtggtgcacgcctgtaatcccagctactcgggaggctgaggcaggaaaatcggttgaacctgggaggcagaggttgcagtgagccgagatcttgccactgtactccaccctgggcaacagagcgagactccatctcaaaacaaaagcaaaaacagaaacaaaaaattaaaaacattatacaaatgtaaactgcaatgatgacgagaaggaggaatgtggactccatatgaaattccctcatggtatctgcactagaacatctctacttttcttaaacctcaaactttgctcatctctttgacccttagtctccacagaggatctgttctcctactctccaaaattgttcaaggtcatctgatgagtggcctcaatttattttcagatgtgcatgtgctttacttggggttttgttttggtttttagttcagtttttttttattggggttcaaatatgacactgtcttggggaacctagtagggaaaatctgaaagcaaatacagtaccatactgagaattgtacaatatgtatatatataaaagaaacaatacagaaacttcattctgctatcacaaagccttcaaagaaatgacgattgatgccttagtgaggttcactagaagggaaaaagttggcagatgtttcccacagaaggaaaagcatgagcaaaattctggagacttgccatagcttcttatgcttctggaggcagtatggcttcagggtttggatgtcagcaatccctgaaaccatgtttcacaagtctccagatgccaattttttcattaataaagtataataattcatatctcatggggctgttaaacaagaacataaagtactcagctgtatggtaagagctcaacaaagcttagccatcattattattactagcctggcatgaatgaagttaaggaatggtggtgggtgatgagtgtgggagaaatcagaggttacatcataaaaggctttgatggtcacattaggagtatggatcttatctcctaaaggtattgcaaagcttcttaaatggctctgccatggtgcgattaaatttatgtcttggaaagatcacattggtcatggtatgcacatgtggtttttgcctattcagttaaaagctccttaaagctttttataccaccacagtcttatgcacctaagaggctaaattatttgccaatttgttgttgttgaattatctatttcagaactactctgaattattaggttgagattgaatgagaggagcaggactggaagtggagaggacatttagaaagtttcctcggtaatccagacagtagatggtggtgacctcaataattgcccagttaccttcaggacaaagtccaagttccttataatggtatacaaagctggcacaatcagacccctattctcaaaacagcttacctctcacttgtcttctcacttgctccagttatgtacaattatttaaagttcttgaaatattcctttccctgtgtcttccctccatagtttctccttctgcatagaatatttcctttccctatccactttctacctatttattctacctcctattcatccttcaaagctcagctcagatttcgcttcctctaggaaaacttcaatggcattatcttagtctttttgggctgctataacaaaacaccataaactgggaggattataaacaacggaaatgtatttctcacagttttggaggctgggaagtcctagatcaagtcactgacaggttcaatgtctggtgaaggttcacactctggctcataacggtgcattcccactatatcctcacatggtagaatgggctaactagctctctggggtctcttttacaagcgtattaatcccatttatgagggctccatctccaatgtctatgatttaatcacctcctaatggctccacctcatactacttctggaggcagaagtattaaccttaagggttaagatttcaacatataaactggtgggggagggaggtggggatgggacacaaacattcagaccacagcagacaacttgctcttttaatgtggaatggatgaccctccaatatttccccagagcaccccatgctcttctatcagggaacttattaaaatcatgtaacatgtttcttggtgacaagaattaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatggataccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcaccgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaatggggttatttgtttttcattgttcaattgttaaattccttatggattctggatattagacccttttcagatgctagttgcaaatttttttagattctacaggttgtctgtttactctgttgatagtttcttttgctgtgcaaaactctttagtttaaataaatccgacttgtctctttttgtttttgttgcaattgcttttgaggacttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgacaggaatagtgttgaatctgtagattaccttcggcaatatggccattttaatgatattgattcttccaatccatgagcatggaatgtttttccatttgtttgtgtcatctatgatttctttaagcagtgtttcatagttctccttgtagagatctttcacctccttggttagatgtattccaaggtatttttttttttttttagcagatattgtaaatgggattgcattcttgatttggctctcagcttgaatgttattggtgtgtagaaatgctactgattttttttttttgagacggagtctggctctgtcgcccaggctggagtgcagtggcatgatctcggctcactgcaagctccgcctcccgggttcacgccattctcctgcctcagcctcccaagtagctgggactacaggcgactgccaccacacccgcctaatttttttttttctatttttagaagagacggggttcaccgtgttagccaggatggtttcgatctcctgacctcgtgatccacccacctcggcctcccaaagtgctgggattacaggcgtgagccaccatgcctggtgaaatgctactgatttttgtacattaatttttgtattctgaaactttattgaagtctgaaaatatttttaataattttagtaatacttgtcatttaacactaagcttttaaaaaactgtaaattataaaagtaaccattttagcaatataaatgtatataaagaaaaatatcaagtcttctccctatcacggactgtgatctcactcttcctcagtatactataaatatcactcagcaacttttcccccttactttaatcaaggaattcccactaggacaataatatagagctaactcattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctcgggattgtttgatcaaaggaaatcctccttttttattataataggtagcatcccatactaaaaatgttgtcacaatttacactcactggtagtgtatgagagtgcccattttccccaaatgttatctcagctcttgatgttattataggctgactgatactttttgataaagcttatttgcatttgtctctactaaaagtggaaacattcactgtttcaatttagttgattgctgactgataggaagtttgcagtcttaggtctggtggatttaccaacttatgacaaggtccatctgacctagtaatagagaaagagcccaagggaaacacagcatatgaaaatctattgtttcagttcctgaatcagatacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcaatgttctgaaaaacacacaggcattaatcgttattaactgccacagacactctttcctggatccaggttcctatttgagtcttgccttggtccacagcctctcacctcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcctgaaaacgaaattgctggaataatacttttaatagaattatagtaatagaacaatacttttaaatgtctggggatttaattatttaaagaaatttggttgtaaacatttttaaaaacaatgcttttatcataaaattggaattttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtctggtgcaggttaagtggcttagtgtgtggtaaggagtatagaaaatagtttgcaactagtttgtgaaaatcctgctaagacaactagataggccggccacggtggctcacacctataatcccagcactttgggaggccaaggcaggcagatcactcgaggtcaggctttagagaccagcctaaccaacatggtgaaacctcatctctgctaaaaatacaaaaattagctgggcgtggtgacatgcgcctgtaatcccagctacttgggaggctgaaacaggagaatcgcttgaacccaggaggtggaggttgcagtcagccaagatcatgctgctgcactccagcctgggtgacagagagagactctgtctcaaaataaaaaaaattaaaaaagtaaaaaactggataataatcagtagaaatcaaagacttatcagggagctttaagcaaagtattggcatgatcgggtccatgttgaagaaggaattatgaagaaggtgggtgggtcaggggcaactaaccagaatagggagggggactgtctaaggacaagaggtacagggagaaagactcaaaagacatttcagagacagaagccacaggccttgatgacttgtgagattcagattagactggagggaggaccaaagacaatgctgaaatttccagcatgtcagtgggaatgcattctattaactaaaataggggcaggtttgtaggggaacctaaggaggtttctgcaaaatgttaattgagggattactttatttcagcttaaacgttagcatgcaaagatggattagtcccttccctgatgaagtccataatacagtattaggcaagaagaatgttatttagtaaagaagtctttagatcagaggttgacagagagactgaaggtaaagtagctaaagtatgaaaagtagtattgtgggtactagaacagtagggaggattttactttactatcgccatataataaccaccaacacctagacttctagaagtccaaggcaacatacaatagcagcatattttctaccatacttgtgaaggcatttcataacccatgtttccatgcagggtggtcgaaacacaaatactaattgggaaaagtagaaacctagtttagatatttgagagttacttagaattaaagaattttagagctggaaggcagttggactcaaggcattttagatcatattactagtatgtttttagtgacatactgagaagaatgtttgttcccctcataagtaggtaccttttgaccaaggttagaacatagattcagatccagtgagatgaaaatatcctaatttcttcaaaagaaggaatgatagccctgtcttttcaggatatactttaaagttattattttatgaacactaaatagcattaccagatttagcaaataaaaatataagatatctacttcaatttaaatttcagataaacaacaaataatttgtttcattagaagtatatcctttgcaatatttgagacataacttaaacgctaaaacattgtttgttgtttatctgaaatttaaattgaattgagtaccctgtattttattctgcaatacaaataccaaaagattaacaaatggaaacacgcatatttcaattttgtatgaagaacaagtctaagatctctatatcagttccatggcctggcactgcaagaataattcatctgtaccaattgatgaatcagtaaaatagaagatttgctaaacagttgctatgtccccagctttgtggtcaatacttaaaggaattcaaatgtcttcataaaaaatagtccctaagctagaggcccttcatagaggtgaaggaatatgcattcaattatgtgggaaatgcaaagagggagcaacttcctaatctgtaataggcagataattgtattttcctcattcataaacctacctgagaggatcgtgaggcataaataaatcaatacatgtaaaggacttaggacagtgtttctaacacaggtataactataattttaattataataatattattatcaccatcatcatcaagaacaacagcattatcatttggaacagcagtttgctttccatgagaccataatgtttcaagtggattcagtgttcaggatatggtgctgagaaagaggactcctaagtttattattatttctgccaccaattgattcacttctgtgaccttgggtaaaattctgctaaggcttctccacctggaaaatgacaaagagtgggcaaaaagctatttaaatctcatatgaaagaaaatggaatctataattatgaagtgttattatcaatgatattcctatgcctggctaatttatataaatcagaaaagtctggatatgctaaaccacctcagataagccaaaactgcttgagcagattttttaaaaatctcatatctaaaaatacgtgaggtctcaaatgactggagctatatggatgtcctctgcctagttcttagtctcatgatgtgacatagggaatctctatcaggtataaactgatcaacagaaagttccctgaaaagtcccttactattaatactatttttgcatgaggaatctttgaatattcaaataaaaataaacaaacaacagggaaagtgagaggcactatgaaaccaacctaaagccagaaagaattaggttcgaatcctggctctatcactttcctgctaggtgaccttgggcaggttaactaatcactatgagcctcagttttcttataagtatagtgtggttgctttgctttttaatgaagataagtattcacgagggattctgtgaggattgaatgagacaatgtgcatgataagcatagaacaatgccttgcacacagctgtgcaacaaccttgattcactttcccttcatgtccaggctgactagtgccagtcagagaccccagccttaccaggaaaaatacttagatctaaaaggaagaaaaacagaggacataaattagtacgttctatctgttctaaatcctactgaagaaaatgaagtcaatgctttgaccaatttggccaaagattcacagatttgaagacctcagcatttctgtgttctagttctcttagtttaaagacaaggaaattgaaatccagaagggttacctccaaggtaaaagccgtaactgaaaccaacactccactcttgctttagccttttatcagagagaccagcttagcaaacactgcccagttttgtctgattttgtagaatgtggtaaattatagaattagagaatgtgctgcatttagtcttgaaagaatatatggaggcagtaagtatagtggtcaagagcataggctctgaaggcgagaagggggcttgacaagtcacctgccctctctaagagcctcattcacctcatctatcaaggagataacaatgataccaatctacaaaggatgttagggagactaaatgaaattatgcacaaaaatcacatcgcacagtgcctggcatgcagtcagtattcagaaaatgataactattattaactataaaaacaataacaatttaccctctctaactaggatagctgaaatccagaagggttttcaaggtaaaagcaataatcttacatcaaagtctaaccttcttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgttcaaaaagcatttaatatgtgatgcaggtccagctaaagaagaaaaaggaaagaaagaaaaaaccttttaacgatttttaactgtacagcgattaaattatacacaactggcctgataatagagtctattcaaaatttgacctcaatctacctctccagctttatcttccattattatctgctagcctaactggatttcccaaacatgccctatgcttcttggtgccacatcattgtgtgcccttcagcttcatggttaaatgctccgtcccctgtgaagccttactttatctctccaaattaaaagtaatttctcatgatgacattatgagctttcaaatattcttttcatactgcaacattggcatcccgtgtaaatgcttcatatttctacacctgtcttatttacccttttaaattgcaaactccctaaggacagaggaaatgatggtgtggcagaactacccaggtgcgctggttattaagatactgcctctcagcgttgtcatgctggggcaggaatttcaggataagtaaacctaggttcacatacctttctgccacttcctaactgggggaccttttttgtgtaaattacttcaacttttacaacctaatttcctcatttataaaatagggtttgcaaaaattacctcaaagtttgtagtgaggaataaatgaatttatgtaaagtacccagcacaatgtctgatacaaataaccgcagctcgggcgcggtggctcacgcctgtaatcccagaactttgggaggccgaggcgggcagatcacgaggtcgggagatcgagaccatcctgcctaacacggtgaaaccccgtctctactaaaaatacaaaaaattagccgggagcggtggcgggctcctgtagtcccagctactcggaggctgaggcaggagaatggcgtgaacccgggaggcggagcttgcagtgagccgagatcgcgccactgcactccagcctgggcgacagagtaagactccgtctcaaaaacaacaacaacaaaaacaaataaccggcagctgtgactaatctgaggtctcgcagtgtctctcacctctttgtgcagtaaaagctttgaaagagtgaaccaacaagagaacaaagaaggaatagatgacaagaggcggaagtggactaacaatgatacgtttgttgaatgagtgagaaggtaatagataatgctgtgagattatgtggaaaactttttatctgaagtctttaaaagacattctcacttttggctgggcgcgggggctcacacctgtaattccagcactttgggaggctgaggcgggcggatcacttgaggtcaggagttccagaccagcctggacaaactggtgaaacgctgtctctactaaaaatacaaaaattagccaggcgtggtggtgggtgcctgtaatcccagctactcgggaggctaaggcaggataatcgcttgaacccaggaggcagaggttgcagtgggccgagattgtgccactgtactccagccggggtgacagagcgaaactccatctcgaaaaaataaaaaatgtactccagctggggtgacagagagaaactccacctcaaaaaaataaaaaataagggccgggcacggtggctcatgcctgtaatcccagcactttgggaggccgaggcgggcggatcacgaggtcaggaaatgagaccatcctggctaacacggtgaaaccccgtctctactaaaaatacaaaaaattagccgggtgtggtggcgggcacctgtagtcccagctactccggaggctgaggcaggagaacggtgtgaacccaggagtcggagcttgcaatgcgctgagatcgcgccactgcactccagcccgggtgacagagcgagactccatctcaaataagtagataaataaagactttctcaggtttttgttttgtttttgtttttttgacagtcttgctctgtcgcccaggctggagtacagtggcgcaatctcggctcactgcaagctctgcctcctgggttcatgccattctcctgcctcagtctccgagtagctgggactacaggcgcctgccaccacgcccggataatttttttgtattttttgtagagacagggtttcaccgtgttaggcagaatggtctcgatctcctgacctcgtgatccgcccgcctcggcctcccaaagtgttgggattacaggcgtgagccaccgcgcctggctgactttttcagttttaagctaagaatattctctaataggtatattattgacccattgacaatagaagattgaatacactttaggattccagcctcctcttctactgctcatgctctccgtaagaagggctaaacatcctactcctgtgcactacattggagctcagaaatactgacttaaaatctccagatcttaacacggacttttaaagggaagattgagtatggacccagtattagatggtattatggaattatttttaagctttttgggtacaataatagtattgtggttatgtttaaaaacaaagccttctctgtgagagttatattctgatatcttcccaaataaaattatatgatgtcagagagttgctgtaaggggtggaagaggacaagatggagaacgaacagtgcagggagatcactgaaaagaacagcaaaatgttgggaaccgttaaagctgagtgatgggaacatggctccctggtaaatgggacacatacatcgggaggtactattttcgtagtctttgtttatatttgaaaattttcaaacttacataatgagaagtcaaaaggggcattttcatcccaaaaaggtaaatgtccatattcttttttattttttcattttcatttctggaattacctaaactcaggtcatagatagcaatgaaaattcggctccctgtggcagcttctttcagccaccagacttacatagactcagtggtgcagagtccgtttcccaatactgagggataaagaaaattaagcctgcctctaggcacgtctcaaacttgggagactcagaatacaacagagtatgggatacagggaggaaagaagagatgcagaaataaattaaaaacaagatttgtttaaagaggaactgcaacttctttaattgggcagattgaaccaataaaagcacagttctctcccttcacctgttatcctttagtctcttcaactttcacattgcttcactcactctcttcctctccctttcacctgctcaccttacccaacttgaactgtgccctctgatctgacacaggatgacaatgacatcagtcattacctagcagccattttttctgataactagagttctgagtgatgatagttcatggtgagataatttccaagacctcgctagccattggtggtactactctccattaaagacaagggcatttgctgattgagaaatcaatcatacaagtgtccttggaggccaccaaggctttgcctgaactgttctcagcctatgatggtttctctttctaaacctgttcttctaggttcagctcaaacatcctctcctatagaaacctttccccatcctcccagtcagaactaatgatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcgagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccatctcaaataaataaataaataaataaaaaccaaaaaaaaaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaatcagagttgtgttaaggtcagtgagtgaaggaaatgggtactgcacctttgcaagatagtaggaagcaagccagagaagagctggcattccacaaaagagtctttatttgggacaaaaatcaatatgaccaaatcccatcctaatcaattctgtaaactaaaggaatttttaaaaaataatttagcaggaggaagagtttcaaaatcttgtagggaaaccctgatgtaactcctgattattcacccaaagtgaaaagtaactattagtgaatgggttttattttaaaacctttcatttttagaatcttatctcttctaggaaaagtgtagtacatacgaattttttgtatgcagagtgaatttttctccaggcttctctgacatcaatggggcaaggtcataactctataaaacagggagaagcactgagcattttcagaaaggactctatctgtcttgaccaaaagacaaaggactggtcattgcaggatccccagaaatacattttagtagtttccaagtgaattcttttgtaaatggagtttctctccattcataagttttagagcaaaaatgaagccttagtgggtctagatatctggctaacattaactccctgtgtgaccttaaactggtcgtccccaaagctttatgcttttatacaattaacttgatttacagcctctccttcttgcccataagaatgataataccacctgcattactcatcttttacgcttatgtgagacacctagccacctatcagaaggtattcaaatgcaaagcattaagtttttacactttaatgtgaagtggaagaaagtcttgattcaaatgcacaatctctacctttctactgattccacatttgctgtcttttactagtgcagttaagtcccaaattagaaacataagtcgccccaacatgtgacaaatgtcctttgttgccagagaaaggacagtggggctgtgtcctcagccttagcaaccagaagattctgcaagaccaggacattctcctgccagagcctgctttagtgtccagtcctgttctccaaagagatggaaaaaaccaagtggaaaagtttcagtttattcaatataaggctccacattcaaatggcaaaactgctctgttcaggtcatatttcaagcccaacctatgtcagtccttagtaaaagcttcaaagcaataccagtcctttcccagcctggtttaccttgattagacaaacacagacacccatgtctgagtaagcactgagaccatggatgagtgctaaggagattaggtgtttggatagacacagctagggtgtgtgcgtgtgtgtgtgtgtgtgtgtgtgtgtgtgtgtgtagagagagagagacagaggcaaagacagagacagtgctcattgggcagaggacagagtagctgagatagtatcatttgtttattcatttgctttttcataaaatacttagtaagcacctacttggtatgtgccaacactttaataggtactagaaagagcaaaacagacagaatcacagtcttcagagaatttacagcctatggggttaattaaaccaatgattatcatagcatgtaacaaacaaaagagaaccgagaatcagctgtatggaaatgcacacaggtggcagatataaatagcagcagatacacgaatcagtgcgggtccatcatataactcctagctttagtctctaaacttaggctcccactcaactcaactcctactctaactcaagatataccataccttggtttgctctttctctaagcatcgctgttctagtcttctaaggagcaggaatataaatctacatctatgtgaaactacagcacccccaagggaaaataaagaatccagtgctattctagtaattttagggcagtagtacagtacaatgcaaagtataggcttttgaactaaattggcctgggttcaaatatgagccctctcacattctattaggttgaaccatataaaaatggagatattcaatcatttttttacagtttcacgtagttcatctctgtattctagaggtaaatcattttaacctaagtttcatttccttctgttgttagtttttttaatggtgctaatacccctacctttcagggttgtaaatgaaaagatgttaaaaaaaaatacctgacatatagtgggtgttcaataaatgttagttttcccaaagatagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgacaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatagaatcttggtcgtgtcccagaggcctctgttgatgtggcccaactgagctggccagtgagaaaacatacacataaatacccatgatctcagcgattctctcccctccccaggacattccttagcagaaccaatctctctcactcggctggagcctctctgttcacagataggcctggctgggcttaatttagcaaagggcaggccccctgcaaaagccaggggtaagtctggagcccctgtaatgccccaggacaccttgtgtggagacaggagcccagccctgccgaaggagctaaaggggatgttcagaatgtttgtttttctcagctatttaggaactggagctcacaggaaccaccctttacttccttaacttctcacataaatgttttctttgggcagcagctatagaactggaaactaagtaaaaccttactttggaatataaaaactatattaatttttctatagataaattgttgcataggaaacttgctaaatatttttaaattatctgtaacatctaacataatctgacatttatccccaaattcagctttcaattctggattgaaacatactttgatctgttctctaaaaaggacaaagccagtcactggtgttttgcaaagtctgggaccatttttcctacacagaatctcacacaataaacagacaagatattagaaactaagttctaatatctagcagtcactccttccctggaagcctggctgtgtcctgaagccaggtcctatgatcaggcaactcttctgaagctctgcttccactagagacagcacttaccctgtagactctacagatgtaccatccaggatggcaggcatgagccacatgtggctactgaacccttgagatgtgactagtccaaatcgaaatgtgctgtaaggatttcagacttagcacgcacaggagttcaaagactaactacaacaaaagaatgtgacatctcattaataattttaaaatgttgatttcatgttgaaatgataatgttttaaatgtattattaacattaatttcacatatttctttttactttttttaatgtggccatcagaaaaatttaaattacatgtatggcttatatttacgttggacagcactgttctataagatgttaggaaaaagatgtatttgctttaagtactttgcattaagacatagtctgacctgaatcacagttaatcctgtggtctcatagcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccactgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacgaggtcaggagttcgagaccagcttggtcaacatggtgaaaccccgtctctactaaagatacaaaaaaattagccaggtgtggtggtgtgtgcctgtaatcccagctacttgggaggctgaggcaggaggatcgcttgaacccaggaggcagaggttgtagtgagccgagattgcaccactgcactccagcctgggcaacagggacatactctgtctcaaacaaacaaacaaacaaacaaacaaacaaaaaaaccagaagaaagcactggcagtctcttaccgccatatcaatccatctacacatctcgggttacattctctgtctttccacttataaccatagatcaactatccatgctcctatctaaagccaaaccttccacttatgtattaattaagtcctattccccctacctctcaaaggcaacacctagaaggtctcccctgcttctctttatcaatatttcactttctaatggaaaattctgttggcatacgaacatgctattattcatttatctttctagaaatcccctatggacctcatacccttatcaggtatgccccattcctttgctctcctttgaaacaaaactcaaagtaattattcatcctcattgactccaattcttctcctcacattgtttcttaaacccactgcaagcaggcttttgtcttcaccactccaccagaattactttaatcaagatcactaatgacatccatgttgttaaatccaaaggtcaattcttttttgagacagagtcttgctctgttgcccaggctggagtgcagtggtgcaatctcggctcactgcaacctccgcctcccgggttcaagtgattctcttgcctcagcctcctgagtagctgggattacaggcatgcgccaccatgtccagctaatttttgtattttcagtagagaccgggtttcaccatgttggtcaggctggtctcaaactcctgacctcaagtgattggcccaccttggcctcccaaagtgctgggattacaggcgtgagccaccacgtctggcgggccaaaggtcaattcttaatcatcgtattactcaagctctcagcaggatttcaaaaggtggatcctgtcctcttcactacacacattcttcatttggcttccgggactccagactttttctcctacttcactggtttgtaccttctctatcttccttttctgattcttcctcttttctccaaattactaatgttggagctatacaggaccagtctctggtccttttctcttccacctggaaaggtctaactccaactcctttggtcatctcctatggtttcatggctttaaatatttaaatttaatatttaatgatctatttgctgataactcccaaatttatgtctctagccctactctatttcctgaactttagacttacgtattcaactgcttacttaatactgccacataaaatgtctagcaaatagcttacacaccaaatttccaaaactgaacccctactctccaccttcaaatctgctccatccgtagccttccctatctcagttatggcaactccatccttccagttgcttactccaaaaaccctggaattttccttgattcctttatttctctcccattctgtatccaatccattggcaaaatccttttagatttgctaccttcaccacttgttcccacatgcatcactattacctaagtctgatcactatcagcccctacatacattactgcagtgtcttcctaagagtcctcctggtgtctacttttgttctacagcctatttgcaatactgtaaccagatttatcatttcaacaagtcagacaggactggcatttgttagacccctcctctgctcaaaacccttcaataggttcccatgtcactctgagtaaaagctgaagtctttaaaatcatctacagggacttactacacaagccccataccctctggggcctcatcttccagcatgcttaatcttgattatgctgcatcagccacagtggctttcctgatgtttctctgcctggaatattcttcccccagttctctgtttggccaacttcgtcatctccttcaagttgctatttgaaaattattttctatggcatagccactttgaaaaatagttagacagtatctattcagaaaataggcagaaataccgactgggcatccctaatctaaaaattcaaaatccagcatgttccaaaatccaaaactttttgaggaccaacatgatacctcaggtggaaagctccatacctgacctcatgaaaggttgcagcaaaaatgcaggcacaacacccagtttattcagcatccccaagagaaaaacataattaccttcaggctatgtgtacaaggtgtatatgaaacataaataaatttcatgtttagacttgggtcccatccccaagatatctcattatgtatatgcaaatatttcaaaatctgaacacatctgaaaatcttctggttcaagcatttcagataagagatatttaatctatatatacttattatataacctaacagttccactactgggcatttacccaaaagaaataaaacaaagacttgttacatgaatattcatagcagcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttgaaacacgtggcaccagtaggacatatggaaacttttttggtgtgatggaagtatttttttatcttgattgtgtggtgtttgttatacagtggtatacatttgttaaaatttatctaactgcatacttaataaagtttatttaaacaaaacatgaaaggaaaaactaaaatgacatagcaagtggcaatgcaaactgccaagtgcaaagaatgagtaaagagcttggttggcatggagactaccagtctaggatgcttttattgcctcaggtcagcttggaaggccataaatgctgtgaaggtaaacctagaaacaaatcttcctgcactggtaactgtcatgtttatttgcttccctttccatcccatcctttcaaaaaaaaaaagtaaaaggtagtgtggtccacaaactaccgtgtggctccccatgatccccgcctcttggtgtttgtgcccttgtgtaactccttctctttgggtatgagcaggccctgcgacttatttctaaccaatagaatatggcaaaggtgaaggaatgtcactcctgtgattatattaaatttcaaggctctcttgcttgcagatttgctctagagcctctccttgctgacttgaagtggccatatggggaaagctcacatggcaaggaacactaggtgacttcaaggaaccctggacagcctctagccaacctctggcaagaagtcaaggccctcagtcctactgctacaaagaaatggattctgttgacagcccaagtgagctctgagtcagattcctcagtcaagcctctagaggagaatgcagcctggccaataccttggctgtagcctagggagaccctaagcagacaacccagctaagcggtgcctggattcctgacccacacacactgtgagataataaatgtgttggggggtgaaggagggatgggggtaggggtggctgtgcatttgggtatggaagggtgttttaaatcgctttctaaacacggcctctcctggccactccttaatactgcaacctgctctccactcctgtaattttttttcaacatttgttttaggttcagggggtacatgtgcaggtttgttacatgggtaacttgcatgttgcggaggtttggtgtatgaatgaacccatcacgcaggtagtaagtatagtacccaatagttagcttttcaaccctcgccccccttctaccttccactggggtaggccccagtgcttattgttcccatctttgtgtccatgtctcaaagttttgctctcacttataagtgagaacatgcagtatttggttttctgtgcctgtgttaattagcttaggataatggcctccagctgcatctcttttgctgcagaagacatgatttcattcttttaatggatgcatagtattccgtgctttatatgtaccgtatttttcctccccagtctactgttgatgtgtatctaggttgattccatgcctttgctattgtggatagtgctgcagtgaacatgtaagtgcatgtgtctttttggtagaacaatttattttcctttgggtatatatccagtaatgggattgctgggtcaaatggtagttctcttttaaattctttgagaaatcaccaaactgctttccgcagtgactgaactaatttacattctcaccaacagcgtataagcacttttctctacaaccttgccaacaccttattttttgtttttcacagtaggcattctgactggtgtgcaatggtgtctcattgtggttttgacttgcatttctctaatgatcagtgatattgagcatgagaattttttcaaatatttgttggccccatgtatgtcttccgttcatgtcctttgcccattttttagttgggacaaggtctcgatctgttgcccaggagtgcagtctgatcactggagttcagtgatgcaaacacagctcactgcagccttgacctcctaggctctagcaatccttccaccactgcctcccaaagtgctggagtttcagatttgagccaccacacctttgctcatttttgaagtggggcaagacccccacttcgtaggactattacttgattgagattaaatatgtgtaaaatgcataacatggtgcctggcttatagtaaacactaaatggatttcttcttccataggatttaaatagggagcaattttttttctatcaagagctgatcagaaataaatgggaagcatttaaatgctctccttcccctgtcccaagaggactttcactttccaacattctacatactttatttataatatttattgtttattttctgtctactcatgacagactataagttctatgaggatgggaatgcctgtatgtgcttattatatgacctaacagttccactactgggtatttacccgaaagaaataaaacaaagacttatacatgaatatattgatatatactccagtcacctccaatagaatctagaacacagtaggggcttagtacatatttttaaatgaatgaagactaatgtttagtttaaactaggattgacctattcttatcttcggcagagacagagaataactaattaccacttgtcacatattgagacttcagtacctaaaaggcattattaggtcacctgtaagtctgttttcccccaaagtaaaaatcccaattccattgcccttttcacataagcctcattttctaacctttttagtttggtttaacgaatttcctatttcctctgaattctggagttccaaaccagactcagcacaagcctaacagggcaacctatacagataaggacagcccaggcacattgcacacggcaagttgcacctgttttaagagtaaaaatgaggtcaatgccaccttgtactgcaggtacctcaatgagacaatgccaccccttcctgccacaatcttggcaaaagtcactacgaaagtaaatatcattttactagagtcctttctttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaaaatgcataacatggtgcctggcacacagtaaacacaaaacagatttcttcctctatagcatttaaatgggaagtatttagcgtttacttgccatgtgcatgagtgaatttgggaaaagtggggggaggatatggggcaaagaaggacagaaagggcctaagagtaggaagaatttaataccagaagatgggacaagacctgggtctagaaacctcttctgcagataaagtagctgcaaattatagggaaggagtcctcaggctgctttccttataaccatttattttcctgcaccttatatcaagaacgttaggcactggttaagaccctgtccccttgcagcagtagagaaaacaggaggaaggagacgggaggtagaaatttggaagctagcagttgaaggccaactcagaaagcgtcaggtggaattccattcctaattgacatcaccatcctctaactgcagcaattctctccagcccttttatgtgctccctacagaaccaagcttccacacagctgaaggaacctgtctgctctcaccccagcttcacagaagatggcagggactggttattactaacctgcctcctagtcttctgaggctccaaatggttttgtcagcaagctgagcttccccacaatcccacagactagaaggggttggaaagaacaagccttagaacaatactgctccccacctctaagggatctgctcctctgagtcccagaagttcaccgccttcatttgatttctgctacaggaagactctgggaatccagctctggacccagcacttcctgatttttgaagtagagagttgacaaccctgttgtcatcaatacaactgtgctaggtgggtgggaaaggaaaatatcttgggctcccaaaatcactaagctaaaaggaaaactcaggatcatggtggatggaagtcaggactagattgcagctccgactcggatggacagagaagcatgtggaggctcatatcatgaatttttgctccagaacgactggaggaataaattacaaaacctgagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagctcgaacacaaagtcttcaatttgacccaatccaaccaagacaaagaaaaacaaataagaaaatatgaacaaagcctccaaaaactctgggattatgttaaatgaccaaacctaagaataattggcattgctgaggaagaagagaaatctaaaagtttgaaaaacatatttgggggaataattgaggaaaatttccccaaccttgctagagacctaaacaaatacaagaagcacaaagaacacctgggaaatttattgcaaagagatcgtcacctaggcacattgtcatcaggttatctaaagttaagacaaaagaaagaatcttaagagctgtgagacaaaagaacccagtaacctatgaaggaaaacctgtcagattaacagcagatttctcagcaggaatcctacaagccagaagggattgggcccctatcttcagcatcctaaaacaaaacaattattagccgagaattttgtatccagtgaaactaagcttcatatacgaagagaagatacagtatttttcagacaaacaaatgctgagagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacagaattgcagaatggataagaattaaccgaccaactatctgctgcctttaagagactcacctaacacataagagacttatctgacacataaggactcacataaacttaaggtaaaggggtggaaaaaagacatttcatgcaaatggacaccaaaagcaaaagcaagcagaagtaactattgtttttttgttttttttggtttttttgagatggagtttcactcttgtagtccaggctggagtgcaatggcgcgatcttggcacactgcaacctccgcctcccaggttcaagcaattctcctgtgtcagcttcccaagtagctggaactacaggtgtgcaccaccatgcccagctaatttttgtatttttagtacagataggtttagtacaggcaggggtgatccgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaggccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaacacatatatacagaacattccatccaacaactgcagaatatacattctattcaacagtgcatggaactttctccaagatagaccacatggtaggccacaaaacaagccgcaataaatttaagaaaattgaaattttatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaagggaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccgggcgtggtggctcacgtctgtaatcccagcactttgggaggccaaggtgggcggatcacaaggtcaggagatcaagaccattctggctaacatggtgaagccccgtctctactaaaaatacaaaaaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttataggtgggaattgaacaatgagaacacatggacacaggaaggggaacatcacactctagggactgttgtggggtggggggaggggggagggatagcattaggagatatacctaatgctaaatgacgagataatgggtgcagcacaccagcatggcacatgtatacatatgtagctaacctgcacgttgtgcacatgtaccctaaaacttaaagtataataataataaaataaaataaataaaaaataaaaaataaaaataaaaatacaaaaaattagccggacgccatggtgggcacctgtagtcccagctactcgggaggctgaggcaggagaatggcatgaacccgggaggcggagcttgtagtgagccgagatcgcaccactgcactccagcctaggcgacagagcaagactccatctcaaaaaaaaaaaaaaaaaaaaacctagaagagatggataaattcctggaaagatacaaccctcctagcttaaatcaggaagaattagatactctgaacagaccaataacaagcaacaagattgaaatgctaatttaaacattaccaacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccatgatcaagtgggtttcataccagggatgcagggaggtttaacatacgcaagtcaataaatgtggtacaccacataaacaaaattaaaaacaaaaatcaccatgatcatctcaatagatgcagaaaaagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacacgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcacgaccaagaacccaaaagcaaatgcaataaaaacaaagacaaacagctgggacttaattaaactaaagagcttttgcacggcaaaaggaacagtcagcagagtaaacagacaacccacagagtgggagaaaatcttcacagtctgtacatctgacaaaggactaacatccagaatctacaacaaactcaaacaaatcagcaagaaaaaaacaaacaatcccatcataaagtgggctaaggatatgaatagacagttctcaaaagaagatatacaaatggccaacaaacatatgaaaaaaggctcaacatcgctaataatcagggaaatgcaaatcaaaaccacaatgtgataccaccttactcctgcaagaatggccataatcaaaaaaataaaaaaatagtagatatggatgtggatgcagtgaacagggaacacttctacactgcttgtgggaatgtaaactagtacagccactatggaaaacaatgtggagattccttaaaaaactaaaagtagaactaccatttgatccagcaatcccactacagggtatctacctagaggaaaagaagtcattatacaaaaaagatacttgaacacgcatacgtatagcagcacagttcacaactgcaaaaacgtggaaccaacccaagtgcccaccaatcaatgagtggataaagaaactgtggtgtgtatatacacacatatatatatatatatgatggatatatatatatatatatatgatagaatactactcagccaataaaaggaataaattaacgcattcacaatgatctggatgagattggagactatcattctaagtgaagtaaggcaggaaaggaaaaccaaacattgtatgttctcactcataagtgggagctaagctataaggatacaaaggcataagaatgacacagtggactttggggactcaaggggaaagggggggaagtgggtgagggataaaagatcacaaatagggtgcagtatatactgcttgggtgatgggtgcaccaaaatctcacaaatcaccactaaagaaattactcatgtaaccaaacaccatctattccccaataacctatggaaatgaaaatacaaaaaataaaaggaaaactcaagctggaaactgtttagggcaaacctgcctcccattctattcaaagttatctctctgctcactgagataaatgcatatctgattgcctcctttggaaaggctaattagaaactcaaaagaatgcaaccttttgtctctcttctgtgacctagaagccgcctcccccactgcaagttttcctgcctttgcttcaagttgtcccgcctttccagacctaaccaatgtacttcttacatacattgattgatgtctcatgtctccctagaatgtacaaaaccaagctgtgccccaaacaccttggtcacatgtcataaagacttcctgaggctatgccaggggcacgtgtcctcaaccttggcaaaataaactttctaaatttactgagacctgtctcaaattttcggagttcacagtgggcaagactagatttacttttgtgttgagcagatactgagcttgactgatgagaatctggagtgtgaggtctgacggagtaactctgagagaggaagctacctgtgtggtctcagggagaagatctgagacttaccaagaaaaagtgacctgaaagaactggctgacttcaggcccttgaccagtgcctagaccctctttctgcagctccagatcatagccatcatgctggcagcctccctgccgctcatccaggcaccttaaagaagggcttcctcttcccaagcctctgggtgggctttctaaagccctgtgtgcatgaagaggtggcttgtagccctttgcagcagcagggcttacatgaggctgggatatgaaaagctggcattacaatgcagcttgtgccttgcattcactccccacttcatcaagccaagtttctaaataacagggatagtaactgcccactgtggcccaatgtcacttctaaagttgcttggcaaaaagccacatgactattacttagctctccacagaacggcatgtaccaagtcggatcactgctgtcggtgtgtgggtggattagctgctattgaacatgatagggcgggcccctttccagtttgcaccagccccgctctgtgcctactccatgtatcatagagcctcctctctctgtgcagttgaacttgatcagatgagatggcaaaagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtgaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttaggcaaattactattctgagctttagtcatcttatctttaaaatgaagggtttattctttagaggaagctgagtgaatggcatacgggaacactctgtactatttttataactttgctataagtctaaaattatttttaaataaatggttttcttaaaaagtgaaaggattatgtagattatcttcaagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcctacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacaggacttcagaactgggagggatgtgtgcgtcaatcctggtccagcccactcatttaaacacaaagaaccagaagcccagaaaaagtgacttgccttagcctggccttcctcttgattcctttccctcaattctcccgtcctgatcaatcatcaagtcctacaaatattttacctcttaaatattttaaagatgagttgcctcccctctattcctactgccacagccctcattcgggccttcatcttctttggcttggcaagtctgttctcactcacttcctgccttgactctcttgaatccacctttcccatgcatcagagggatctagcaggttccctgcagcttaaagcccatcagtggtgccttgtcttcttcaggataaagtctacactctttaaaatggcacaaaagactgtgtccgtcatatcagtctcattcttcgcctagtacttaaatccaccaacaccaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagttgccttacactttgtacacagctctgttactgccttttactatactctagcacctgtggtttactcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatactgaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaggagattgagaccagcctggctaacgtggtgaaaacccgtctctactaaaaatatgaaaaattagcgtatgtttcacagcatctgtaatcccagctactcaggaggctggggcaggagaatcgcttgaacctgggaggtggagattgcagcaagccaagatggcgccactgcactccagcctgggccacaaagtgagactccatctcaaaaaaaaaaaaaaaagaagaaaaaagaaatgccttttcccatttcttgttatgttactaccttttaggattcaatgcaaacttcaaacacttggcaaggcctttcctggtggattttattgcactatagcaaaatctgtccatacctctatggtagcccttattataccatttttatttatttgttgatgtcttctccaccagaatctagcacagtagctggcatatagtagataatcaatagacgtttgactgaatataccaatgcatatgcgcaaatatgagcaaaaaaatgactaaaatgatattgcaaacaagggaaacatttgagacagaaatttagaatgtctatttttttcaagtgtaacatgctacttctatcagtgcataaacctgaatgtacatacactatagaaagaagtggccttgtaataagttcatgcagaagtataaattatgtagacattgttagggggataactgaaagtggattagaattaaattagggcccagaatttagtctgggatttgttttccagtggttgaaagaaaaattcctaagtattcaaagggaagaagcatttctcaacaggcaagtattatgaattctaattaaaagctctgaaaaaatgagataagttgtgttaaggaaaagcagaaaacagagttgcctttggttaagagttccactatttttataagcaactgacttttttggggaaagttgctttaagcatttttttttctgtgtgtatgtgtgagatggggtctcactctgtcacccaggctagaatgcaggagcacaatcatggctcactgcagcctcaaccttctgggctcaagcaatcctcccacctcagcctcccaagtagctggtaccacagccacacaccactatgtcagctaattaaaaaaaaaaaaatttacagagatgcagtcttgctatgtttcccaggctggtctcaaactcctgggctcaagtgatcctcccaccttggccttgcgaagtgctgggattactgacatgcgccaacatgccaggcctaaacattttgtgtgtgtgtgttaaaatatacatataataaaatttgccattttaactattttaaagtatatagttctatggcattaagtacattcacatagttgttcaaatatcactatccatctccagaactttttcccaaatgaaactgtagccactaactccccattccctcctccccacaacccctggcaaccatagttccactttctgtcttcattatttgactactctaggtacttcatttaagtgaaataataaatatttgtcctttagggactgactttacttagcatgacatctttaaggttcactcatgttacagcacatgtcagagtttcatacctttctaaggctaaataatatccagtgtctatatagcccacattttgtttatccactcatttgtcaatgaacacttgagttgcttccacctgttggctactgtaaacaatgctcctatgaacacagaaatacaaatatctatttgagttcctgttttcatttattttgtgttatacccagagtagaattgctggattatacggtaagtctatgtttaattttttgagaaactccatactggttttcacagcacctgcaccatttcacattctttctagcaatgtgcaagggttccaatttctccacatctttactagtatttgttattttctgggttgtttgatttttagtataatagccatcctaatgagtgtgaagtttgaaaaaatatttaaccaaaatcataaatattggttacaaatatttaatggatggattccctctatttctgccaactttcattccctgaaagaagaaataggtaagcatgacctcacgaacctcagaaggctgagaatggggaattggcacacacagtgtgcgtagacacagacacacatggaccatgttcatactaggcttccagagaaccatttaaaaatagtttggctaatgtaatcttgtctgtctcttatgttcctcctttcccatcatacacatttcttaaagttcgtgtaagtaaaacataggagaaaaaaacatagccactaattaaataaggcatccaagtgtaaaagaagagcaaactctgctacatataagaagacaagcattaattctggcaacagcagccacacagccactttagacaataacctgagcaggtgcatgctttctagtatgtgtctccagctatgcaggatagaaatcacaatcctttctatttatctaacgtctaatacactaaaacatgtttacccatgggggagaagagcacgacaggaattgatgactctaatttaggaaactaaggttcacagaagttaagtgacttggccaagatcatgtagctagaaaaggcaggttaagaattcaggtttccttagagttcaaaacttttatcacaacatttttgataaccccccaagatactcatccttctctaatagccttcctttggttcaagtccagcttcctaaatcctaccgcctgatggagttcctgagcttccttgtaagtctgcaggtatattgttcctcatcatgttgcccaaagcctaaagaaatcaggctaggaccaaagaaaatcagtcaatgagccaaaaagaaatttaatcaacccagcctttcttatttattttctttgaatgaacatttgtatctgagaatgccaaggtaaatttgatgcaatagggacacttggattatattatgttatttacacacaagcaaacaaaaattgagaattgagacaaataggacaaatggtcccaagtccactattgaggaaaaagaaactgatttggaataaaaaatagtccagcatgaatgtgtcagtaattaagacttatctggataagtttgccgtctctcaatttgtcacaataatggcaaatatttattgagagcttactatgtgataggcattatgctgagttcagctaattgactcatttcatcctcctctagaccctataagataggtgttattactgcccttgctttagctcagagaaattatggtatttttcccaacacaaatagtaagtagaaaaatcaagatttcaccccaggtctcgccaatttatagctcttagccgttatgcccagcaataacagaatagtaaaaacaaggacaatttggtaggcaagtaaaatcagtaggctgtttaccatagctatagaagtatgctatgcataaacctcaaagattgcgcaggaaaagtatcatccaatctcaaagatgagaaaaccaaagaagtttcaatctcagagaagtcaggcagcttaagggtcataaaacaacgcaacacaactctctcaactcatatctaagggctaagtccactttaaccttccaatatcattacatcatatttaaacattgactctatctggtcaaggacgacaacattttatttctcctgacccttttgctatcagatctggccttgtcagtttttcaatttcattcttagaatggaaacttaattcacacaagttgaacaagtagtcatcagggggcaaaacccagtggatgatggttttgtgtgctgtttggagactgggtgtttaccacacagcagtggatttcataaattccagggtcagacaagattccagtagcgacacacttgactaatatgagaaaatgcaggattaggcaatcaacaatgaggaagtcagccaagttgccacccaaaaattacttaccacagcagctgcagtccagaaatgctaacaagccagtctccctaggagtgggccatactcagctgtggaccactcacaacattttctcactttattttgcttcagagtcagtgtactgcaatgatttctcctttgcttgctttatatgtttaaaattgtcttccctaaaagctgaacttaaaattaatgtttgctaccaaaagggggtagcagtgcctagtcatgtaggcatatgtcccactctgtcggtacagagggtaagcagcctcttcctttttaaaaaatttattacgatgatttacaaaaattgaagcttacaggataaacactcaacaaaaaagtagccagtctcaagaaaccaatttttatgtatgaattaatattattttattaatccatggccaggatgattcttaagattatttcttaattctctgaacagcttaaaagagagaaactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaaagagaaagatagcacccactctccagttctcttctcccaaagttgcccgtatttcccttccctgaagccaatcaaatactttattgtttctcgctaagagtaatttttcactcttaagtacaaacagctcaacaaaaattcccggtagcataaatatgcacatcaataaaataattactactcacaatagactttccattacatatgtttcacaagcattggttttcttaaaaagaaccacgcatacagcactcaaattattgcagattctaactcagtagagtttgatttaatgtttttacaatattttttttaaagaagtgtccttccaacgctaaggaaaaaaatcagaatcaagaaaattctgtttcttagcaacagaaaaatcaaacttctgttactaagtttggtaacagaacagtactctaaattatcctctgaaccacctgatttaccatgtgatgctgggcacattgctgctaattaatcttcctaatctcgtgggatcacaatatgaataacaagaatgaacatcagacacatctgtgggaattatgagggggagattataaagagtcaaaccttgtccccatatttaaattttataataactataactactagtagaaatataactactaccctctcatatatatgtgatgttattaagtttataaagtgttttgatatgtttcttatttcatcttcatggctgctatttattcatagaaaaataattctcagtatctgtagcattattgttaatgtcaatcctatagaggctggaacaggctcagagaggctaagtaacttgcctaactaagtctcctggttgacaataggtcttaatgcagtgttttccgaatccctcgttcttacatcaaaacagaactgtggctgggtgtggtggctcatgcctgtaatcccagcaatttaggaggccaaggtgggaagatcacttgagcccaggaatttgagaccagcctgggcaacatagtgagtgagacctcaatctctgccaaaaaaaaaaaaaaaaaaatacatacacacacacacacacacacacacacacacacagacacacacatatatatataaataattagccaggtgtggtggcacacctgtggtcccagctacttgggaggctggggtgggaggatcatttgagcccaggaggtcaaggctgcagtgagtcgtgacggtgccactgcactctagcctgggtgacagagcgagaccctgtctcaaaaaataaaataaaccagaacggctctagttcctatcaatcactcatcatgacatagtgtggtaaactaatttcaactctgaatgattgataatggctttatgtgttctgtttcccaagtaataagaacattttagcacaagcctttagcgcttttcaaataatcatagccaaatgagaaaattaatatgacaggcagattgaacaaacatttggtgagaaggaagaggaggggatacagtagtttgagatccctcaaatcatatgatgcagtagctgcctgacaactctgctaacacgtaagactagatagagacagggccatatctacttcctgtatgggacccatggcaatactagagtctagcaaaagggttgtcctctctgcatgtgacaataggctgtgttccactccccccacatacaccttgtgcagctcctataatctcatttatcacacttctccaggtgagaaatggtgccttctcacaccccacccaaagttgtttcctaaagatctttcgctagggcggagcagagagtgagatcaaatgattcagacagccatctgattcagctttaaaaaaaaaaaatcctggtgggggcgcagtggctcacgcctgtaatcccagtactttgggaggctgaggcgggtggatcgcctgaggtcaggagtttgagaccagcctggccaacatggtaaaaccccgcctctattaaaaatacaaaaattagccaggtgtggtagcaggcgtctgtagtcccagctactccggagaatcgcttgaacccaggaggcggaggttgcagtgagctgagatcgtgccactgcactctagcctgggcgacagagtgagactctgtctcagaacaacaacaacaacaacaaaatcctttccctcaaattacctaagaaattgtcctttccttctttgccctgaagacagttaatggggaaagttcctccctctgcacagtgaataaatccatccactattcctaccctaaccctaaggcaaaacctcccactcatcctctgtctctcgccatctctctgttaccaaccctcacttggcaatatccttcttgacacgtggcagctccaatgaggcacactcattacatagccacgtaaaagataaaaggtgaatctggaccaacttctggaaaatttggacttaaaacatggaaatgcaggagagacaggaaatagagttaaatcccccagatttagctatacacattaattgaattaactaaataatcatttgggtctcatagacaccagctatttccctgatccaagatgttatctagcagcctgtatcgcttcccagtcatccatcctcttgacaggacagagcacacatagaaaatggtatttgtatagtcctctggggtaaacagttggagagttagaatctctgataaggtcagaggcaaccagtccccggtcacttgggccacttcaggtcctgcttgtccagacacagagagggctgaggaaaccaatattgtggtgaccagctacgaggcttaatcctcataacccatagcccaatgtcctcttatcaaggtgctgtcctatctcacccacagctcagccaatccagtaggtcttccttccccaccctgatcactgacccatcaatcaagatagccctcccatccaaggaagaggccatttcccctcccactccacccaggccaactgctatcccacaggttactctcttcttcattttaaggcaagctattccaaagactaaaaatgcctaagattctgtcttaaaagcttatctgcatagtcatcttcaaaagcaaacatgaatttctcaaggaacggaaacacccttagcccctgcccttttctccatagcatcattctctgccccaccaagccggaactaggagggcactttctctaggagaggtatgacctggagatgatctgcttcagagccacctcagggatcttgcttaaaaatgcatattttcccaggcaaagtggctcatgcctataataccaacaacagtggaggctgaggtgggaggatctaaaggccaggagtttgagaccagcctggacaacatagtgccacccctttggtacgaattttttttttttttttttttgagacagactcttgctctgtcacctaggctggagtgtagcggcgcaatcccgtctcaccgcaacctccgcctcctgggttcaagcaattctcctgcctcagcctcccaagtagcttggactacaggcatatgccaccacacccgctaatttttgtactttttaagtagagatggagtttcaccatgttggccaggctggtctcgaactcctgacctcaagccttctgtcttccttggcttcccaaagtgctgggattacaggcatgagccactgtgccctgccaatttttttttttttaattatctgggcctggtgtcctgtgcctgtggtcccagctgctcaggaggctgagccagaaggcatcacttgagcccaagagttggtggctgcagtgctatgatggtgacactgcactccagcctgagcaacagggcaagaactgtttctaaaataaataaattttaaaaatgcaaatatccaccccagccccaccctctccccccaccttcccccacattactacatcggaatccctagggtgaggcatggaatctacattttaaaccagctcccaaggtgattgttccgcacagttccacgtcagtgtttgagagaggctctgatttattccagtcctctttctttacagagaaggaaagcagaaagcaggcaccagagaggtgaaatgagcttgtccaaggtcacaggttgttaaggtgaccagagctggacgaaaccccacctctctcgctgactagcacagcgccagctaggaagagcctagaatagcgaccaactggcaggccaaaccgtcccctgcccctgcccctgcctcggagaagcgggcccctgcactcacccgcttgtagatgtcctcccggctggcctcatacttctgttgcatgcgctcctccaggaagtagatgcgcagcttgaggctgaagttctccttcttcaggtcattgaggtgctgggacagagtgcgatatccattagacatgatgggcaacccatggggaggagcgtgcccgattgccccctcaacccaggaacatggtgcagctgcaccgcagcatgaagccagccggctgggacgctgctgaggctgcggaccgagaggctggggctacggcgacatggcccctattgctggagctctctccgggactcgggactgggctcactgctctgggtgctggagcgcagcacactttccttttttacctcagggagatatttgcggaatccctgacagaggaacatgctgcgtgaactcagacacaagtggtgtaacccgactccaagccaggactctgctgtcaccctcctggagcctcccaggcccaactgtaggcagttaacagcttctcggaaaagagagactgacccccaagagcttccaggaaagggggaggggagatattcaaggtgacagtgggtttgcaaagaagagaaggaaatagagggtggggagggggtatttaaatgacttgtggctgatttggactataagaccaaaaggagtgtggccagaagcaagaaataaggttgctatagaaaagaccatgtacataaaacggcccacaaaggtaaccgcatgtcaaatatcccctttctgtccagtgcaaatcttaaagagcttctaaccagaggagtctcaatttcctttgataatccagagctcacttctaatgagttcctttgcagttttcagccccaagctttttgagctctgaggcagttcaactaatagcctttattgccatgagccttcccccgaaacacaccatagctacccgcaaagaaagagcaaatcttctagctcagcggaatctttgcagactctatttaccagttacaaagctcagaaagaggcagggtcaagggatcctccctccatggaagaagggatgggcagaagagagtgtgggaggatgacagagagggagccgtcatcctggagcccaaagatttcaggcagtcactggttcttaactctggcacctgccaagtggagccgggcactcatcaccagatcttgctcctaaagtaatttaagatccttgagtgacagctgcaacattagcaggaagtattatttataccacattacattgaaggtgatgggagacaaccccagagcacagataacaaacacgggttctttgtggcaataatattaggttgaaaaaatatatattaacattcaagataaaggaaactacaaaatttacacttaattcaagccctcatttcctccccaacctacctgcttttcattcttccaattccttctcaaaccttcataatcattccagtcaacaactcctgagtactcaccaggtaggacattgggcatgagggatatatagatcaagaatgtcccaaccctcaaagagctacgtggccatacagctggccatgatatgttaagatatgtgttttacattatgatcctccaaacctgtgtttttcaacttttgtatgttacattgccatctagtacatatgcatacactcttaactgaagtaaatgtttcaaaaagtaattgtcaccatcactatgtgtgatgtcctctgatatttcctatttctttttctgccagtgacccacccgacggatttcatgacccactaataagtttcagcctgagtttaaaaaacgttgactctgggggagcccgtaagaaagagtagtcagttcttactggggtgatcagagaaagcttcattaggagttgaatttgcactttgccttgaaaaataaaaaatgtttgagtggataaagtggccccaggagggcataattagagtgaagcattctcccaaatagatttagattataaataggcaaaataggcaagcccaaatatttaccatttgaaaaaaaaaaactacacatttaaaatccatttaactattttcactaaatctgaattcttagaatttgagaatgccaactaggcttagttagagacagtgaagaaaaaagtctaagttaaaacaactcaaaatatccttttccattcccagttctcttactaaatagctatgttatagaccatttctctagaagcctaactgtcctcacttaaaaaatgaaatggctttaaaaattggtgattttttttttttttgagacagagtcttgctctgttgcctaggctggagtgcagtggtgcaatctcaactcactgcaacctctgcctcctgggttcaagccattctcctgcttcagcctcctgagtagctgggactacaggtgcccgccaccgcgcccggctaatttttcattgttttagtagagacagggtttcacagcgttagccaggatggtctcgatctcctgaccttgagatccgcccgccttggcctcccaaagtgctgggattacaggcatgagccaccgcgtctggccaaaattagtgatttttaaggccctttcctggtctaagctcttcaaggtgataacccagttaatatcacctccattttgctcaaggggagccaggctgccagagtttagataagtgtttaatcatgctttggctgtctacttagattcctttatcaggtaaaataatttcataaaagttttacaggaagtaaaactgtgtatgaatccagggtattcttatgcatcctagatttctgttggacatttatgcttatttcctccatgatatcttgttcttctatctctctggatccttttctgtgttttttgccagctcctgaaagtgggtatttaaatgatggtaagtcctcagccttctacttttttttctcttcacatttttatccatggaggttttatccacttttagggctatactttcaccttcgaaacaattcccaaatctccaaccgagtcttctcacccaagatctagccgtacatattcaactcttggcttagatcattcaacttgagtgttcccaaattccacccaagcaaagcctttcctcttaccctagcctggaaagacttcttcctcttttgaactctaaggcagatattaacattcaacaagtgttcatatgctgccttatgatgtggcttttgttatcttgaagggttatttacatcttttagggttacgtgactttttgtgtgtttgatctttccaactagtctgaagctgcccaaggaaaaagtcaatgactaactaatgcatcttcataaactcctacagcttccataacaacctgagacctctccaacagcattcatcccattgtgctgtcacagtctgtttacgatgacctcaacctggctagagtgttttgagagctgacaaggcatattttgtgtccttgtattcttgttgcatagtactcaggaagcactccctaaatatttgtggaatcaatgaacaggaaaatattccataaacattgtacgttttgctttgttatatatgggctggctcacctgtattattctcatagatttccaataatatgaaaaaagtttgttttaatagtcctaaataaactatatttggtagaacacttattctagaagacgtagaaaaatgacgttttgttcacttacatttctaagtttacatgcccaccctgatcttttccctgaactccaattgatatctgactgtctagtagaaatctctgcttgaatttagacatcacatacttgtgatatctaaaactgaactcctgatctttcccagtaaacatgctcctccctcactacaccttttttcaacttgtaacaactcaatattttcagatttttgagcccaaacctttgaatcatttcttgattcattctctctcctacatatcatctgtctgtaaatcttactatgcatattatacattatagtatatatattaataacatatatggtagtataatatatatgttgtagctgttgtattatgtatgtaatatataatactatattatatatactattatactactatatatatattttatatatatgttatactaccactactgccactggtatttctaccaccctgacccacagtactgccatcttttccttacatgatctgaatagccccttaactggtgttcctgctcccactcttgttcccttgtagtctattctcagcacagcagccacagtgaccctttcaaaatacgtcagattactcctctgctggagagccccctggcttcccatctaacttagagtgaaaggtgatgtcccttcaccagactgcaaggcctgaggccctacaccctcttcttgcctctcctattacctcctctacttcttcctaccactctccctctgttctctgctgtagccacactgtttctctttgttatttctcaaaaacaggaagcaagagaagctttcttttccgaggcctttgaacttgttgacccttctgcctggctgctctttctctagggaggtgcacgattctctcctcaccttcttcatctttgattgaatgtcaccttcttggtgaagtgaatactctttaggcaccccatgcctcatcccagctctccaaatcccccttcattgttttttattccgtagcactatcaccttctaaaatacattttcttatttattttgtttcttgtctgtctctccccaccagcatgtaaacttcctgagaaaagtgggatgttttcttagtttgttcactgctgtgtcaccagtgcccagaacggtgcctgatacatagctggtgctcaataaatatttgttgaattaaagaatggatgagtaattaacctgctgatttatttctcattggagtaatacaacttaatcgatacacaagattatgtagatgttttaggataaaaagcatacctagtagcattcctccttataaaaagattataagtaaaataaattactctaacagactcattttaatacaccatgcagaatctggactttctacaacagttccgaacaaatatggaatcgtatatgacaaattataaaggacaatatgaactgtacaaatagtaaaaactgggccaggcatggtggcttatgcctgtaatcccagcactttgggaggcccaggtgagcagatcgcatgaggtcaggagttcaagaccagcccggtcaacatggtgaaactccgtctctactaaaaatacaaaaattagccgggcgtggtggcatgtgcctgtagtcccagctactcaggtggctgaggcatgatgattgcttgaacctggaaagtagaggttgcagtgagcggagatcatgccactgcactccagcctgggtgacagagcaagactccgtctcagaaaaaaaaaaagtaaaaactataaaaattaggaaggagaggtggccagagaaggtaccacagagaattggcactttagcttgtctcaaaggatgagttgagcttggataggcagtggggagaacacaaggcagtccaggcaggtggaacataagcgaaagggcagtgtgcccaccaggccaaagcaaagggcacatactgtcctgaaataggccacagagatgaggggaaataaaaagccgtctcaaggagatcttgaaagccagggtgagaagcctggagtttgcccctccaggatcctggctctcaatctggataagagtgaggggaagggaagtggaggtggggaggagggcagtgggggtggggagggccaggaactgctgactgggaagattattttctttgtgtattgcttaggtttcgttttacttatttgttttcttgcagctttaacaaacatcagcgctgcatgtggaaacttggaaaagaaaaaaaaagctttaacaaacaaaaacacacatacctgagatgcacacggcaacctactagctcatggcaaacaggcctatatgttgataacctctgcattgcttaggaaataaaacactgcagattcttgagcaaggggaagtgcttctatctttgttcttcctttttctcctagtacatataacatctttactctggtctcagaatgtttcttccaaaccttaatggctctccccttctttttccttaatttcttcattccacccctggaataacgttctagtccagactagaaatacaacgtaaataaagactcaatcaatgccaacagtaggaggaggattaccacccagctgttgcctgtcatgccccattaacacaaccaaccgtcaagtctgcctttaaaaaacccagcttgacatttgcttcatcatattcagaccccccagctagctcatataatgtatgtacttgaaaacatattaattgtttaccaatctttctcctaaaaataaagcttcactaacaaaaaatgattaatcttcttaatggacacattcttttcaaatataatcaaacttccacaattttaactgtactaatttgatatctgtggataattcttacctttaccttccttgaaaataaaaatattttaaaaataagttaatacggcaaatagaaaaacagaagagtagtgctttaagtaacccttgacactttacatcaatttacacatagacaataaatatgatcactattatacatatttatctagggtgggtagcgtggaactgtgaaaagagcaatagctttgaaccatgaagaccagcgttcaaatcccggctctccttttttctcattgggtcattttggggaaactacttaatagttaagtataggaagacagtcagaagactgggatctgggcaggatactaagaaggttgcaactgtatctgtaatggtaacttttgttttttcacctgaggaaaataaactaaaaataatgttttctaacatttagatattcaacacatggacaagtgtttaattattctttgtatattcctgttgtttgtaaaacagcttataatttttaaaactattttaaagggaatgaaagtaggaattacagggaggcagttatcaattagatataaggatgaattctctagtagagttagatgtaataaagatattgccacactctatccatatgtttatacatcaaatttttactgagtacatacatcatgagacaaaataaacttcctgtcacaaaaggtgcttgaccaaaactcaagaatcacctttcagggatactgttaaaagttttcccacatcagctaggagttagctctagagggcttttaagatctttggccatcctgaaattctatgcttgaaacacgttttctcatagaaacgctcctaccaaaggccagtgagagaactatcactttgtgaagaatttcagaatgcccactagctctcctgtagccctaaaaggtaatgagagtctacctgttcagactgagagctccggctgccttgtgctacagaagcagtaagtgcatgtaaaggacgccatatttctaagacaaaagcagtaacaatgactcaaggatgatgcccaatagacgatttaacctataactttgctaattgtcatattttcaaaacagccctatgggaagggtacacaaatgtctggggagtatttcctgctttttagcacccagggaactacaaccaggagcccagcttattttggattggggatggggatagacaagaagagatggggcagggagaagagacggctggtttattttacatacacatattttatttataatacatctctgtgtctaggcgtctctatgctgttctcataaaatctgaattatacaaataaaagtttaattcctggctgttttggatgacttgggcctgtattacaaaattaatcagatacaattatactatcttcacaacaacaatcatctacattggttttgacaatgtacaaagtacttccatgtgtattatttcgtttatctttaccacaacctttgaagtaggaagacatgatgatccccattttactgcctaggacagagagacatcaggaggttaactgacttgttcactgagaaagcggaggagcacagactataactccaacagtttgaccccatactgcatacgcatcagggccttaatcatgagactgtatgacccttctgagcctgggattcacttgcaactgggtattccctcttctacctcaggccccctataccttttcaaaaagtgtccttcactgtaaataatcttcctggtggtgaccctaaaggatctgacaacctggatctatgtaaaaaaaaaaaaaaaaaaattgttttcttcattttcaagatgaataaactaaagttggctctcaaagggttaaacaaagagttaccatgtggcctagcaattcctttcctagttatatacccaagaaaattgaaaacatatggccacacgaaatcttatatacaaatgttcatagcagcattactcataatagccaaaattggaagtatttcaaatgtccttcaactgatgaatggataaacaaaatttagcatatccaaatcatagaatattactcagccataaaaaggaatgaagtactgatacatgctacaacacaaatgaccttgacagcattatacgataatgtgaaagaagccagacacaaaaggtcacatactgtataattccatttacatgaaatgtccagaataggcaaatccaggcagaaagtagattagtggtttccaggaaccagggagagggaaactgggaagtgagtgttaatgagtatgaggtttcctattggagtgagaaacacgtactggaattagacagtggtgatggttgcacaactctgaatatactaaaatcatagaattgtaagatttcagaagatgagctgtatagcgtgttaatcgtttgaataaagctttgtttttaaaagaagacaaagaaataaaccaaagctgagagaagtaactaacccaatcctttatcttttataagagtttttttaatgataaagactcagttaaagtccaatttgattcagttcagttaaagctaaatggcttagaatgaatcatgtctaaatattctgtataccaatcctacctatattatagggccctaaaagaagggtcagacgaagtatgctctaagtggctctcagtactgaatattcacagattaagttttacaaaaaggtaaagttttgtgataaccctcagataaaacagaaacatatgacctatgttttgacataaaacatacgtatttggcctgttctgaaagatatgtataattttcacacaccacattctaccaaggaaaatgtcaaccggagccaaccaacttggtgttccactcatcaactcttttatgccaacatggtgtttctgcccttgtctcagaagccaactactgatacctgcttcagaaaactgactatgaattccacaaagtcctgcttttttcttttggattgtacaatcaacaaacaagtcacccttctaaaactctgtttctgaaattttaacataattcctgaagttccagagtctcttaaatgctaaaatattaacaataccattccattttttcccctaacactcagaagcatactgatacccatcctgtacacagccttttcttgcctgataacaagagcactaatgacagagctattgcatcaggttgattaataaaccccgtcttaggcagcctcatcatgtggataaagaaaaggagttaagatgatgttcctgctgccttccccaacatagaaacacacccacaacacccccaatcctggaataaccagatgttatcttcatcatcacactagagcactgtaaaccacatcaaaacaaaacgaaacaaataacaacttccctggccaccaaaaatagatggcccagccagaaatagtgctgccagaggcagttaaatgagctgcaaggcaggaatgacagttgagctgcagtgatgctggggcctcccaaggattaccggactccaaactagattctccatcactttggtccaatcaacatcagcaggacttggtatttgttcacaattggttcaactcagattatttgctgagcttctggaattcagagagagtgacttatgggctcacctttttctctagattttaaataatcctttctccatttttttctaggagtgaaggcaattttgaaggcatgactacgacctgctctggccacaagagctaagagttgccaggtgttgtggctcaaacactttgagatgccaatcccaacactttgagaggccaaggcaggaggattgcttgaggctaggagcttgaaaccagcctgggcaacacagtgagaccccatctctacaaaaaataaaaaaacaggccaggcgcagtggcacttagggaggccaaggtgggtggatcacctgaggtcaggagttcgagaccagcctgaccaacatggagaaaccccgtctctacaaaaaatacaaagtttgccagtgtggtggcacatgcctgttatcccagctactcaggaggctgaggcaggagaatcgcttgaacccgaaaggcagaggttgcagtgagtggagatcacgccattgcactccagcctgcgcaacaagagtgaaactccatctcaaataaataaataaaataaagttttaaaaagtcaaaattatccaggcgtgatggtatgttcttgtagtcccagctactcaggaagctgaggtgggggatcacttgaatccgggaggtcgaggctgcagtgagccaagattgtgccactgcactcaagtctggatgacagagcaagaccatgtctaaaaaaaaaaaaaaacaaaacaaaaccaaaaaccaagagtccacagtgataccatgaatgcccatggctgcaacaataatgccttgaccagaagtagggggataagggaaaagatagagccaacatgaaccccgattgaccctcccttgctccatccatgacagaaagcctcctatttctgaattcaccaggctcatgctgcctccaggactttgcatgggtagcagcattagcctagaatttcacttctctttaattcccacccatctctcacttaactaatcccaactcacccataaggatctaagtcagatattacctactaaaagaaacctatctggccctaatgcctgggcaagggcttctcctgaatgcttccacagcactgcggacctactcttattgtggcccatttcacagtatattgggattatctgtttgactctctccccagtagatctggagttccttaacaacaggaagaatcttctttacttttcttccaaaaacagaaatcgctttactgttttttgtttgtgttgctgttgcttcagtggtcataaaagtactacatgtgcctgtctgttccagttgttctctttctcagtggagggcataacctagtagttgaccaagcaagaaaacttgacatcatttattcgttcaaaacaaacaaaaaagaagaaaagaaaagggcatgcctactatgtaccaggcattatgctaatcactgtatctagaagtgaaaagacaaccactgtccctgctatagtgagctcatgttctaacagaaaaggcagactttgaacaaataactcacgttattgaagagagaggtgaaggtagtctggaagtttacaacaaggtgacagtgggtaggatgtgagtgaagagatgaattggtgatcagtcgtctttgggtttcttcagcctcactggttctacatccagtcaatggcttagctctatcaattctgcctctgaaatttctttcacctgtccatttctctaatttttatactggcatctccaccaacctttgcctggaatactgcaactgttttctctgcctctagactactcctcctatgcagaggtcataaggaagccaaaaggatctttctaagaggaaaatctgatcatgtcacctctctgtctaaaagctttcagcagttcccttgagctcagataaaatttaaaagcctttacataacttgcaagactctgtatgatgactcctctctcttttctctggtttcagttctctgcattccttacatcccattctctaggaatactgactatggttctttctctcatcgggatcttgattcaagctatttcctatgcatggaacattcttcattctcacactaccacccccttattagtggctacttcttattccttcttcaggaccctggttagatgcagtttcctctaggaaactttccctgaatcccccaatctcttcagattgagtaagtgcccagttatatattccatagcactctttacttctattacaataataattacattctgttggaatttgctaatctgtagactctatgaaggcaggaaccatgtttgcctattcaatattgtatctgcaatgcttaaggtatgctgcacatagtaaaagcactagaatattttttcaatgaatagataattaaaataaatataatactcagttataaagaaggcaataggctaattccatcatccagacataatcaatatcaatgttttggtatgtatccttccagacatttccatcttttctccctcaaaaatgagatcttattttttgtaatattcagtcaaattgctgttgccgttgttttgtttaatcttaaatttgttataatggacatcctcccaagtcagtacattgctctataatgttctattgtatatatattccacacttgaaataatcctcaccttgagtactaatattgtattggtatagagaatactgaaatataaacactcatccttgaacatacattttcttttttttgttttttttgagacggagtctagctctgtcacccaggctggagtacagtggcaatctcggctcactgcaacctctgcctcctgggttcaagcgattctcctgcctcagcctcctgagtagctgggattacaggtgtgcaccaccacacctggctaatttttgtatttttaggagagacagggttttaccatgttggccaggctggtctcaaactcctgacctcaggtgatccgcctgcctcagcctcctaaagtgctggaattacaggcgtgagccgccacgcccggccgaaaatacatattttcatacattcattcttgatcattgtgcaactaacagctagaacatggcctggcacacacgatgcactcataaatggatgagtggattaacaaacaaatgaataagggggtcagctatcaataagcataataaaattgtggctaagagtttaggcactagaaccagtacacttatgtccaaatcccagctccagcacttgccatcaattactagtgttttcctagcttcagtgtctctctacaaacaaagacaatggttgtaccaacctcaaaagactattaggagaactgaataagataataaggtcaagtgcattctcagaacttggcacactgtaagcacttacaaatattaattggtatcatgatctttgttgctattttttaaatttagtattggaatggaaattatcattagaatggaaactttgcaaagtccacagaaagaaagatagggcttctcttcgaacaacgggagaagagaagaaaacaagttttaatgaggagacagaaaggagataatttaaaattatgaaaagaattattctaattcaagtgctacattctctgtgaaagtggttgctctcttttctgtgttggtaatcatacctttcagaatgttcagggttgtccaacttttgtaatttcattctttttgataaagtttctttattaattgcatgaccaaatgtaagctaatatttacaactttgaaaagtttacacacgcacacgcgcgtgcacaaattagaaaaaatgttctatcccagtatttaagatttatttatttatttgagacagagtctcgctttgtcgcccaggctggagtgcagtggctcgatctcggcttactgcaacctctgccctctgggttcaagcgcttctcctccctcagcctcctgagtaactgggattacaggcgtgtgccaccatgcctagctaatttttgtatttttaatggagatggggtttcaccatgttagccaggctagtctcgaactcctgacctcaggtgattcgctcacctcagcctcccaaagtgctgcaattacaggcatgatcaccacacctcgccatatttaagttttaaaaacatacattagtttggcaagtactcccatcttgaaatatctctttcaatattgccttagatgttatttaaattaaatcttgtataatttaaatttttttatgccccaatcagattgtacattctttgagaatggaatctcatgtccatctttgtatattctacagcactcagaagcattccttttactctgtagttctataagaaaaaaagtaattgatttgattcatatctttggtaatgttgcttaggaaagaaaactttgcatggaaagtctgtggaatgcctgtgtgtggaagccttctgtttccctttttaaacatgagattgaaaagggaaaacaaactgcacttgtgattgctgaaagtttaatatttaccccctgcctcctagtaactttttgaatgtcttaagataccagtgaaaacaaaaccagtatgtttgggacactgtggtttggaagaatgaatgcattttttttaaataaaaatgcacttcactagtagtattcattttccaaggctgtaattggagagaaacactcgagaagcaccaaaattgtggaacataaagagggcagtgacaggaccccaattaacctaaattagcacaggttacccagactgtgataactcagagctccagaaactccccaaaatgaaaaagccttctgcttttagcacttttttttttcttttttctccccaaagacttcaagattcaagtggaaaagttcaccaggatgggtgggacctgaacaggctgactcactgcggttagattcagactgccaaggaaagctgcagagtacagttaggcatacactacagctggttttgatgatattttcttgttaaagacaacattattaaaaaaatgtgtaaataggacagggcagtggaggccccctcttgattttatagccaaagactcccacccttccgtggcttttctgtaccgtctgccatgttgattctatgtaaaaaacccaaatgcaggcattccaccaatgtaatgctctccttctctgagagtcctttcatttccccaagagctttggaatcattggagttacagtggttccgttactttattcttatataactttgggcaagttatttgaaccttgatctcttcactagtataatggttgtaaaaataatatctatctcataagttaggaaaatgaactgaaaatacactaaattaaatatgtcaaatatctagaaaagtacctggtgcataatgagcactcaaatagtatttattgttattagctactattgtgatcttcttaataaatcctgtcaaatattatttcaaaaagactctttctctcccgtccttttcatttttagttttatcattccatttaaagtggaaaagaggccaggcgcgtagttcgcgcctgaaattccagcactttgggaggccaaggagggtggaccacttgaggccaggatttggagaccagcctgaccaacatagcggaactccatctctactaaaaatgcaaaacattagccgggtgtggtggcgggagcctgtagtcccagctactcaggcaggagaactgcttgaatccaggaggcagaggctgcagtgagctgagattgcacccctgcactccagcctgggtgacacagcaagactccttctcaaaaaaaatgaacaataaaaaaataaagtggaaaagaaatgtacatttcttgacttcctagtttcccatcctacccaatcaactaacacaccaataccctccttaaaactattcaacttattgtgaataccaggtagaggcagaagagatacaaatccaataggatatctaatttttaatacttttcagctagtttagttgatgaatatttactgagcacttactatgtactacattatgctatattctagagactagaaaagaatgggcaagaggtgttttctgccctcaaggagcttagagtcttggtatatattctgggattagagagtaagagaaggcatcctaaaattaaaaaataaataaatttaaaaaggcacctgagctgaatcttgaaggatgagtaaactttaaccaaataaacaataggagagaaaaggttttcaaggcagagggaacagcaggtacaaataaatgaaagtatgaaacagctttgaattgcaagcagttcagaattaatagagtaaaaatcatgtaatagagaatactggaagacaaaagtggatttacagtttacctagagaggcaggaatctggtaggatttcaatctgcatcaatctaaataggaggaactagtgattccatttccaaataagccaacaccttcattagcaccaaactttcaccagctgagttccccaacataggacatgcccactatctttaggtcacaaagacatcaggtgttttcaggctcaatcatgagttattgggcaagttcctttgttattctttttgccattagttcatcatttgtaaactggaataataatcatggcttttcttttttttattatatttgaagttctgggatacatgtgcagaacgtgcaggtttgttgcacagtatacgtgtgccatgttggtttgccgcacccatcaacccgtcatctatattaggtatttctcctaatattatccctcaccttgccccacagcccctgacaggcccctgtgcgtgatgatcccctccctgtgtccatgtgttctcattagtcaactcccatttatgtgtgagaacatagggtgtttggttttctgttcctgtgttagtttgctgagaatgatggtttccagcttcatccacgtccctgcaaaggacatgaactcattctttttttatggctgcatagtattccatggcgtataagtgccacattttctttatccattctaacattaatgggcatttgggttggttccaagtctttgccattgttaatagtgctgcaataaacatacgtgtgcatgtgtctttatagtagaatgatttataatcctttgggtatatacccagtaatgggattgctgggtcaaatggcatttctagttctagatccttgaagaattgtcacactgtcttttacaatggttgaactaatttacactcccaccagcagtgtaaaagcgttcctatgtctccacatcctctccagcacctgttgtttcctgatttttaatgatcgccattctaactggtgaacatgccttttcacaaggttgttgtaaatgagatcatgctgtcacatacttagagcaatatctgccacatagaaagtgatcatcaaatgctagccagtattatgtatgtgctgctgaagtcttgctcattccagagatgctgcagctgggtgctgtgatcagcgagaaagcatagggcaagggatttttctcaacacatcattgtgaccatttgtaggtaaaatttatttctgatccaataatgtgttcagatttatgatcatggtacataaacttatggccctgaaaaagtcacaatttccgtgagtcctggttccctcacttaaaaaatggggagagtgatgcttgttccgtgtcttataaagacaaaataaaacaacttatgagatacacttaacccactgctcaatacactaaacccactgctcaatacactaaacccacagagaatcccttcatcagtggattctctgagtggggaaaagcgcctacataacgaagttggtaaggttgggaaattaattaaatcactcactcattcaaaaatacaaatgaagcatatatgctaagcaatgccctcctttcatcatggagtgtaatacctattgacctcaacctgacaaacatacaattggagtttgtatacacatacaaccatgctgttggttgtgggtggagaatgaaagaaaagaaacactgttgtatgttggaaatgttgctttctttgtcccttttttctacaccaacataaatgataattgtcactttcgcttgttaattgactaattatgttttggttccataatgtgccagtatttgcatttttagtctgttatctctttccctgtaatcaaagagccttttttctctagaatttcctacatcagcaaacattttagaggtaactgcattactgaacaattataattacttttgacagattgagcacttttagtattacttctctcctgttctaactctctttttcttacctctctatagtccagtctcttatttgaacatatctctcttccttcccccaaatctcccctctgtctggaatattatactctacttccctgactagtaaaatctaactcagctttggagaccttgctcaacgtgaagcccccaggagaaatgtcctctggtaagaggcctttccctactcctttaataaaagtagacattttctctcaagatctcagagtgtactgtccttatctctatgaaagcacttgccatgctatattgtatttaatgcaatgtctgtacttccaaatagactataactatctaagggcaggaactaaagtatctcatttaatgtgatcatgtgtttgttgcatggataaatgaaataagaagggattcctggctgcttcttccaggcctgtctccctttgtctttaagccctggaggagtcgaccctactttggcaaaaaacatttagcatgtcccctcctctctctgagtactgctacctatcctatatcccaaggctaccaaatgcatattttaaactttacagaaaataccatgttatttagtattttaccatttttagggtagggcataggaatgtgttcctatctctcctgtattttttctaaccaatgttttctctaatttttaaaccctttcatggaggcgttttgtattttaggtgctgtcattcagagtccacaggatggatgaatggatatgaaaatgaacaaacgtgtgacacaacactgcatgatttacctgcaatgactttctgatcaagcctgaagtgggttgtagcctctttatttactttttatttgacacatagcagagagagatttaaactatctcttattggccttttccctgcgtcttagcttggtttctgtcagtgtttcccagcatcgagaaataaggactaatctgtcatattagatctaaactctaaaagaaaaggactttgggccttatatctgccacccattctttcaatggaggtgacacccctcatttctatatttccagtcatctctcaatgaaaaggaacatgcaggctggctggcctttggagagcaccccacacagttttgaggagctctgcagctctgcttgccctttctgcatcacagcagatccaaaaggtgaaaaaaaaaaaacaaaaaaaggagggggttggggtgttagcatccttgcttcccccaccagcaccacacagctgttcggaggtttagtcttcaaaagcctcttgattaccatgcaaactctccatgtcttaaaaaaaacatacacacagtatacatgagaatgctaagcataaaatttgaagaataggctgttaattcttaggcacacgttatatggtgcatattctttgcccacagaaatatctggtaggatgtacagaaagtattggtgaaatatttctacttacaaattgagggaagatggggtaaacccatgtcaacacaaaattttttgagattagaattttactttttttttttctgtcaaaagttatcaattccaattccagaatgagagaaaccccagtatctcacagactatttacacattatttatgtgggacctgcttgctgggtatccctgagggggcaccaaagagctatttctttcttccttttttttttttttttttttttttagagcacaagagtataagaaattccggctgcctgtttctgggctatttaaatcccagtagacatgctctcttgtacagacttcctgggctcaacccagctcacagggagctggggaatctgtattacattatcagttattgtttttggtcaaatctaaggacaaacatatgaagaagcagagcatgcagcactggttcaggaggttcaagcaacattatcagattcttgttgagaaacaaatggttgttactgtgccaccccacactgcagacaattcctagatatcgagagaggtccaagctagcaacagagaatttaatactagctgctggaccgggactcctgggctcactatgttgcagctacagattctcagaatgccatttaaacttcctgagtttatctgagaagtaaaccaagggtgtaggtgatgaggcagcatttactggtacagttagtccccccttatccacagttttgctttccatggtgtcagttacccacagtcaaccacagtctgaaaatgttaaatagaaaattctagaaatgaacaactcataaattttaaattgcacattgttctgagcagcatgatgaaatctcgtgccatccactctatctcacccttgaatcatccctttgtccagcacatccaggctgtatatatcgcccaccagttagtcactcagtactgtctgggttatcagattgttgcagtatcacagcgcttgtgttccagtaactcctattttacttaacaatgtaaaagtgcaagagtagtaatgctggtatattgttataattgttctatgttattattaactactgttagcctcattaacatttaatttataaattaaactttatcctaagtatgtatgtatagaaaaagacatagtaaatatagggttcagtactatgcagtttgaggcatccaaaggagggactgctgtacaggcaagggtccataaccacaccccccagcacacagctgacagagcatatgtttattgggacatgctcttgaaagagacaccataatgataataccatccataatccggaccaatccatgggtcatatttttatcaggcatcactattccatagtactgcttctaattgggataacaattatccactcacatgacttaccttctcaaagtctcgaagagcctgggtctgtacctgagggggtttctcaaatgctctcaaggaatatgtctgcacaaacgggaccttttcaccacttctccagatctgtgactgcactggagggcctcgatctttagtgtcactaagaaaagctgtcaattaaacagaacaacaaaaaaaaaggtttatataataacagcactaggatcattctaactggcacattccagcagaattcagtttctgcaaaatacaaactcaatctaggccacatagaaacagtttacttaaagtagtctgtggtagatcatattaatagccatccccagtgaatcaaactagtttgggtccataggcctttgcaatgtgatactcctgccattaagaagtagagcctatttccccaactcttgaatctgggttggcaaagtggcttgccttgactggcagaatatgatataaatgctactgtatgagttccagagactagctttgagaggccttgcatttctgctcttgccttattagcatcccaagacaaccatgctgtgaagaagtcggtctaccccactggagaaggaaaggctgttcagggaagtgaagatgccccagctgacagtcaccacctgccagacatgtgagcaaggctgtctgagaccttcagtctcagtcaagccatcagaaagttgcagccagttgagtgatcccaagtgagaccagcagcgataatgcccagtttgccaaaacagaattgtgagaaataataaatcattgttgttttaagccaggtgtgggcagacattttcttaaaggaccagacagtgttttaggcttgtgggtcatatcatctctggcacaggtactcaactctaccctgtaacacagagcagacacagaccatgtgtaaatgcatgagtgtcactgtgtggctataaatctttacttataaaaactgactgttggcccatgggctgtagtttgctgctgacccctgttttaagtcactaagttttgggatggtttgtcacataacaaaaggtaaccaaaacagtctaaaggaaagaaccaagctgctagcaaactatctctaccgataatttttcaggttactatttagtaatagtaacaattataacagccaacatatttaaagggcattacatgttacaaaatagtttcacatgaattatttcatttatgaagtcgctgcaatcagtgaaatagacataagtgattattaagtccattttactgatgaataagtaaagattcagaaagtttgcttgaccaagatcacattgctaaaaagtggcagaaccaatcccatcttttctccatctgtctttcttagcagtatgctactactgtgttattttagcaattaaagggattgcaataggtctgagagtggggaaaacaggtaaagaggcagagactcaatcactccattaaccaatggaagcattgctttgggagaacctagtggagtctaagctgtaattaaccctatgcttgcttttgagaagtaacattgttaaagaatgagaaagcaaagcctctgtcaaacaaagtacacagaggacctcatgttggggcagggttggagttacagacaggtagaaaacatagaaagctacatactttcttggctgacagaaggaaataatgaacttttattatggaactattttttaaataagaagacagtcatggcaaagcattaagcgctacagacagtgtcagggcaagtaagagcaaaacaggtactgggtgactgcctggctgaggaaaagttaactagacacttggggaaaggagatccaagggagtaagaggcaaaatgcctttgcatgcttttcttcctatctctttttctttctctccttctcactctctcccttccttcctttcttcctttctctttctttttttttttctcttttcccccacctctctgcctgcctccttccttccttccttccttccttccttccctccctcctctctccctccttccctgccttctttccttcgttctgccaacttgccagaaggagcccaagaaaaagcacccagatgcttcagtcaacttcttagaattcttcttttttttatgttcagaaaagatggaaattcatttctgctaaagagaaagaaaaaattggaagacagggtgaaggtgaacaggcccattataagaaagaaacaaaaatctatattctgtctacaaggaaacgagagagagaaagagagagaagaaagaagttccaggattctaatgtaccaaagggatctcctttttcttgttttgttctgaaaatttcaccaaaagagcacaggagaacatcttggctaattcattggcgatgatgtaagaaaactgagagaaatgaaagaaatgaagaattactgctgcagataatatacagccttgaggaaagaaaggcttttaagattatagatataaaggctattgctgtattctgggataaaagaaagtctgatgcagggaaaggggaagttggaaaaactggaaaaagaaaaaagaagaaaagaaaaaaaggactggaaagacattggtgaatagaaagatgaaaagggtgaagaaaaaaatgatgatagtcaatagggtggttttaaaagaggcttttgttttattaatttgtttttgtgtgagtgtgtgtgtatgtgtttgttttttgcctaaaagtatttaactccgcattacaccactgatttcaaagaaaaaaagctgaaatgtaagatcatatgatttgtttttaaactgaacactgtatactgtctttttatttttgcaaaattaatgtagtatccagtgtgtctttagataaccctgtccttaatgatattttcaatagccactaaccttgcctggtactgtttcggggtttaaactagaacagaaatttaaggcaggctttattagtgcatagtacaaatcaattacatatatatggagatattatttttccctcttcaattgtttttcgtgcagcttacccaatataattgttctgttagttgtacactactctgtgatagcaaataataataataaaataattatgatgatattgcccctgttttggtgatattctgaatgtttatacgtaaatgcaaaatttttaattaaaagtaattagaggctgggcatggtggctcacacctgtaatcccagttttttgggtggttgaggcaggtggatcacttgaggtcaggagctcaagaccagcctggccaacatggcgaaaccccatctctaccaaaactacaaaaattagccaggcgtggtggcaagcgcatgtaatcccagctactcgggaggctgaggcaggagaattgcttgaacctgggaggcggaggttgcagtgagccgagacggcaccactgcactccagcctgggtgacagagcaagactctgtctcaaaaataaataaataaataaataaatgtaattagaaaaaatgatttcttccacatttaggtgaaattaaatatactactaaggggaagataatctgataaaacagaataacaatacattacagttagattggtggatatgatagaaagagcaatgccttgaggcttggatttgaatcctgaccacttgctaattgtgggaatttaggcaaatctcttaattttgctgatatattgcctctgtaaaacaggggtaataatatctgctttatagaactgttatatggattaaataaaataataaaagcaccttgccacatgtattatatgtagtaagcattttatccattcccctcacatttttgccctagtccttcaatttttgcctcaaaatgtagaatattgacatttaaaatgttgagcacagtaacccttggaatttgtggatttaacacacatttcaaatactaattttaagtgactctgaaattcttaacttattcaaattaaaaacttttttccaaattgtgcatataaacaatctgtgcttccaggctgttatgaaaaaggcaaagaacttagcaaggaagtaaaaccctcaggtcgagaacaagttttgtggaaaatagaccccaaaagaatgttatcttccctttggttttgcaattcaggtagatctctggctaatgttagtgtagtaataattgtgctgttgttaggaatacattaatagtgacaatagataagatacagagtgcttattccttgatagcctctgtactaaaagcttttctcaatctcacctatgagattaacattattattatacccattttatttatttattattttattattatttaattttttttgagactgagtctgctctatcacccaggctggagtgcagtgccacgatctcagctcactgcaacctctgccttccgggttcaagagattatcctgcctcagcctcctgtgtagctgggattacaggcgtgggccaccatgcctagctaatttttgtatttttggtagagatggggtttcaccatgttggctagcctggtcttgaactcctgacctcaggtgatacgcccgcctcagcctcctaaagtgctgggattacaggcgtgagacaccatgcccggcctattatacccattttaatggtgtattaagataaagatttcattttagtaacataatttattttaatcattgtacaagtgagtttagccttgcaattacagaatcgttaaaagtatgaagaattcacataagtatctgtaatgatttactgtactatgctgcttctcagtacatagaattatagctagcttataattctcgtgtgaaattgctacagtagtatgtgcaaatttggaaattcacaaaagtttgaagatattgccatgatgaatttaaagaggccataattcaagagaattaagatcaatagaaaaccaagaattggccaagtgccaatttctctcacacactttggaaagctggagtgggtgtattgcttcaggtcagacattcaaaaccagcctgagcaatatagcaagactcccacctctaaaaaaaaatattaaaaattaggcatatgtctatagtcccagctactcaggaggctgaggtgaaaggatagcttgaccccaggagtttgaggttgcagtgagctatgatcacaccactgcactacatccatagtgagagagtgagaccctgtctcaaaagaaaaccaaatgaataaacaaaagaaacaaagaatttaacaaggcaaggcccacagcatccttacctgctgtgtgactcgttctgggtaccatctccccatcatcctctgcaaaataatctctgtggaggcaaacacatcattaattaatgagatactaccccacaaggctcccatcccagggatcgaggagaagacacctacctatttgtcatttctatttatctctctgcaagtatttactaagcttctattatgtatcagggaccgtgtcaagtgctagggatacaaaggcaaacaccacagaagagttcctattctcaataagtacatgagagccagccattaaataatttcacaagaattaactactattgtagtaaatgttgtgaaggaaaatgcagagggaacttaactagcacagggactcagagaaactcagggaaaggaacatttaaacgtagatgggaggatgtcaaccaggtgtagaatgggagaatgggagtggaagagtgttccatcatgagagaacagcaaaggccctgagtcagaaaggactctggcctgttagaggaacaaagaaagccaatgttgcaaccaggccacgcaggaccttgtggtatggggtaaggccactgagtctaatgtgaaaagctacgggaaatcaatgaaggattttaaattaaggaaagaatggcaatgatcagatttatattttagataggtcattccagctgcattctggctctacacagtgagactgtggaggggcaaaaatggatggtgagaatctatattccaaataggaagttgtgatggtttaacaaaggggaaattttaaaaatttaagatatgtttagaaagtagaattgacacagaaaccttgaaaaatagacaaagtttatgagtggaaatgttaataacaccatgattcagtagcaagaggtgtatctgttcagcatagtaaataccaccatccctagcagagaggggacagtatctcaaaatgtattcaacaaatacttctcaagcccatgcttgacaagtgcttttaggcactgttgtaagctccacaaatgtagcagtgagcaaaacagacaaaaatccctgcactcatggaatttttacagtaaggggagacaataaataaattgtatagtagcagttgggaacaagtgctataaaaaaaaggaaagtggggaatgtggatagggagagctggaggtaggaggaggtagaggggattgcaattttcagtagacaaggctgctctatgaagccataaggacaggcatgggggtctctagggaaagagtcttctaagcagagaacataaaatgcaaaggcccataagagggagcatgctagttagtggctgggtgcagtgagcacgtggtgagcagtaggaggtgaggtcagggaagtaatgggaagactgggcagggggcgcagactgtttgaagcctttcaagacatggagaggcatttagccactagagtcttgtgaatcaaaaagaaagacggactcagtgactaatgttttaaagggggactgtctactgtcttgacaactgactgtctgatggggatgtcagaaacagatgatttcaataaccctacagaaagatgctttcaataggtagcttattctttaaactcttgggggctcccaagaattctgtaaacagagatgtagaggacttctctctttctctctttttttttttttttttttttgagacagagttttgcttttgttgcccaggctggagtgcatggcacgatctcggctcaccacaacctccgcctcccaggttcaagcgattttcctgccccagcctccccagtagctgggattacaggtgcctgccaccatgcccggctaattttgtatttttagtagaggcggggtttctccgtgttggtcaggctggtctcgaactcctgacctcaggtgatccgcccgcctcggcctcccaaagtgcagaggttacaggcatgagccactgcgcccagcctacaggacttctctttttaaaagccagaagatattcacagggaggcagaggaggacctggcatttgcttggaaattggtggttttttcttccctgcctcagggctggatcttggcagaaatcttcactttgttaagtcccagatggacatgaaaataccagacagggcacatcgggctacacatgccacctgacaattatttcgtatccaaaagtagatcaccagcttgtgattcttccaggccccctgcctctttcccttctcctccttaaaagctttccctgagagtaaacaatgccaaagaggaatgtactacgtatgcactcccctctgtggaggtaaaataggagaaggatgtcaaaaccatcaaccagaacaatgtcttaaaaaaatctgtggggaaaaaatttatacttagctgctgctattcactgagcatttctgcctagtccacagacaaaggtggctgcatctgctgtcaggagcaaggtcaaccctcaggccaaattcagcccatccgacatgttttatttagcccacacaagtttgacccacttctaactgctcttgggaaatgagtgggtctgccaacactgggcctgccttcccacacagcgggagaacttgccccctttacacaggacagggatgtgttttccagtttgccacagtccctgccactccctgtccttgtcgtccctcattcacttaattatgatacttgcctggcatcttgcaggtttctgatgctgttaccccagtatagaccaagtgcagacagaatttcatttctgctttattaaggcacagtcttgagaaacccattggcttcacacacaattaattaatttgtggcaacaagctactatattggcttgcatgtcactttcacctctctgggcattagttttctctaatatttataaaagaaggacatgactttctaaggttccttgcagtaattatgcagttctattctaatagatgcttaagcataaaacccattttaatactgtccaaggatccaggataccttccagacatgatctcactcaatcttctctgctctgcagattgcacattataggtcaagagcaagctacaacacagcaatacatatcagccctaccagacacctcacccttcccgcatcacccacacccactctgagcacactgcctgcctgatatgaatcaataactggaaggatagagaggtcactttagatgggtactgagttaataagcatactcgcagtgtctcaggagatttttaagaaatcactttagctctattaacagctcaagttccctctcttattgccagagaaaggggctcactcagctgctccacaagttacaaaggaatctgacgctccccaagggaaggggctcagactgaagaaacacagagtataagtctaaggggttgcaatttgtgacaacatttgataaaccaaagtgcaaggagaattggggtatggtagagacagactccaagcatggacacacacacacacacacacatacacacacacacacacacacacacacacacacaaagtggtaatatatgttggtacattctttcgtattacccaagttcagaaaaaaattttatatccttgtcctagtttctcaaattcaagtgtctctagttttttaaaatatcaattcatgaatgactcatgctcagctaatatgtggttcaccaggccacttttagctctcctgcatttccatatataatctttctcccatgatgctttcacttaaaattttgctttttctgtataaatgaactatatttttcctcaatgtcttaccttgtctttctccctacgtcatcaatctgctaatgacaataccaattccactaaaaccacatatattaatattctcaccaggacattattttgctttcggaagtaccaagcattttccaagtacaacctactcacaagctgttcacctgcttgatttctgcatggtatatcactcatattttcttgagttgctgataagtagctattaagatattagactcaaataacacatcaacattcaatatcccatattacttggtttttctatggctttccagggtgattaagttgagaatgatcaggaaataattgcttctctgaaggccatctgccaccccctgatattctgacattctcaaactgtcctgtgatgatttcttccagtaattttctaagaatggtagtttcatttatggccagggttatccaaaacactcagttttgctttacttgaaactggccactgatatagctcctttcaagattcaagcatctcattggtcccactagtctagtttctcataacattgtggggaggggtagacacttgggtttcttcttgcttaggagcctgcagagagagatattttctataaggcaggtatagaccttcctccgtaaactgttatttctggtattattttcttgtattttagtctgtctaatttgtggactgagaggaacaacagatcatatgaatgaatcatctcattcaaaagcaatgacaagatggtaatcatcattacaaagcaggttctatgagtctttgaacagtatgagatatttgtattctaggaccaaaatcaccactaaaactatttctaaggtactgatgcctgtctaggctccatactttcttctctccagtctcacctactaaaataattaacctaaggttatttattcccatatgagtgtctaaactcccaaaggaatggtgattttcaggccctctcttcaggccaatcacaggtatttagtttgttctgagaaccacatagtctggccctcctacttcatcactaaccaccacccttgcttaacatttctaagcctgaagaccagggccatctcccagaggtgttttctagctttcaagcttctttatatatatatatatattttattattatgaacaaaaattcagaaggagaaaaaacaatctgctatagcaatacctagagcgaaaacctgggccttcattgctatttttagggtttttataattccattttgtaaacatttattgagaagttgcttatatgccaggtactggaaatacaaaggtgaaaaagtatatataccctgtggttaaagtactcagaatctattgagggaagcaggcacatgattcagagagataattattagaaaaattagatttaacagagatttcagaacataaataagatagcaattaattttgtcctggtggggagtgggctgggacagggtggttggcggaggggtctaggacatttacagaaaacagataacactgaatctaggtcttaaaggatgggtgtaaatacacaaggaaacataacaaagacccaattataggaaaatgaacggtgtgttcagggggctttcattttgttttccccttcccaaccaccccgctccatcttccccccaccctgaggagccctgaactgcctcctaggacatcttccaacttcctgtttacctttccccctcctcaagccttcctccccaagcgctcaccctcaggtgggaatatgaagggaagccaagggtgaaattgtttcttcatttgcacctccctcctcaaacactatagcttagaagcccccaaaatgatttaaaataatgtcagcaagaaaggggctaagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaagaaaggggctaagatttgcactattgtgaaaatacccatagaaacaaactagaaaagaacccagagaaatgaaaagtccggaggtttagagtggcggaaaatatactgagcatcctccccctttttttcttactatttttgccaaaaggctaattcttatttttaaaaagtttgaataatctatttttattgaatttacattgctcttcctaattaatgaccttgataaaagataactatggaaaggattcggctcggtgtggcctctcaaacagtgaggggcgtgtggcatgacagcaagactgctgaagtttgctctttcttggggtcctcacaggagtaggcattgaaccaaatgcagattctgttccaattcccatattcttggagctcatttaacatgagttgctggtttctgtttcaaatgaaataaatttttcaaacgttccaagatgcatttttcctatttttaatttacagctatattcaactgtggcaaacacaaaagggtcagaatgagaagaactgtggcctattttttaatatgggaagctctggccctgacagtttataaatggtaagattttagaaatagtgtcaacttaaaaacaaagacatctacagttaacaatttctggactgctggtgcataattttataattccacaggttttcttgcactggaattttcctcaatactaatcttgtattaaatgaacatattattatcatggacaaccatcaccactcaccaccaatgctgcctctgcaatttactgaatgcctgatactttctaggcatcagttcattcagtcatcatagaatcctgtgaagtacgtcatacaatccctgtttacagatgaggaaacaaggggcctggaaggataaagtaatttgcccaagatcgcacagctagttggtgtcagagcctgaacttgaaaactgtctatttgactccaaacttttactcttcccaatatgccctatttctaaccacacatttacagggaacctcctttgtacctgccttgactccagggaactcacccctgagaagctgaggcgaaaggaagggtggacggtttgctgtgctgatgagatgggatttttgtctcaaaccctgacacaaatttgtttcttagactatcaacttatccctgatgggcacagcttacacttgagtatttgagtactggtgtaacagatgccatgtgacaaaataattaaaatcccaaaacggaagtggctagtgtgactttttatataggtcctatcgtgaaaagtgagtcatccatcattttatacttctctatctctaacccacttttttcagaatatttacatctttctccaacccctcccgtgataacacttggcattgtccctacccaagggaataaactgaaacgcgggaaaggtggtggaaacagaaacaatcaaagtggaaaaggcattagtgaacaagctctgagacttctcagatgtgtttttttcctcttgccaaggagagacactggatatattttctatgttccaaatgttgccaaataccctcccacaatgtggcacccgaattgtaaaaacacatattcaaatgcaaatagggtaaaagccccagatgcagaacgttaagactattatataatacagtgaaattatcattttttctcatctcaagatctatcattataacctctgcaagtgaggatgcttaattggcaaagctcccagaggagagagagcatcacggtgagcctccttctgcatgctgactaagtgtgggctgacttggcaccgatacagaaacatccactttattccagtataggctgcaattacacccttcactcaaagtctattcactgacagtgaccatcactctgagaggctgttttctgcagtgctaagtccccaatagctacagtgagctacaaaatcatcgtgcatccacaacaatttctttaagtttcgggatctttgttttgttttgtttttggtccagcactaagtcttcatcctaaagaaaataaggaaactaacattactttcttgatgctatccatcaaggttcagagaaaccccttaataagtaagtaattatttttcctcactttaccttctgaggtcatcacatatccaaatatctaataaattttcctctacctcccctgcatcagccaagacataggtatcactctttcaaaagaagacatgaaaataacctgctttggattcagtcacattaccccagggatggtgtatggtctctccacccacctctgaaacttaccttttgcattttgcttttggtcctggcaatgcaccctacaatcctcagttttcattaacaactaatatccacaaggcactggagtatattgcagttggctcaatctttctagagccctagactgaatgttaagaaacaggtgatttttttcccctttccacctacttttatattcacataatctttcagtttcttttctttacaatgtctatttttgatgattttaaaagaagtacatgcctcgtagaaattttggaaaagagaaaagtgtacagagaaaaataaaaataatctttaaaattctaccacctgaaggcaacattgataaagatttgtatgtatttagttgttcttcagtttatttgcctgtgtgaattctgcaaatggaaataatattgaatgtaacagttctgcatcttgcttttatttacactacggaaatcaaaggttgtgaggaatatatttttagaggaagagaaagagtcagggaaggaggagcaggagaaagaggcaggtgggaggaggaggagaatttctcagcagcattatagacctgttgaggattagcaagaatgaatctagagtctctcttctcagtgcggttttataacatactaaaacaacactcatagaatcctctaggattttaaaataaaattgactaagggttaccaagccgggagatggttaaggcagttagagattctaaagcagcgttgagaacacgattcaaagagctgactctgacgtctaggttcagtatggaggtgaataaacagcagatggcctggaagatacagagagttgaggaactggaatacatgacgcagtaaacaacattcagaaagaatgaggaagtggggaacttgacctgtggtcaagaagtataatttcagcattaaggatcctaagggtggaaaatctggaagaaagatgagctacaaaagatggctgtgctgatagcatactgaagtgaattcgagttaaggctatgtcaggtcaaggtataacagtgatgtatgtccatgcctagtgacccctctagaatgtcagtctctggaagggagggtttttagatcattcactatcatctgtccagcattaaagaagtctagatcataggaattggatgcgtatttcttttttttttcttttcccgtaactgaggaaacaagacacatatttcttaaacaatgataaatacaatctgaatgtataatggtgtcaagtttgataacctgttgtatccattctacaataaggagacacccaccaaacagatattcccatcggccttttggggaatgttctctggaaagctcttaatagatgaccttctaagtgctagaggcaatgttagatgctgaagacttatagacaaaaacgtttcattctgccgataaacttggagtatggaaaatatcaagttaaccaactagctacatgctacaacagagtaggcagagcgtgttctggctacacccagatctaggttctaaaaataattcctaaaggaggtacttctgaatctaacctctgaagggtatacaaatttatcccagcaaaggcaaggctagatgtgtaggtgggaacaactggtatattaaggcccactcataataattttagctcagggtaaattaagtcgcaatgactctccaaccagctccccgggtctgctggcaataatgctgctcctgtggtgccaataacctgaaaatctccaagtaatacaagaaagttatacacagaaaacctccaagtgatacacagaaaaacctaaaaccaactcaattccaaactttacatgttgtcatttggtagacacaaatgtgaacttcttcctgcaataaaaacctatgttgacttagtttaaaagcagcatataaaggatgttgcccataatcccctaaccaaacaaggcatctattttctcttttctctgtccttgtaatagacatcctaataggtatacatagttttgatgtaatttacatctatcttttactttcttatgttaaaattttctgtttattatcatttcaggaaacgtttcaggatagtaatagagattaacagcaacagtgaagcattttaccctagagaagggtaaaagttggaaatgttgctattgattcacctaggttatgccactttaatgtcagtgtgcctcagtttccccctttacaatacagggattcaggtcttgaaaaagatatttaaattgaatgcaatatctttcttatgggactataactttaagtaatttgcaatgtactttcaagaactggaaatgttgacatagttattctacttctgaacatctctcattcaaaaaataatgctgtggaagaagatgctttatgcacctagacatttatcaagtattatttataatagttaaaaattggaagtctacatcctttgggttaggcgtaatgatttaaaagacactgtaaatccacagcatgttattctacattatgaatgataatataccacattatgaagtggaaaataaattcattcttaaattgtgtgaaatgctagaaattattcaattttctttgtgagtcaatgctttctagttttttttttttttttttttttttttttttttttccgacagagtcttgctctgtcacccaggctggagtgcagtggtgtgatctcggctcactgcaacctccacttcctgggttcaagcaattctcattcctcggtctcccgattagctgggattacaggcaccccccaccatgcccactaatttttgtatctttagtagagatggggtttcaacatgttggccaggctggtctcgaactcctgacctcaagtgatcctcctgccttggcctcccaaagtgctgggattacaggcgagagccactgtgcctggccagtgaatgctttctatatgtcagaagttattgcttctttccaccctttccaccatgaccatgataagaagacactagttgcaagttacctcttccctcactggccttggaaaagacaagaaagaaagacgtttctgtggaatgtaacaagcagaaaaggactgaagataatgagacagattaaggaaagatgaatcacaggctgtgaaagtgctatgaaaataaaacagtattattatacaatttattataaatagtctatgactaatttagcactttagccataagcgttcagaaaaaagaaattcagatcatgcttgtcttgctggccacagaactcagaaaatgctctgaggcagaggaaaacaagtcctcagtgcatttgagtgttttaaaatagaatcacatagagccaccttgggtcaatatgacatctcttgtattctggactttcttctaactttaaatgctatttgaatttttgccagagacaacttgtggaatgttctgagcccagtttggaattttatttataaaatggggtagatttcaatagaagtagtgtcctggggcatccactgaatggatggatgctccacttagccttgaaaatatgatccctcagccacagtcaggcgagcctcccaggatggggacggcaccatgaggtgttacttatcctttctgagacaaaaacaaccccttcccagtctttaggtattttaaacatagtcttagcatgtagctgaaaaaatgggggttgggggagtcaggtccagactgatctagtgtgtggaaaataagcaagtaggagtgaaagcattgattctggcaaattccccaagccgaaatccaagtataggcccatttaaaagtagactggagttgccaaggcagaatttccttcttaaaattcagataattagttgctagcagtgctgaatattaaacaggaaattcaacttccaaagatgtttcaataatagaattctgaaaacaagcattttcctaatatgaagtgttacatgcaaagcaccagcaccataataagtaaaggtactggaattaactaggccttcatacaacacatactagttgtgtgaatgccagcaaatcatttaaccactttaacctcagtggccatatatctctggttgtaactatgtctttgtaaacaggactctctactaactcaccataaattcagagaaaaataaatgtccctgattcctctaggctaaacatttatatagagaaaaacaaattcaaataagctatcaatggagatctgttaagtacaatatagctgtggtaaatggacaccttgtcttgcttgaaggctgtactccagaaaagaaacaaagtcaaaattcttaaattttgaaaccagatcattaattttcttgaatgttacttccattttccaaattttcacagatacagcaagcaaatgcaattaatgcttgcattttattaaatcaaattgcaggggaatagaaaacaaaacaaaacagactaatttgctttccttttttaaccttcagtcttatagtttgcccttaaacatttctagttcactcttttcttgagttatgtgttcggggaagttgtataaggttcatatatgattcacctgatgtttactcagctttctcatatgctagaaaccagaacatttccactgaaatggggaagataattagtaatgactttttcagcattgaacgatgtggtaggctaaaataatggccttataagaatgtccacattcctaatccccagatcctgtgtatatgccactttccatagcaagagagggctttgcagatgtgactaaagattttgagatgaggagattatcctggattatctggttgggtccaatgtaatcataagggtcctagtaagagggacactggagggtcagaatgatcaaaggagatgtgatgatagaagcagaggccagtgatggcattgctggaaggggctatgaacccagaatgtgggcagtctctcgaagccatgaagggcaaggaacaaattctcctttagagcctctagaaggagcacagtcctgctgataccttggttttaacctagaagaccaaatttcagacttctgacctccagaactttaaggcaatacatttgtattgttttaagccactaagtttgtggtgatttggctgggcgcagtggctcacacctgtaatcccagcactttgggaggccaaggcgggtggatcacttgaggtcaggagtttgagaccagccaggccaacatggtgaaaccccgtctctactaaaaatacaaaaattagctgagtgtggtgccatgtgcctgtaatcccagctacttgggaggctgaggcaggagaatcccttgaacctgagaggcggaggttgcagtgagccaagattgcaccactgcacgctagcctgggcaacagagtgagactccatctcaaaaaaaaaaaaaaaagtttgtggtgatttgttacaccagcaacaggaaattaatacaaacagtaatcctgaagtactgataatctttaaagcagaaggtgtagggagttgctagtccagacaggtggatgctaaaaatttagagcagtagaagctgtttgcctggttgacactggacctgccgggtgagaaaacctcccctcatcatcaagttcttcatcagctccatgagcttattcttttgacaactctcgccctgttcacggaaataaatctgaaagctggtgaccaaatcagctttttgtaatgccagtatattcatagaaaatttgctattccagagccaaccatgctctgtccaaatgatttaaccagtgagtttggcaacagtcaggtaacggccccagcgggtagggggaacctttccattgagctgtagaggggcagatgatgtgtagctgggagtagagcatatctaactttgagaactaaaataccaagcaccttgtcctttgtgggtaaattgagcaagtagctagcttcagaaacaagtcataaactgagtcacctacaaaactctactaaaataaagtaaaagcatagattttggaatgaaacagttcaaggctatatttctttctcggctgtgtgtgtcactctgggaaaattatttaatctttctgaagctcaatttccttttcttaaaaatgagtataacatttacttcatagggttgtaaggattaggtgaattaagtattcaaagagattagcacacaattaaagcttaataaatgttatcaattatggttaatttttattctttcaatcccctatccactgtgtacccagagcagccactgcgtatctctgccttagtgtctctctattaaaattatagatgatgacaatgtaaagccattaaaggcagagacccagtctcattcattgcattcattgttttattcttagcatctagcacagcgtctgacctgtttggggctctcaaaatttatttatttatttatttatttttgagacagagtctcactgtgtcacccaggctggagtgcagtggtataatctcagctcactgcaacatccgcctcccgggttcaagggattctcctgcctcaggctcctaagtagctgggactacaggtgcaggcaccacacccagctaatttttgtatttttagtagagatggggtttcagcacgttggccagactggtctcgaacttctgacctcaagtcatccacctgccttggcctctcaaactgttgagactacaggcgtgagccatttcatccggccctcaaatttttaataagtgtttatgaactaatctgatctgtgagttaggaaggatctgagatgtcagccatgatctgtgattataggatttttccaactgtgacccattaggtggagaaataaattcagtgaatcagagccaacattttatttttaaagaaaaagaatagaatagcaaatatcagagtgcaaaacacatagtaaagttaagtattgttacaagaaactttgttacatatgtaagagtacttggtggcaatgtaaatatattacttattgtgagtagtggttaaaaaatatgtgaacattctgaatggtccaccttgccagcatttgctactttctatctttttaatttcagccattctgatatgtatatagcagcatggtgttgtggttctaatttgcatttccctgataactagtgatgtggagcaccttttcactatgttcttccctttggataccctctttttttttttttttttttttttttttttgagatgtaggctcgctctgtcacccaggctggagtgcagtggtgcgatctcggctcactgcaagctccgcctcccaggttcaggccattctcctgcctcagcctcccgagtagctgggactacaggtgcctgcaaccacgccgggctaattttttgtatttttagtagagacggggtttcaccgtgttagccaggactatctcgatctcctgaccccgtgatccgcccgcctcggcctcccaaagtgctgggattacaggcgtgagccaccgcgcctggcctggatacccgctttagaaatctcttttgtaatctgtttaaaaaaaaacaatctggcagtatttactaaatctgaacatgcatttcctattacgcagaaatcatacttctacttatttactcaacagaaatgtgtacatatgttcatcaaaagacctgtacagaaatgttcatagcaacactgtttataatagctccaaactggaaattgcccaagtgcctattaagaatagaatggacaaataaatttgatatatttatacactatagaagcctatttaaaagcaagaataaatggactacagtaccatataacagtatagaactccaaaagcaaaagattgagtgaaaggagccacgtacgaaagagtacatggtgtataatttcatttacataaagttcaaaactaggcaaaattattctatggtgttaaaaattaggataatgattatccttgaagtcatcaggagggcttcagggatgctggtaatgttccctttctctatctgaatgcccatcccatgagtatactcagtttgtcaaattaattggactgtaaatatataatttgcgatttttccaaatcatttctgaatttgtctgaaattgttacatgtaaatataaaatttttaaaacttaataaataatacttttttcttcaagtgtgaaaaacactggcagagagcaaaaggccctgatacactcactcccatcaccatcaagtggtcatctagcctttgcctgagtaactccagggtcaacaatctctttactgcccatactgcccaggcagctaacttgttagaaagcttttttttaatttttttttgagacggagtctcgctctgtcgcccaggctggagtgcagtggcgcgatctcggctcactgcaagctccgcttcccgggttcacgccattctcctacctcagcctcccaagtagctggtactacaggcgcccgccaccacgcccggctaattttttttgtgtttttagtagagacggggtttcactgtgttagccaggatggtctcaatctcctgacctcgtaatccgcccccctcagcctcccaaagtactgcaattacaggcgtgagccacctcgcccggtctttttttttttttttttgaggcggagtttcgcttttgttgcccaggctggagtgcaatggcttgatctcggctcaccacaaacttctcctcccgggttcaagcgattctcctgcctcagcctccggagtagctgggattacaggcatgtgcgaccacgcccggctaattttgtattttagtagagatggggtttctccatgttggtcaggctggtctcgaactcccgacctcaggtgatccgcctgcctcagcctcccaaagtgctgggattacaggcatgagccactgcacctggccagaaagctttttctttacactgagccataactcgcctcccaacaactcgcttgcatcggttgttctgtcctcctaagagattctaatgtgattcaatccctctaccaccaatagctcttcggaaatttgaaggaagctaccacatcctccccactcccagtcgtcatttctccggactcaggagtcccaggtccttcctttggccatccctcaaggcatggctttgagttccctcctgtctcttgattgtacttattttatctaatgatgcccagaactaagcacagccctctcggagaggcccaagaggagcagaaaggagccaaaagtaaaatcatcacttttgatctagacagaatctagacagcctacttcttctgtcaacaaaccctaagcttcaatttgctccttctttaatattcacattataccattcactcctgttgagcttagcaatcaactaaaagcacccaagtcttttgcataagccccaaatttaccttctgtgtttgtaccgtcttcactctctcaggagtcagagcgctcatttggccccaccccaattctccaaagctaaatcccacagatggaagcatatctgttatagagacaccgctggaatagtctccctaccctcccacccactaaaaaacagaaacgaagtctttgtctcaatacatggtctcttatccttaccctttccttgaatggggcttcattttaaagtgtgtctgggggaaggactggaagaaaacgcagtttcacaggccatctccaaaatctgacctaaaagccaactgttgcctggcctcaataaagcctgagcagtgtggtgccctgatctctttccttctccattcctcccccaagtgggctccaactggaggttgtggagatgagtgctgctgggctctgctcactcagtccctttgcctttgtgtgagtagtgacagatgaggctgagaaggaaaacgtggcagggtgagaataaacctgatattgttcaaagcatctgacatcaaacatatctctcaagaagacctactggaatccctctagccacacgaacaaggaaacgacagagaaccatttctacagaaagttccaggcggcctccctgggtatttttaacatcaggactcggtggaggggagagtcattaagcaagggaaaccccgtaaaacagaacatgtgaaaatgaccaagagaggtgggctgggaaccaggcagggcgaggctacagaaaagggaagctgtcacgggaccctggtggtgaggggcgacctctctctccctaagggcgctgggggaggggagggaggaggaccaccaagtctggagcgcggcgagaaggaaacagcccacctacctcgtccaggtctgctccattttccaggctctttccttagtctcaggacgctcctcacccgggaggggaagcagcctgggaaaatgagaagccttgcccacgaatctccagcgcaaaaggcagcagctttttcctccccagctcctttctgcgtcggcggcgaagagagagctctgctccctgcttttttagaaaatggatttgacgtggccgaacctgcggctagccgtgcgacccgcacaagggagggactgttctcagtaggaggctggactcagagcggcgcggcgcccggggctgtttcgtgagctggagccagcggctgcccgggcggcggtgcgcgcactctccaggctgagacacgactggctggcacgagttgctcggcaccagctgagctgtc

SEQ ID NO: 1123 - DNA, 143610 bp, Homo sapiens
cagtgaaagaaaaactatttatttctttatacacatcttgctttaacaatcaccaaaaagactttcattttctgtcacccaccctgtccaccagttatgttggccttcaatatatggcgttagcaacatatataaatctatatcatatatttatacacacaaacacattctaccagcactgtgaagacacagactaggctttactaggcttggggcctctcccatgccacttaaaaatgagcacaggtttgctctatgcaagaatttcaacagagttggtctggccatcagtctgcaatttccccgagataagatagggtgacaaaatgggacagcaactttgaagtgaggtcagtccaatttggatatcatagaagaaaagaaataggatgtgctaggttaagcctgagatggtatctgggaagtcaccacattcatgatgtgaactcaaagaacacaggtgctacagtgcagaccaaggcccagcctgactcgacccaacagggtcaggtgtggatctgtgagtagtgctcactgagcccccgccagcagtgtccggcagggcaccgctgctcagtagtgtgcttttagaacctgccagaggagctccagcattgggaccacgtgcccctttcatcggaatcagggtcctatattcactgagttttccatctcaggacagctgatgaggcaagaaatgtgctcttgctagttcccaagctgctggggctgttgagaggcaggatcacaaaaccttctgtgcaaactacgcatctttttcttagtgctgggccaagtggaccttggctaatcgtattccatagccgtcagaaaggctttctgcctttctcccagctccaccaggatacatctctgactccctcttctggaccctcccgtggacttggaggaatgaggcccagatgctcctcagcagataggtagctgcacaaaagggggacaggcccacctttcctgctgttttaaggacttctggtggctgcgcttcttgcatggttcctggaaggcaagggtcacaaggctggagtacatggcagagcccttagggatttcacctgcagacaaacataaaacaaaccaaatcagtgtatattgccaggccctactgatggctacctgaagctggagtgagagctacgtggtgaccaaagccaggagcacggtgagagccagttaagaggatgagctaagagcatgcgctgcagtctggaggagcaacaggtgcccgaggttagggggagcctccccacctccctgtgtgctgagatccctgctccaattcactgcacactgggtggctggatcctaccactcccccttcaggggccaggtgactctccaaatcactttgtctcagcagaaagaggcctttgccatctccacccaagaaagaagtgcttagcatgaaacatgcacatatagaaacagcctgtttgtaggaagaagaggacattttgctgggaagccctctgttaagtttatgtccagttgccataatgagggtgtggaggggccaagtccacagggacctcagagctcaactaagtccagttccatctttgacagatgagggtgcagcagtctcacagagactaagggacaagccaaagccacacagcagttagtgataagccagggattagaaccgaggcctcgggtcctttccagtgatctatgggaggtggaggggaaagcttccacactggagaaagccagtggatactagagatttttgggttaccttttagtggatactagagactttttggattaccttttctgggacaggaataaggctttacagaggcaatcctgtaagtgctgctctaaagaggctcaggaaagagaagaattatcagagaaaaacaaaagggaattagtgaaaaaataaaaaaaagagcaagttaaactggcccaagtcattttcacactatggagatcaacattctctcaggttatggattagaaacatttctaggaatatgctgaattgcttatggcaaagctttgatgtccatgttaaaaggtttagtttctgatttttaaccatttcatatacctcaagtttttcttcaaagcacttcctagggaatgattaacacttagtgttttaagtaaatgtagataatgtctggtacatatataacattttttccctgaaggttcagttgttatttattaacaaattcgcttttagaccaatgagacccaacagatctcttttgtcatgttacttaaagatatagcaaaatcaaattgctgttcttaacccgggaatgtgcagtgaaatcagtttattaggttgcaaattgcttttactttttcatgaagagtagaacacataactggcctcaagatccctctactagaagctcattcagaggcagactcccgaatgtctaatgacttcaagagtcagctgaattgcatttctccagtctctgaacttggcctcaaagaagaaaaattggagtaaaaaggagagatgatgacaatgtgagagtgaaccaagatacaggggcaggagctgacggggtgggagggtgatggggacagaaactagcaggatgctcactgaggacctgtgatcttgcaagtggaccccaagtcttctcctggaaggccaaagcaggccaagggtcacctacaagatctgctaacggatggtgatgggtgggggacaggcttggtgcctctgactggtgcagtagtttccttacctctaagttagtccttgccttctttaaaacatcatgtgttctggttactgaaacaacaaaagagcaccacagagtagaaaccaccagcagaaattaaccctacttgcttagcatgagaattctaaagcatttatttctttctggctattcagcttggagtctccttctatccaccccctgtcctccactccctctgcagccacaattgctcctggtacaggaggtttggggatatcaaatcagtctcaactcccaacatccccaagcccccctgatcacttctcatctgaagcacaagtggggcatcgggaagactgcctgtttcttcccccattccctctcagggaacctacgctggctgacaatgaactgttccatgctctccttctgctggttggcgttcttcagatgctcagttgtgctctgaaggagtcgctcctgtttggatactttggttctcagttccagaagttccctttctgttgattctccctggataagaggaacagactcttactgaccaggcagaaggcctaaagcaccctgtgctttgtggctctttccaattcaaagaaggattctacagtcttctcaactctcttgaactggatttcctccttcacagcctcggatacctccagctgaggacagttcaggatgaggccattaggcaggaataatgagactctggaattccccatgcagactagcacaggcctacacacctgtagcttaagagaacctcgcctcaggctggtatcaaactcccaactctgaagaggaccttgctttagtcctgatatcagttctgtcactctcccttcacaggtaagattgagagttcagaagtgttatgctggggtgagagatctggactcagggaagtctgcaagtttgtaaatatttgtgccaacatgaagatggcaaaacaccctctccctggaattagcatagttggatccaaaaggtattggtgccattgacctggaagtagaatccctggggaggggatcctgaaacctgcctacatgagggtctgccaatcagagttagcctgagctctgagcagatcctgaggggtggctgactttccccaggcctggtccagcgatgccagcttaagttgtatgttgggattccaggcagtggctaaaaaggctcagtctcatggggcattctgtgatcatttaaccatgggacctgaggggtgggagatgggtgctgaagctttaactgaatttcagctcagtcaaacttcagagaagtaaataaactgaacatttatggatggccagggttatgatgtctccgccttcttcacaccccttcatcttctttgatttcttaaccaggggacagggggctggtggggaatgggatatattcagagctgtaatgaaagcagccaccatgggtcagagatgtccctccagggacactcctctaagttcctgtctatcccaactcactatgtggctcctgattttctggaaaagctgtgacattgaggagacagaacagtattggagggcaggagaactgggtttgaaccaagaaagggcactggcatcttaccactttgccaggcagcacagggatgtgggtgcttggcagggccgctctccagaacatggtgaggagggaagctgactcctctagggcatggtgcagggcactggtgctgctccgaagctcatgaatacctttgctgcctagcacctggggaaaggtaacaccacaggagcggagagattactttcttccccctgcatgggctcaagcttcctttgtgagtgaggcatagaacatgggcctgcttgaacctgtgaagccctcacacaaccatttgcagctctcagaactaaggtgctgctccctttaccaggaatgccttcctccacctgcagaacccacaaggctttcaaaactcaccccccttgctatgtcctctatgagcctgttaccttccttgcctgagataaatgaccacatttgtattggcgctctcacagcacagaggatgacttctcatactgtgcctgtagccccttactgtgcttatctacttgggtgtgtgtcttgccctctagtgtgggggctccgtggaggcagggctgtccctacgcatccatgggtctccagcagctcagacagcacagccacaggttcctggtctctctcactggcaaggtgctctcagaagctttgctgactgccttccctccctctatgcagtctgcacaaggaaatgacatggctgccaggcttctcaccccttccacatgtgggggccatacacctgcaaatccttcagtttctatccatcccattgagttgactctgcccacagatggtcatgtgcctgcatgactatggtagataataagctaccaaaggctgctaggcaatgccacatgtttctgtggggctgaggggaaatatccagtcagctacatctggaacagagcagaactcacagtgaaaataggagatagagaagaaagggcctggctgctatacatggaagaggaagtctcagctgttgagagatgcaaagcatgaaaaaaacaaaaatggtgggagaaggagttaacatcaaaggaagaaagggcacagggaaagagtgcacctaaagcttcaggtgtgattacctctgtgccttgggcttcaaggccagggaagctgcacgctgatctcacaagagacactatctttttgaccagcagcttgccctccgcaatctgctgtcttagggcactgtagtcatcaatgtggccaatgacatggcggccatgcttattggcaaaggagccatcagtagcatcaccctctagcttgggaggggtcttcattactggagaagtatccaaacccaagcctgaaaaagaaaatgacaacacaacagaatcttctgttattcataatgatatcctcagtttgctccaactaaaaaagaggtagggaacaagaaaaggacgaggccgggaacaagaaaggaagcctgggaatgtacaagggtggggcaaagtccatagagatcttctggcttctatatttttataatctttcttacattatctcttaatgataaatttgccaggagacaattttttccttattggcaaatgaaataggatgaatcataataaataataagtttctgagtagagaagacacagacaaggaagtcaagctggatacagacagcattttcaagaatagagagattatggtgcaatgaagcaaaaacagcagtaggaaaactacaggaggatgaacaatggcaagaaaggcagccacagaaggtgcagggagtagggctaaaggccttggggcatgcagagaaaactctctaaatacagataatatgtttagagacaacaaaaggttgtttgcattaatcactttccatcatcagtccctgggccctttagttgccatatttaccatttgctctgttgattatgggcgtttctgagccaggagtagaggaagcagagctggggaagaccagagctggggaattcataccaacatcccggactggaggggacacagctgaatctagggggtaaaggcaaccacagttttcaggagccctggaacacactgcacatgaagcacatgcacacctagctgtccccactgagacctaaggtggcaggactctcctcttacagaattatccataccccacaagccaaagcaaaatcaaaagcctatgagtcactgagttcagaatgtttccattcttcagaacaaaaagatattcctgtaattgaggggtgttccatgagaacgtaacttctagtttgaaaaattattaggtgtatttttataaaccgagtcttaagtataatttgtgtgtggtatctaatatgatgccctgtaactaaatgtaatatgtataaatatacatagtacatattaaaatctagaatcaaagaatcaaggaatgaatggattcatgggggactcaacattctagtcatcattctgatgaggtaatactgaaaaaaattgacttgtatgagaagaacggagacagaaggcttggtgggttaacattgtcttgctggagactaaaaagcaaccctatggtggaggaattggaaaatatcacaaagaaggtagaaaaggtcctgctcaggcaagtgtggcccagtgcctgctttccagctcaggcctccggggtgctagagaaagaggggcagggactgcatcagtggggctgagtcttggctgctgtatgggaagccagtgagagaagaaggcctggttagaaggaagagttggagacataactgaacaccacaaccatcagggcagcccagaggagggcaaggtgtccaactaatgtaagctgagcagtgcctggtggtcaggcggtttgcttggtggaccacatgtgtttttttattgaattgccaaaacagcataatcatgttattgtcaccttcatttgacaaataaggttactgtcagataaatgagaatctacaagaaccacagaaaaacaaagattaacatgacccagaaatagctggcaggagagtttgaaagctcagctttagagaaactgaacagaagtggttcctgatttgaataaaattgaaggtatggccatggaggtgagtggagatggtgtactaaacggtgtatcaaaaggagaaaaggacagaggaagtagaaattgaatgatttaagagactagggggacaccattgacatttcaatgaaaactgggagaagtgagattgatagaggatattgagaagggggacctggtcaaacacgcctatctgaaaaggcaggcaaggggtggggtagagaaagcgaatgatgaccacccgaaataaatcacccaccatccaggacttccccagagccctgtttccttaggggcaggaacattttaccatacactgagttccccacctgtgagggaaagggggactagagaatctgggaaggtcggcaatactgagacagggcacaatgagctggaaggaacacagactgaaaatcacaacatctggttctgatcctggctttgtctataacttctctaaacccccgcttgtctgttaatatctcaggacctaagttttcttatgtgaaatacagagatagcaaaacctgctttacttcagatgaaattatatatgtgaaaacacttggctaaaactaaagcaccaagcaaatccaagaaaaagatatgaacatatacagctgctaattattgagtaattcttagtgtgccaagcacttgtaaatgatttcatttaatgctcaaaatcatataaggtacatatgatcattatcctcatcttaaatataaggaaactaaagcttaaacctctgagactttagacaccttgcccaaatcaaacgacctctaagtggtaaactcagaatctggagcccagtctgacctaaatcccacgctttcactcaggttgctagactagagcatctctgatttcaacctgaccctaaggagcatggaccaggcagattacaccttctgccgcagaacttcctggtgatctcccgactggccaagggctttctaagtcccttttccttcctaccttggaggagcagctgcttgtttccagggtcagtgctggctgggaagttctggttaatggaggaggggctgaggctggctttgccagcaccgctctccagctgctgttgcagctgcagtcgcagacaattgttcccctgaatgctctgctccagctgccctctcagagctcgtacctctgccaccaggtggctcaggtcactgctcaaagggatttggtgacaggcatccaggctgtaagctgagagagaaggagtctggtaacattgacccaagtatttccaagcacttgtcagaaccctcctctgtgacattcttttctgccaaggaccccactatcatctgagtctcatgcaacccatctgtgatggagatgtcaccatttctgtgtgtggcctggggatggcactgagctggcacacatccagtctgaaacttccctgcggcttaagttacacacatgcacctatagagcatttgattggcagatgaagataagtccatatttcatctccatagtaaccttaatcctgtaggctaaagtataggatactccaaggtagaaggtcagcactgagctagagaagggtaggggatgaggaagaaagagatttcatagtcctcactctcaaaaatgaaagagaaggaggaggtcttttggtagcatgtgagaatgtgagttgggcaccttagacgagggattataactgagtttttcaatttctctctctctctttctctctctctctctctatatatgtgtgtgtgtgtgtacatatatatacacctacatatagtgtgtttatatatgttgtgtgtatatacatactatatataggtgtatatatgtgcacacatatacatgtacatatatatgtgcacacatatacatgtacatatatatgtgcacacatatacatgtccatatatatgtgcacacacatacatgtacatatatatgtgcacacacatacatgtacatatatatgtgcacacacatacatgtacatatatatgtgcacacacatacatgtacatatatatgtgcacacatatacatgtacatatatatgtgcacacatatacatgtacatatatatgtgcacacatatacatgtacatatatgacatgtacacacatatatatacatacacatatatataaatatatatatgtatatatatttacctccattcaccacatggctatttctttgtactggggatgaagagatctaagaaatattctacgaggctacaatcccttatctgaaaaccttaaggccaaatgtatttcgaaaggtaaaatttgttttagtttttagcaaggcaacagggtgcatatatcatatataacatgtacccagttgcatgtgagccacaatcctttatcaaacatataactatttccgcaatgagctatgtgaatattctaagtagataaataaagacttatgaatatcctcatgtcagatcatctagattttgtcactaaatgagtatttgaaaaatttaatttggaaatcttactggattttgaaattacagataagagattatggagctttagtggttgtagctttgaaatgagtcctaaaaggcagggagaaaagcatgaaaggaaaggtagctcaggatgaaccaattttagggactttggtaaataatctactcttgaattttgcccaaagttttatgatgttcctctctctctttctcaacccaacttctcactaaattttgcttattttttaagagatgttttaaaatctatctataccctttcatcttcccaatagcaccttatattagactgtcatctcttaatgtgccagaatatcactagacccatccaatacgtttcccagattctaatgtctcccaattccaggacatcccctaagacttagcatcctaaagttctgttttcatcatatgcttatcttctttgaaaaagaacagacttagtttcattatctactatacagaatgtcaacttttaccctgacctgtgagctttcaagatttggtgactctgctccaccatcctgacttctcactccaacctcaagcttctcctgtggtcaggctggtcccactgacccaacactcaccatgactgtgtacttaaattattctcccagcctggtgagccccctctatttcttcaggttccagttcaccttctctttagaaaatcaggaaactaaatcaggatttatgataattctaatctaacttccactgcccttcactctttgtttagccttctggagggacataaaatacatgagttctttttcacctgacacttcttcaaatatccgaagccagttctcatgtcctcaagatcttttgaaagcctacatttctttagtttctttgactagttggagatttctggtccacaccattgtgcgccctgtcttcattatgttccctagtgtgtcaacgcccttttcaaagatggtgccccttaatctaacaatattttagacatggtctccacaggcgaacatcacacttacactactgtagttccagtttgagctggcatttctagcaacctttgtcctacaccttacttgtgtgaacatgtttctaccaaaccccaaaccctcatgtccatgaatggctgcctgtcctatatttctaccctcatcctatatttctaccactgatatttttaatcaagctcaggattttgctttttatctttgctaaatttcacgacattgatgtcgtcctctgttccagcctgctgtgacttattcacattatgttttgaatacccttctccatttaaagaatgaagaaatatatcaaaattctcaaatattagattattatttcagcaggcagcaaagtcttcaataaatgtccttaatatttaaatccaggattgaaatttaggtcctattagtggtatttctataaggtttttttgtttttgtttttgtgtcttttaattttctcctgtgggcaggctggtccccactgactcaacactcaccatgactttgtacttaagctattcgcccagcctggtaagcccctgtatttcttcaaattccagttcaccttctctttagaaaatcaggaaactaaatcaggatttatgaaaattacatgagagggcaataagctgagcgccagatgtcactagggaaagggtcagggtgggagcggactgcctgctgcattgggctgaatgggttgtcagtatgtatcaccgacaatattaaaggccttttcaaatgatgatatcattaggacagttcttttgctttcaaaaatgttacaatctagacattgataggaatgtctagattttcttaaagtaattaggaatgatcaggccggatcttgctcgtgccaccaacctgtcccgttgggctttgtgtttgagagctcctactgggagccccaggctcgggtgggggtttctgcaacagaactctgtagcttcccatgatctccacaactcccaaaggaaagacctcactagcatcctatgcaagggcaaaaagctcatggggtgaggggagaagaacacatacctttcagccccttcttggaattgccataaagtgcctcgtagatttgtagctctgactggagggactcaaagagctgctgtttctcttcacactgttgctgcaggagaaccagcttgtgctgcagtctgaccagggagaggcaaggcccactgagatggcagagctactcagccacaccagagcaacaagctgagagccagatgtcaactcagagggtcataaagggttacagttagggttacatctgagccccagatgtcaactcagggggtcatgaagactatcacttttatttcgcagatatggaaatggaggctgagggaggtcaagtaactttgcttgaaaacacaccattacctacattagttcagagcagaacagacacaccagcacagtctccttactgttcctacagtgctctttgcattctgacaagcagttacagggcttatgctgggaccaagcatcacagccagtatagaagcttcctaggtgatggtgagactaatgtcctatatctaattggaagcatgggaacccttctttttcatgtctctgatatactgaagacttctataacagagttttactctctcaacttgggagtgacaaggcattcccagagaagtcctttcttctgctcaaagcgcccctccccccaccccactgacacacaaaaatcaggaatagcagagggaacatttaggtttccaaaagaggacatcaattgtcttgccaatatcccttcctcttgtaatgtaagaatgaatgtaagaatgaagaatgctaccttctctgtcaatgggtcccctcttacctggagtcgttttcctggagggaaagacgttcctccctgaaatgcaagacctcttgctgcttctccctcaagtcttccaaaagctgctgcctttccaccttctggtgctccagctccttttccagctcttgaaggtgggatcgagaggacagcagagcctccctcaggctttctgtttcctgggagtgctctggtgagaggaacacaggattgatttattatcatggggccagagctcagctggaagatgaccccaagcacatccaccctgacagacagagctaaggagcagggaaggaaggccctatgttggtgggaagagcatgctggctcaacatcccccagagcctggagcatggtgcctctctctctttgcaaaacccttcatgccacttatttaatctgtcctaccttgctcttagagaaattctgctttctaatgatcaccactttccaagtgctcacatatcgtctgttcaataatccattcttgaattttgacaaagatcaacgtcaagatttctttttggatctcattttcattattttgaaaactgagattttttgtttttgaacttgcagcacttctctgatcttcacaagttgtcaaagattattgaagggactctaaaaatacagctgcaggctcagtaagtcctctggggaaagagtcacctgagcctggcaaattgtactcgtttaaatctcttactgtcttctcacctgctgaggtctgttctattctctccaagcatgcaatggtagctcagtagttctgccctctttcttatctgttaacttttgttatcgtcccccagcagtgacctttcctctcaaatcttctcgctaatacagaaatcaattaattaaattaattaatttgggtggctaatttagaaatatctcttggtggctttttccttttccacaagcattccttcattctgggcttaatccttttggatactaccctcagtcttttcatggctgttcataaatatttgtgaataaaaatactttgttatcgataatacattgatctgatcaagtagactaacaccaaggtcagctgcctcccagccacacgagaaatgatgcccacctgtgagcgccccctggctagggctgggaaagtgctggggggcatttgctagtgccactcggcatggagtcatgggagtactgaccagagggaagccctgagtctatgagtgagagatgtggtgaggaggcagagggatggcacagcagggccaggagcgacacatgctgctgcagtaaagtctggagaaacttgagagggaagataggcattcgcactccctcctttattggttccaagtcagttgtgagtgaagggaggtagagcagataccagactggtatccaaattgatagcttgtgactctggatatatgcaggtgggcttgtacagaaatgatggatttcctagagctcttcgcttctggggactaggagtctgaggggcccatagttggaacatcttagaaagcagccttctctagactgagaatagctgtgagtttgggttggtggatctgagtagctctgttacctctaccttcttctgtttgcttctccagttggtgattagtgtggccagggaagaaagaaacttaagagtgaccacagtttgtgggttttgaccacgtacctctggaaacatgactcagttgagcctgaagtcttcgattgtcttccctgaggactctgttctcattgcagagctgaggtatggactccaggccctgactgtagaagttagaagtggatcctgtcccagaaagtagacatttgggtaacagaaactttcaaaagtttcccattcgttatctctcaaagatactgccccaacccagcagaaaaccccaaggactgaaggcctggccctgaatgaagcgtggggggctgggtacatgttttctgtgtgcctcttctcagtggattctttgcgtgcatcatcacatgccgtaactgcaatggtgcaggaggctcgatctccctaaacagctgctgctgtggtataggcaggacaacaacatatggaaagactggcctccacatgacagcagcttggaaggagagtgtaaggagaaaggccaccttggtaaagaggcgagggtagaggtgggaggacccttacagacctggttccaccacttatcaatcacacaacaaaggcacagacatcagcagtatataagcagattaagtatggggtgagaagtcaggtgactctgggcatcagacgtagttctgccttaaagagagttactctctaaactcagatatattcagaaagtagggatgacagtacttgcccacctcccttgctggactgttcataaggagcgagtgaagtaaagaatatctgtgaagctctgcctaaaagtccctaaatagagccagaaacaggaaggtctgggcctctcctaccccttccacgagcagtagaggtcagccggtgttccagttgctcccgtaggcggtcattgatgcagatggattcctccaggcgctggcgcaggttccggatttcaccaagatgctcttccagcaggtcagcccctgcggccaaaccaccaggacatgaagagaggtgggagatggagaatcctggttactgatgggggtggggctcggctaggggacctgcagcaagacctgtaaatatcactagccttctgccaactgtgtcctctcacacggacacccaaaagaatggtagttttgtttaaacagtcaatgtgctttcaaacacatgacagtcacttgctaaaaaatctccatgggcctcctcccacacaggggtcttgtgagagttccacgttttagaaaaataactgagggctctggacaaggcctgcctagcatctggaaaggtgtggccacctcctgggtgtgactatgaggatgataggtgagacctcactctacctttcttcttactgacacgtgagtgagcattctttagcaagggacaaagcccttcctcccacccttagaaagaaggcctaaagtaaaagtacgtgatcttacactcaccctatgcggttaatgactgacactgaatgcttccctgaaatcacttttaatatggaagatgaaagaatagcctggaaggatctagagatctgaaggcaaattagagaggggatgacaccccccttccccctgccaaacaaagcaaaaatatccagaaaagtcagacggatgcttacaccggacattaactgcaccattttgctttgggctcagtcttttcctgaaaattacgattgtcttactgttggaactgcgcggcatctcagcatttatgagcttagctatacctctccacttgctgtgactgaattttgtgcacaggatatatttgcagggtcagggagctgcacccttacaccctttcctgtgacaagtcctgactgatggaagaaagtcccatctatgcctggcattctggaagggtctaagagagtgggctgcaaagaggccaggctgcagagggatggaaggacatgagtgtgacagcacaagaggtgggtccctgactttcccatatccctacagagcactgaggccctgggcaggagaatgaagaaatgtacttggaaaggattgagccctgatacagctcttgcattttatatccactctgtgagccagggatggaggaggaatgaaatagtcctgcctgggtaggaaaagagtagactccaaatgagacttcttttcaaaggctgccatctctgctttgtgctttacctgtgggtttggagttaagctggtacacagaggagcctgaggataggtccccagatacactccctttctgaggcctcatcacatcccacttgccactgctgcccaggtacccaggctctaggattcttcccagttctatggtgccccttggaggagagtgaggctgggcagagttgaggtagtaggaagagtcggcttccaagtcgttgctcagcaatgtagctgtggaagcaggaggaacagtgctggcacctgggcagaaagaaacattagtaagaagcaaatggggtgtcagaagggaagaatttgcaaggaagtgtgtgattgctaagaatagagactaaaaggagacatgtggaatgtcagagatcccagttcactttggtatactaattagactaaggcttgtaacctagaggttgtaactcttaccctttgtatttcctagcaggagacacaagaggtagagaataaagtatcttaaagtcatcagtatatacaatggaaaagtccagtggccccactcctggatcctactataatccttcatgacagactccaaggaaagttctaaaagtaggattcactcccacagttagaagttgtgagtgcagtggaatgcaggattgagcttacctgtgaacacgaacatctgtttgtctacatgtacttgccttcccctgaaactaactagtcaatatgtccgttccacgttggagtttttcagaagagaaaggggacatgaaatcaagctggatatggtggccctagttcctccagactgaagaactctttgctgaggctggggaagggcctatgtaaggcaagtatttatttggatcccatccaacatgactcaaggagctgcaaaatgtcatcactcctgtctaaagaatcattgaatacaattccacagaggcaggtaggacctttcatttaataggctgatactttcatagatcctttgaaatcataggcctttcccttgagccccatcatctccacttctctgtaaaaagaagcctagcatgggggagatgaggaaagaggtgggcagagacacagtttaggagaaaattcagaagcctgctttctttcagggattatgaacatgggcagcagaatagacaggtagctcctcctaagcaacaggagtgaggtcactgtttcttccatccaagccaaactccttggaggggttagtgtaaatgccacttgccagtttttagccctacttgtagctggttctcaaatgtgggtacatattggaatcacctgagaaagtatggaaacatatactgattcctggattccagagattttgccttagtctatatgggatacatcttgaacaatggatgttttaaattcattttaggtaattctaataggcagaagtttgggaagtcttgtcatgagtctctcttctaatttgcaaaatactagatgttcattaggatcacttagttaaggaagaaggttaaaaatttaagcacctacattttagaaggaatgcaacaaatacatgatttcctacctctttcaaactgccttcaaccccatccgaacacaaggcaaagggagaaatcagtggttgcagatagtcagcttactttttaatcaaggccatgtgaggttttaagtctatcagtaacaatgatcagtattctcatgttccagtccattggccacacaatacacagtacatgctctaaaccatgcaaagataccatacagactcttgcacaagattttaacccagggacctgagaggccaccatgcaccactgtccacacggaaacttggctcaaagcaaacaatgagcatgtataagcaatggtcccttggagaggaccttgacttcaggtggagaaagaaagggctacaatcttcctcatctaggctgggaccatttgaactccggtcaatggcctcagacttgatgtaattccaatttaacccaaaacaacagaccctttttcatggacagtgctctccttccatccttccgtttgggcaaagacaaatggacaaatgtggaaagataaaggaaaaggaggcaagataaagaaatggaagctagaaaatactcttgccatttgtcatgggacacatttgttgcccattcattgttggtgccagaactgctaaaataacaagttttaggtcagaaacagcagcacttcctactggtctctaaagagagggaaaaaattgttgcaacgagtccccagagtttgatcagctgagctcagctccatactctaagcaggatggtgacaaagccatcctaagtagaaaagatataacagaaacataaaacctggagcagaagaccagattcaaccccatctctcccacttaccagtgaccttgaacaagtaacttcacttccctgagctttacagttccctgcattagacaaagtacccatttcctgggttgacaaaataaataggctaagctgggtgcagtggctcatacctgtaatccctgcactttcagaaaccaaggtgggccaatcacttgagctcaggagctctagaccagtcttggcaacatggcgaaaccctgtctctacaaaaaatacaaaaattagccaggtgtggtgacacacacctgtaatcccagctacttggggggctgaggtgggagagtcgcttgagcccaggaggtagagactgcagtgagccgagatcgtgccactgcacttcagtctgcgtgacaaagtaagaccctgtctcaaaaaaaaaaaaaaaaaaaaaaaaagaggaagaaggaaagaaatatgctggtccacatgacatttggggctgtagggagggggatgcaaattcttggctgttgtcttgcatcactagaaacttctggcatggtgaccctatcagtctctggctcacctaagcttctttacaggcacagaaagtgcctgacaaatgagtttaagttcattcaaactgctttttaactgttgtgcctaaggtgctatgaaagagcaaattcatgtgaaggttgtcatttttttctaagctatcagtgaccaccagcacactaaatttatgatgagcatccagcctacaaatacatcaaagcactttctaaaaggtgactgtccacagtctacgtaactacatgagatcaattatctttgggagtcagaggatgggattcacagtcagatgccatagctggtgctgtggttctaagctgcctacgtgtcacctgtcccagggcagggaccaaccctgtgcagtaggaaaaggggctcatcatttcctcttctgaatccctctatcattaccctttttgctccaacctaatgatatcaggaactgaacttgattaacagcatttcacagcagaaaaacataatagccacacaaaggagcccactgaatgtggccatctttttcttggccacttcatcctgcataggcaaagcataacatctctctcccacccccaaccaatgagcagtccaccagtctgtcagggattcagcatacttggtggtatccaacactgtctacagtgtgagagcaccaggtctagagcctcgtgaacatatctacctgttaactgatgagacatacacaccacagaaataacagtaaatacatttccaaaaaataagcaaacagagctttccctccctcttacatttgtaacgtgtacccgtgttgtttttttaaactctgccatccagcccgagccatgcagagcaacacagtgtggggctgccaatcgcaagcacacaaatgcagaagtgctcactttctcccaactgcttctgcagcatctgtagctcctgctgagcctcagccaaggagaccactggtgtctcacagcagccaaggaggagagggccagtggggctgaaaggcaggaagctggatggagctgagggcaatggtgcctgaggaaggctagccagcttgggtatggagtgaaaatgaaagcctaggaaaagaaagttaaggagaaaagagacacatcatcaagagaaaatgagagaaaagaatgggtaaaagattgagaaggtaaaagcattccctgaccagacatcaccctgcggagtggctatcatctagtgtggtacaggataagacagccaagggtgaccattgctaccagaggctggcctggctgaccttccctcttctcccctgccagggctatcctgcatatatcctctgtgttcatcttgaaagcaattggctaaagaaggtaaggtggcattattgagccccaccccagcaatcctggacatggacaagtcagagagcctgaatgctttcaagggcccctggggctctgctcccagcatgtatcagtccttggccctgggacaagactctttctctacctagaactcctctttgacagcatcaggtcccatcctgagtaggagagatgtgaacaaaggctgtggggaaattttcattactagtgcatgcagttcaggactctgatggaaacaaacttcagaattccaaatcaacgtgttcattgaccaaattaaaaatagatgccttggtagagtggcttagacaaaatggcttgcaaatccttctgggcatttaaatcacatagcaaaaacttctaatatatgtagattctttaggccttcttgattctgtctaggccttaatgtagacttacagaattataaattcttggaacatgaaatttacatttaaaaaaagtcttccctggtgatctttaggcagcccatctacagacaggtttttagaaaccctggcaaggttcaatgtttaaaattgtttcctcttccctaaaagcaattaaagggcaggtagccaatggagagggagcagaaaccaaggctgacccatagagaatgtctaatgtagaagacaatgattatatcctaaaacacatcccaatggtgctggcaccatttcagatcaatactgcaaatatactcaaattgccaggtaacacagcccaggcattctttgaggaggcattctgattttaaaatcctctgttctttacctactgctctgtttgaacccacaacatttaagcagatgtctataagtctggaagcacagcttttcctcatgattctggtccagctgctgcctactctggcctagaaactttgaaaccaggctcaggaagcattggaacacttcctcttccttaagattttagttgaattgctttcagggaaatgagggcagcagaagaaagcactgtgctttctgggagcacctctactcaagtcaaacctcacaacaaaccacactgaaggcagccagccagctatggtgggaggtaggaggcgaagacaaggtttgccttttcttgccatccctggtacagggctgtgaatgagcagtgtaccctccggcaactaagctgaacttgtaaatgaaatgcacccctttaactgcccccaagatatgcactatgtacatatcaaggactgccaatccattcatacatccattaatggtaacgtactatgaacagaaccttgtctgaggctgttctcaccatccttggctacaagtagcactacctcttgcagaggatctccatgcagatttaatgggtaacacatacagtggatcaatagatgtgaatttcttttcatcctatggctgttgtaatcctgggagaaacattttgcctctttgctcccaggataaaatgagagaaaaccaataaaaatgtttctttttaaatgattagccaactactggtcagaactggtatgcagatcaaaacctgatgtggattacttattttctaaaatattttcttaaatcagacacaactggaaaatgaggatggtttctcgattctgtctaggttttgatgcatttaggcccctaacagtccaaacctctgtcgttgaagaaaaatcaaacaggcagcagagaaagaggagatgaagcttctgccccattggctgttgcatacctgaatgggcctggttggcctccttgggggtattctggggagttggcaagctgatggggttgctgttggattcggccttagccccctgagatgcactggttgatgatggtttagaagacaacacagcagaatgactcgaatgatggatggaatctataaaatccatgaatgaaagaaaacgtatgatgttctacagagaactggaatcctggccttatgtttacccaggggtaccagggctagagtcttgctttcagggaaagaaccaagcacaagcactgttagcagtgttcattttcttgcttgcagacagctcctatagtgaggcaaaccaccttagggatgacagcggtgctctgagctctgaaacatgaaaatggcaactccaaaaatatcaggcaagactagcagcatctgtggacacccaaatatacttagggaacactgctcaggaataagtagcaagatcattgtaggagagatgaaggaggttttccatcttaaagaagatctatctgacagagtcaccaaggaagaagagtctgccgtgatcttctcactctccccacagtggctcactttgtgcccaacagcttgtacgtgcccatggaggccacggtgacagaggtaacttgtagagtcaggagcagagcaaagatcctgatccactggtgcctgtgcatggcacttggccccacagccatgttcagcctgatacacaccatggtggagctataagccctgtttcctgagttctccactcagcctagacaaagatggtaccacccagaaagtggaggctacctgagtgactgggagaagctttcttctcttcatagtgtgtgtactcgctgactatgtccatgtcagagcaggcttccagttcatcagacaggaaagaggtgctgctgggagagcggtgggagtcagacaaggcatggctgctggagggtgtgagggaccgagcatccagcttggcctgcaggacttcaatcactttctccttctcctgcagctccctgctgagcctggtggggagaagggggacaacgggtaaaaccaaggtcaccgaagccaacctgtcctgactatggctcataggaaaagccaagtaagccaaggggaccatgcctgcagataattatggaaataacccacctctgcttagggatggagtgtaggtggggtgtagatggagagagaatagctacctagtgctctggccacataatatgctgaggacaagcaaagacatagctagccctccttttaaggcactgctgcttaatgtatgatccctggaacagttgcagcctgcgaactgtttgttaccatctccaacaagacaagtataaaaattgaaagcaagcattgagaaacacagaacaaaccactgtcccaacatccaagagcatgataagtggaatcatgtaattaactgaattcagaccatatatgtttctatgatagattagaaataaaaacaaaacaaaacaaaaaaaaccactgtgtccttcactacagatactttcagaagcatttatgtagtctgagacacaagcatgacacaaagaaccccaactagtggctacaacggactctgagcccgtatttcattgatcattatatgaagcaactcactgagaactgggtcctgaggcactgcagcctcctggtgatctacaccatctaggcctctttcaccaggtcctgttatatgattccttttttcccccagggcaattgagtgactattaaattagctgtcaacccaactttggaaaaagctcatcctgcttattaaacacacagcaggaaagcaggacccttagtggggcagaagactcttgaaacctagttagttcacttttagctcagactgtttctaggttactaagcctggagaattaatgtgccaatatgattcaaccaaaagggaagaaagaatttagttaaaaacaacagtgaggtgttcaatgaatgcctgaattcaatacattcagcactttgctttattccccttgatttgtggagttgccgccacccttgaccctttgggcctcggtcccaatctctttcccagattctcctctgaattacctgagggccagtggctcaagtccagcttgatctttctcacttttatgatcctctgtaaaccaaatttagaaagagacgataagaaattaggctggtcccacttcccgcattacaaatgcaggagcctatctggagacagagtagtgagcatttcatgtgtgcatccagaacagttattctgggatacctcagcttgtgtctctagagaagtgaccccactgtccctgacctgccggtcaccatgatgacttcctctgccctaaatcagggtaaaacatttataatgtcttttgttccattaatcatgaggcccttgcccagctgccctgcgggacactccagcctccatgtcctgctgcagactagctccccaatgcatatgccccaccacagctttcatgcagaacctgcactggtctctgaggagatgacaagaagccctgccccacctctgcatctgccaccaggtggtgggctgggtggctcccaagtctgatcctactttactcccttggatagtcgctggaaattctgagtagaagaccccaataataaccaatgtagcccttgaactactgcagccagtgcctaaaccatgtataaaagagcatggcgctttatccatatgtggagtacctgcatgcacattaccatgccataaatggagacaccacaaggataaggcatttagcgagttggtggcagcatccaggccagagcttgagtcttgtagttcttggttcagggctcttcctcctataacaaagcccttccatctcatgtcccctactccctcttagcatcagagagatgctgcccctgccccacaggtcacattccattagtggtgaagtttctatagttgtaaccatggcatctccagccctgtgttttcctctccatgctccccactgagcagtcttgatcctgtattagccccaggaaatgaaatagaaacaggaccttaggataaaaagttgcagtggagatgtggtggccaccaggggctggaactgtgggggtgactgagagtattccaaagccctgtggccaacttactggtgctgagtttgctggtgagcctctctgtcagctggcttccctgggcgagttgctcccggaagctctgtcccaggtagtagtcaatgtcattgctccttaggagatcctcaaaagattttactgtatcttttgcatgccgggtgataagataacaaatacctctcccttctcgtattttttgccgtaggtaagacagttcccgggcctgatcctgaatcagggaatcatatttcctaatgcaggacagaagaggaaagagtaagtatggaaagagtggaagctaacttatggagttatgggggcttctgtagagatttctatgagaacatctctaaggaactcccccaagctgaattctggcacataagccataggaggtatttaagagtaaattctaccctgataaagtattgcattaaaaaacttagtacgggccgggcgtggtagctcacgcctgtaatcccagcactttgggaggccaaggcaggcagatcacaaggtcaggagtttgagaccagcctcgccaatatggtgaaaccctgcctctactaaaaatacaaaaaaaatgagctgagcatagtggcacatgcctgtaatcccagctactcgggaggctgaggcaggagaattgcttgaacctaggaggtggaggttgtagttagccaagacggcaccactgcactccagcctggatgacagagtgactccgtatcaaaaaaaaatttagtatgtcactgttcttcaactgttatacatgtgttaattatatgtccctagataaatcataaggtctgtgagaataaacatagttctgcattttacatcccttacagcaccagtatcacatagattcacagcagttactcaatgaataattagcatcatttcatcctaagtctagatagaacctttcatgccttctgttttaaccaccacctgatgcctgaatttcttctatgttacgatactgtggctgactacattttgcaatgatggccatcatttaaacgctcataccatcaactgatgggacccaaaacaagagaccctaagtgagaaccacccagctgagcccagtcaaaccatagaaccatgaagcataataaagtgttgtttgaagtcactaagttttagagtggttattacttagcaatagataaccaggacacaccaagatgaatgtctgtgttttcaacactaagtatcaataacacttataactatggcaaatagcattgagagcttaacatatgctaggcactattctaagcacttgtattaattcttttttttttttttccgagacagactcttgctctgtcacccaggctggagtgcagtggtgccatctcggctcactgcaacctccacctgccaggttcaagcgattctcctgcctcagcctcccgaatagctgggattacaggtgtgcaccaccatgcccagctaatctttgtatttttagtagagatggggtttcaccgtgttgggtaggctggtctcgaacacctgacctcaggtgttctacctgccttggcctcccaaagtgctgggattacaggcatgagccaccacgcctggtcagcagttgtattaattcatttaaacctaatatccaccctttgagatgggttctcttatcatcctcatttaataggtaaggacaaaggctcagaaaggttaagaaggttgcatgggtagtaagcaccagaggtaggtagtctgattccagtattactactatactataccatctttactaatatatccctaagaggaaatccctgagacccggtatctcccagatactggaacatcatcctatgccctcctggttgcctacctgtcttttctgcagacctgtatctaccatttaaatcagtgtccctgtgaatacccagacatgttctttcttccaactgcctgagctaccctacgccaagcatgaacttacacattttcaatcaagaaagtacccaaacagtgccatccttacccaggccacgaggctgatctcagctcctcagccagcttctcttctagtccattttttgggagctgggcctccagctgggatactctctggatgagactctccaggtcctttttggcctgaagccctggagagtagaaagccccagtgccatcagacagccacccctcatcctcatcagggacactatgaggtgaagacccctccaaggtgccaacagctctcagcttccagggtctttccagactagacgaataatcacttgtaactgagagggaccggacccggctcttgaggttttgaatgaccttgttggcattctgcagctgggccttcagatctttgatgtcctttcgtaggaccaagatgttttctgactttccatatacccggaactcttcctgcttccctagctggttctccaagggcttcctctcagaggaactagccagtgttgagccccggcgtccctgctcagagcacagcccctccatcaggaccatttccttgaggctgttgtgctcctcacactctgaaaaaagacaaagatgtcttcctaaataaaagttggatgtgctgttgtggccactgcctttgagaggaggcaggtttggtcatgaggacaataattactagggaaaaagttgaagtagtactttattcaaccctgacactgtactaggcattcaaatacaatatttcttatcttccttatacctacaagttaggtttcatcactttctattttactgactgggaaaccaaaacttaaagagaggtggtaaactagcttgttctagatcactcaaactagcacatggcagagccagaattcaaatcctccaatgtcctgtgttcattccacacacactggtgtttcttaagacattaacatggccttatctatttaggatggccacaagaatgtaggacaagctattactgcatgctgaaagtttaatgctctttaaattttactataatttaaaagtttattgggttacaactgtatgaaaaataggcataggaaaataaggcttcaaaaaaatatatcagcatgttaacatcagtgtattagggcagtggtagtcagaatgagaactaatccatggcattttaccagatgccaggcactgttctaaagcattttataagaatttactcatttaattgaccttagtacctgatggggtaggtagttcctttattactattttaacacatgaagaaactgggacataggaaagttttcaaactgggatttgaaccaaccagtctggccccaggatcttgtctcttaactgccacactacactgcctcaagaatgagagagattgtgtttttcttctcttctggttttcaatgtggtgggtggccctatagttgtagtctttttataatgcaaaacaaaattatttttaatttatggcttgcatgtttctaaaaccttatctggtctctaagtaggccttagtatttctataataatcagttggatagaattttatattattattgttattagcagtatgccaaaaactaattgtagaaattcaaacttatactcagcctcattttgggtaagatttctcctattaacctcctgtcctcctcttccccaatacttgtcaggtgtggaattggccaacagcatccaaatgtgacagctgactccagggaggggtgagccccacaccctgtgctcttaccaggactggtggtttcctcccgttcagcctcattctcgcttcggccacaagtctcatagcccaggtcctggaggtccacctggatctgcttgctgtcctgcttcaccaaggattcacctgcttgggaagagaagcaggtgttacagaatgtctgaatttcccacatatgccctcagcctcaatggcacataccctaaccttttgaggcacggaaggcagatccacagtgggagagaagcttctctgaactggtgggagaagagatcaccagctccaggaagcagaatttctttccaaaggaggagcctgcatttgccattatctccccttcagataacccaggctttagttgggaccagatatctgtaagtcagggattgtacactatcatctctagcagccccattgaagctggcaagtgctttatccgcaggggttcaataaatgttgaatggagctgaactaatttagagtcccaagaccctagacctgtactgtccaataaggtagttagcagccacatatggccactttatactacatcaactaaaattaaataaaaccaaatgtccaagttgcactagccacacttcgtgtgctcaataaccacgttatgtcggtatagaacatacagaacttataagacatataggctagttttctttactagtaagtcatagttacttactaagcataactctgtatttctccagctcgttagcctgagcaaagacagtggcttctgatagcagcagcttctcctggagatcttgatagcgttgtttgcattgtgacagctgggagcgcaggtgctgggtggaccctggtaggctaaacgctgactgaggcccagggtcacgaggctgggactggttatccaactgtgaaaggggccaatacagggatcaggacagtctgaggtcacccccatgcagtgacgaccaccgccccttctgaaccctgtggactttactcaagtctgtcacagcacttctcatgccatttggcagtgacttgctttccagatggagctcctggagcgctgggataatgttttcttcatatctgtatccacagcacacagcacagcaccaatcaagtctacagaggagctctcaggaaatgttttctcagtggtcaaaaagagaccactcatctcccctcacattctgtcccattgattctctcagaatccctgtattctccatttcactgaatcttcagcatggctccttccctaaagaggatcccagtaacccatctgaagcccaggaacagacacctgtgatgagctgtgacaaaaaaatggcagtgataagggatgtcattacataccacttgtctgggctgcctcataacctgatgcatccctatgttacagcagttaccacatcctgttaaaattacctgtttgtgtgccatctttcccgacaatattaagtatctcaggggcagccattggttttattgccccatgccaatgcctagtgtgttatctgaaaaattaagtactcaagaaatatttatgttataaaagcctttctaaaggctgaatgtaggcagaatattactattattgtttgtggtacaaagagacccttctcttggtacctcctgattcatatgggagaatgttttaaggtaaacactgtcatctcaagcccttctccaattgtttttcactcaatctaagcccacacttacttggtgggcatccactgtgaaggtagccccaaggtcaaggctctggggtctggggaaaggcctcacagtcacattcccctcctcttggtgttggtgcttcccaggggaaccaaccagttctgtgtttattctttcaatggtgctggtcagatgcacaaggagctctggagtaagtttactattcccttccttgctactcagcacaagttgttctttgaggaggttgatgatattgtgggcattcttcagttttccctggagctttctgaactcagcctgaaggctactctcactcagaccctctttggttaccacagtctcaaccatcacctcgcccttctccttgtcttcctcgatctcccatccatcagacattgcttctcccatctgctctttcagctccgcattctcaaggcaaaggctcagcatggtgttcctgcaggaaacacacttaattgagggctaggtctggtcctcacaacagttcctaatactacctcttaccaacatctcagcccgcaattaactcagacttaccccagagcatgaagcaacctgagacctaccacagccccctaattttatatacaagaaagccaaggctcaggaaaagtaagagacttgcccaaacttccacagcttcttggtggcagcaccatcactagaaaccttggactcaagacatgcaggctagttttctttacttgtgccccatagcctcatatgttctaatttttagtagcctctggaataaaccagagtacttacactgttaaaaaataagaccttttctgtaacaaatttattgttataaattttacagttctattatttatcatcagtcagtttcaaaccattgggacttaggaacacagaataaataaataacactaatcagaactattaatataatcaaaatgtacttagataattgtttgctttatgtctggctcacgtgatagagataaccttcttgagagcaggactgtgtctgtcctattcatcccatatccccagtgcctacacaagtgcctgccacataaatcattcatatttgttgaagaaataaaattgaccaaaacagctaatttgcaccaagacattccagataaattctttccacaacaacaaactcatactagggttgagtggaagcaaacatggctgtaacaagtctattcacttaacttttttgagcctcagtttccttttatataaaataaggatgataacacttacctagtagagttagcagatgcttaaatgaaattgcatatacggtatggctagctcagggtctaacagggaagtcattcaatccctgctgtactagctgcagacctaagaaataccaacagcagaatcccataaggtgcttgtttaaaaagctgtagagctaaggcctatgaatccacattttacttaagttccacaggtgattttttaatttttatttatttattttttttttttgagacagagtctcactctgtcacccaggctggagtgcagtggtgagatcttggctcactgcaacctccacccctgggttcaagcaattctgctgcctcagcctcccgagtagctgggactacaggcacgtgccaccacgcccagctaacttttgtatttttagcagcgaaggggtttcaccatgttgggcaggctggtctcgaactcctgacctcaggtgatccgcctaccttggcctcccaaagtgttgagattacaggcatgagccaccatgcccagtccacaggtgattcttaagcatgctaaactgagaacccctgagctagaggatgcacaggaaatgggtaattcacaacttgaaggatcagcagtgggctatgcacctagattgaatttctcagaatccaggagtcttggaacctacagcagagcttatctggtgtgtttctgggaggaaaataggacataggatacagacaatctgtgagatagtttctcaataaagaaaaaggggataggtattttaccaaaactgggatgtggaaaggggataaagagggcgcatgtgtatatggaaaagaatatttaatattatgttctaacttcatattaaaaaaaactgatatttttaaatacaaacaaataaaagaaaaactcaacaaaaccttcttgaaaggaagaacaatgcattagattctaccttctacagtataagtgattctgtaggttgggtggagggttgaacaaatcagagtttcaggttagtaattctgaggacaaaggaaaataatccacagggatagctatagatggtttgattgtaggttcaacaatagaatcaaaagagatgtactgttcttacccatgacaactcaattaagtttacacatacaaaaatttaagtaaaataatatgctttaagtagaacttaaggaaaaagttattatgataattcagagcaaaagaatcagcacttagaacaatcacaagaattttttaaaaattgtttgacaaagtatgtagtatagaagcaaggtttagacgttagaaattgggagccacagatattatgcaaccttgagcaagtcacttgaaactttctaggcctgagtttcctcagctatgaaacaacgacatgaggctagatgcctgggcccttttcaaagtgctaacattattcagggaaatttaagtggtatgtaacatgcagggaaacaacagggcatgatttagaagtcatacagctgtactttaaacaggcagtgatgattatagtcctgggagtgaatgaataaatggatcagccctacagtatcagcatgttctccaaggagcttttgacaaaaagccatcaaagacagagtggccaatctaaccaatcaatgagctacctgctatttttgtaaaattactaaagcagcagagatgattaaaattgatactctatgattgaaggacttatgagtgagagctgagaggagagggaggggcctctacacaaaccctccagccgggtgcggtggctcactcctgtaatcccagcactttgggaggctgaggcggggggatcacgagttcaggagattgagaccatcctggctaacatggtgaaaccccgtctctactaaaaatacaaaaagaaaaaattagacgggcgtggtggcgggctcccatagtcccagctactcggcaggctgaggcaggagaatggcatgaacccgagaggtggagcttgcagtcagtgagccaagatcttgccactgcactccagcctgggcgacagagcgagattctatctcaacgaaaaaaaaaaaaaaaaattcctcctccttcgtgaactgttctggttctgtatacagcagtgagacatattaggtagcagggattccttatacgttttggtcaattaaaaacagcaatactggtcatgtaacaaggaggtttccaccatgactgtcatatgtatgactggcagatgcacaataatagtgggcactgttatactgaattaagaccaggattatttgaataacagaaagtgattaccattagccaatattacttacttttatctaaagaatttgtagaaatattaatgcatggagcctgggataggcaccccttggctgtggtgcctcatgacctgcaagctccccttccctgggaagaatgtcctacctgatgtgggacactgaggagaatcctgcttcctcaatttgagcctttagctccttcagttcctcctcagctttcctcttctcttctaagtgctggtggaactcagccctcaggtggagcatttcttcctgaagacacctgttactgtcccctcccatcggagaaggaggggaaaaagatgggttctgggtctccacagttgccagacttttctccaaagccaccttgacaagctaaaagaaaatcatggtttgaagaagttaggccattaaagaggacccaagagaaacatgagattgcaaaggcagttttaaatgagaacaaaaacaaacaaaaaaagcagatctaaaataaactccctaaccagaacctccttagtcaggcataagggccctggggactggtttgggtgggaaggacacacaaaatgagcaggaggaatttccccatggagaagaggagaatccagagatggtgagggagaaaagcacataagaaattaaaacaaatgcaaacaaacgaggttgaaacaggactggagggtgtgaatacggtgattctttctcttcctgaggagacagagccctgcgagttttctcacaattcaggaagcttcatcagctctgcaacacttgagtcctggatggcgggagatgatggcttaagatatcagggcgcaaagcctaaggccctgcctgtaactccaactccctcaaggacagctgagagggaggactcagggcactggggaaacagtcggcagacacagttacagaattagaataaggtggagcgacagggaagacaacaccaactatttcattggcagcagaaggatcacactccgcagctactgggagatggaggtgaagccatcctgccaagcagccaacctcactttttggttattatctttgtgctgatgctgccagacaaactctctctacaaatctcagcatgtggaagaaacagaggcaggaacaactgcccagcacctttctatttcttgaggacactcttgaagttattcatcaatgttttaattaaagcagatcttatggcctttgctcaaatgggaatttgttaacttttagactttgttattgttcattttgggcttatctttggtcttttcccacgctcttaaaagtgtagaaatcaaaatctgagtatgataatctacttagcatatgactaattactttagtacaaggagttcctgcctgtctgtccaatattaatcttaatatgtcccaatgtcacattggcttctttttcttctcagtggcagcatttggagcttttacttaactttgggtcaattttggcctctgaattttccacccctcccccacagctgttgctgagtcatgttgttttcttttatctctacaaatattgtgacttgtaattgtcacttataaattcattctggctatactgaatcattccccaattatccaagtcatccaaatatttgatgtgcatttccacaaatcatgtagtggcccccactacaagtgattggggataacttgtagaattaattatatgctttatatctccattcaggtcaccaatacattgaagagagcagggcccagaacagcttatatggatcaacgactgacagagctgctggggttggtgcgaagccactgacttttgctattccccgtaacaaagtatgttcaaatgtaggtcacaggtttgtggtagggtcgattcacagtatgcatgtgcaatggtgttcagtagcatagcagttgaggttgtgaagacatgcgcacccaggtcaaagaagaaagatccttagacaaagccactcaagtcccaggcacccaatcttacttggactttgtgagcctgagatttgggaggctcctgggaatgtctgtctctaagactctgctggcaggcttaatcaggctggtggccatctccatatgtgcccccagcatttgtgacaaaataaaggaagggggaccaaataaaaccacttctgaaagcttacaatcccatcccttatttaaactatgtgatgttgtcattctatataaactctttccgagtaacttaactaaaacacactttgccattagtcttgagtgtgggcacagcattattcttttctaggccttaagggttccttctgcttaaaaataatgtctaactttaatgaagtttacccattattaaagtgccttctggatatatgttatcttgttctattggtttcaatacacctattttctttaaaaagaaaaaattatggaccatgaatgttaacaccagaaaaaccttaaggtacatctgatctaatttcccactttaaagtgagaaaatcaaacattgcctagggatctcatttttccccaggctaatttgggttttcatatttccatctcaaagtggactttctttggctaactttaaggtttttttttttttacatatatacaacttttattttttatttctttttttattttttatttttttattttattattattatactttaagttttagggtacatgtgcataatgtgcagcacagcatggcacatgtatacatatgtaactttaagttttaaatgtaaatgcctgaaaagtaactcaggatctagccttttcattagttttgatcatgtatgaaagcaagtatttctttcccccaaatgaaaccccagggcttccagtatttgtagtgatagtgtgaatccattaggtctatttttaattatatctgtcttattggtttttttttccacatttcctaactcacttgtgatattgcttcatataattcaactttttgtgtgctgggttcccatctgccccacaaaggcctctgtgcaaatctgatatcctgtttgaatgacattgttttgcttttaccctattgcttcgtatctgtcccaatgttaagtcagttctcaacattaaggcattaaaaattagcttttctcaaatgctcagcatcactaatcattagggaaatgcaaattacaaccataatgaatatcatctcacacctgttggagtggcatttatcaaaaaggtgaatgatatgttagagataatgcagaggaaacggaacacagacattgtgaataggtatgtaaattagtacagctggtgtggaaaacagtatggagtttcctcaaaaacctaaaaatagaatctaccctatgatccagtaatcccatttctgggtatatatccaagggaactgaaatgaatatgttaaaggtatatctgcactctcatgttcattacagcattattcataatttatgttaagatgtagagccaacctaggtccatcagtagataaatgggtaaagaaaatgtggcagataatacacaatggaatactatttaaccttaaaatgttgggggagagctcctgtcatttgtgacaacatgaatgaatctgaaggtcattatgcttagtgaaataagccaggcacacataccacataggctcacctatatgtggaatctaatgaagttgaactcatagaagcaaagagtagaatggtggttactagaggctggtggagtggggagggagagtagggggaattgttgatcaaaagtattgacaaaaagaataggtcttaagatatattgcatagcagggtgactatagccaataaaatgtatatttcaaaataagagtaaattttcaatgtttcaccatcaaaaatggtaggtaggtaagtttatgaatatgtaattagcttggtttaatcattccatattgtttgtgtgtatatatatatatataatcatataccccataaatgtatacaattacgatttgtcaatcaaaaataactatttttttaaaatagcttttttcaagtttatcacactttgtctactaacgtctgttcttcatatttgaatcttgattttttttctttaagaggtaggggtctcattatgttgcccaggctggccctgaactcctgggctcaagagattctcttgcctcagcctcctgagtagctgcaactatagatgcacactacctgggcctgaatctttattcttgattaactttttctccattacaaaacttcacataaaaaatgcaatggttgattactctagtttctttcacagcaatttcataggtatttattatagatcttacatctgcttgagaatagaattttgtgggagataatctagggaaaattactatcatggccagacttgaggcttcctgaggtggctgagtccaaaacataaggagcaagcaacttgtattggccaaaaggtgattctcaccttggaagaaagacaaggtgggatgtgtctgttaggaaaagcatatgaatgcttggagtaggaagggaacttggtgtcaggcaaaaatttaccttccaaggacataacaaggagaagctcaaaatctacctttaagggaccattttcctggaaacaagcaaacaaattttgagaatctggacacaaaacagttatggcaaagtaagctttatttaattggtagcaggagagtcacaacttcaaactccagaaaagatgaagtaaatttgcaatgatttcatacaccaagattcctcctacccaaagctgaagatatattttcaaggaaaggtgatggaaagaaaaatggtgctcgcccaagagattcttccatccagcaggcatatactttgtctatcatgagtcaagccctgatccaaaggcttgttaacttataattacactaagcatctctcctatgccaagtaatgtggcaagtattgtgagggaaatacaaatgccctaatgtaaaaagttcattccagtgtaggctgaccttctcaaaatggggtctggtcagattctccatgctaggctacaggaaagaaggctgaagaagcaaatttacaaatcagtttgcctacaattgagaattagagcaaatgacttgcaataccaggagtacttcagaccatatcaatcagaaactttcttcatatctgtgtctcctgttcatttattctgaagttaatcctgtcccacagtcattataaccatcagtgaccagccaacctcccaatctagctgtcttagagtagacatttgttcatcctgcaggtccctctctctcacccaagatcctcaatgaaatcagagagtgaggacagagggatctgtctggagggacagagatgtatataattaaagtcacaaccatcggtaaggaggactcaggagaagctgttcaagcaaaaggaaaagtggagctcatgcaagcactcaagggagaagggaaggtcgggtacagctatagcaacaagaaggtgatcctattataagaaggtgatcctactactacaaagaaactgttgagaatatgacgtatcccagacaactactcatgtccccaagtgccaaatcccaaaagatttgaggatgcttatttgggctcttcttattggttgattcgatgtctcttctttgtcttatgcagaagacatacaggcagacccagaaagcctcatttcttgtttaattttcctaatagccccaagaaagctattactggaaagtccagctgcttgtgcaggatatctaccaatgattcactttctccttaagaatcataggcacagtccatttaggagatgagattgctaaatggcatggacaaagtggagacattataggagttccggtgagtgcttgtgagatcactattggtgacttaatctctgaagtccagattattcactcttgtaacatgctagttacatcttcactgatggtgggtggaagcaatgtttcagcctcaagttctgaggtttgacaggggattgctgttgaagtaccatctgctgatcactgagtcaccatgacctcagtggtttgtcaggttgcataaggttctctttgtataatgagatttcactgagaaagattcttgctttggaagcattccaatcttcttggagtttcttcccaagcaggtcctccgccctgccacctccccgagcagcccttcgatgactccctgtcttctgtggtgcgtttcagttacaaaaagcccaaggggaatgtgtccatcgtcttgcaagtaaaaatgcttctgaagctatagctacagagaataaataggggcaaaggtgggtaggagggggaaggaagcagaagaaagagatacaatacaaaccaaagggtggattggagagaaaaatggagtgaagatatgggttggaaaggcagctgggaagttcaaggagaacaggaagatgactgagaagtagtttatgtaaaaagatatcttctcactaagtccgcaagggctgcaggagactatcagacctcagaagggctgtgtgctgtccaccctggaagtcccagaccctgacactgacttacttgctggtgactatggtgtgcagcctcctcctcaatactgtcagtgaactcagtgcttgtatcttcggtgtcatcccctgcagctgcacctggaaacaagtccagaaaagaaaagtgattcccttcacagatggcttccagacagcaggttaaattatactctttttgcccgctgactctgatttcttcctttctccatatacatggggcagaaattctccctagccagcagggctggaaagaaaaatagaactttttgtatcacagacactttcttactcatactccagcctgagcctcacaacataagctgactttgcctgcacagacccatttctaaggagccgactgtcggatgcactggttaccccactcgaatgtcaagaaagcctgaattattccccactgcctggctacataaaaactttctcttccataatatgagtccaacatgcttaaccctttccccaccactgagtgcctggagattagagctgccctgaatctctcagaggtatctattgttgggatcagttgtgcatagggtgacaatctctctgaggaacttccctctgggggtcctgtgtcctagtaaggttcaggtctagtcaagattcaagacaccaaaggattcagttgttccctaatttcttcctctaacctcccttcctcctcacctctctcaaactcttattctatgcagacaccctttgcctgaagggtttcttgcactgctttatccccgtgggatttaacccatcctttcattctccagagatggacacagccactctagggcccaaacatctacaccttgctctaaggtacaagtagctgcagtttgtggtatgggcaaaggtctaaggcagcactgaccaagaggactttctgcaatgacagcaatgttctgtgccagtgttgcccagtacagtggacacagtcatatatggctattgagctttgaaatgtgggtagtatggctcacatttcaaagcattgaatcttaaattttatttaaatttacttatatttaaatgactgcatgtggctagtggctaccctattggacagcacaaatctagggtgtgtcttcctccttatattgattaaaattaagactgttcatacattttaagaccaagagctatgttttatatactgtatttttcaggaagtgtagaaatttattatggttaatttgtcaaagaaaatttactgtgacactcactgtgtcttatagaacctccccaacttaagaatcttgaaatcttgttctgatcctagcctcggcaaccaaccagttacaactccacttctgaccactgattaacctggacctctaagagattacgtggtgagtccaaggttacacaactagccctcactagagctgcgccagtaagtcaagactctggactcttagacagaagccactcacttttccttctggtgacaaatctgatctttatctttgcttcttcctccaagaccaaagaaccttctgttgagttcagacatccaggcatgaaaggctctgcttgaatcatgagcattcactacccaatacagataaggggcttaccttatctccgtaaggaattcgacggagacaaataaatgctcatctcatctcgacactgccacacaggggttttgtttcttccccttcattctctcttttttaagctagctcacagtcttcttccattatggcagctttaagggttgctcagccttttaccaatttgaattaaaatgctgaaactttttctcccatgtttgagggggcagttcacatctatatatttgcaatggcccaggctgatctcatggaagtgctaagaggtagtaagtatgctgtgataacagcttaggtttcctcatctacaccatgaactttatgttaactttggatcaaggaagggtcctgttcagtgaagcctctaccacctctaccacttagcatctttagaggtctgtggcagacagtgtacaagagttatttccaatacttactcattcaaaccaaccccagaaaccatctcactcaggatactagctgagtagaggtgtatggacacattccctaatctttggctgctttaaaaacttactgaaaaccaggatactaatttacctaggacacccacatcatgttatgcttactttggaaaatctttccctgtacaacagtagcgatcacaatcttttatgtttttccagcaaaggaaatgaattgtctcactcagtgacagaaaacagactgttcacattgtttctcttttgaacatggggctagagaaggatcctgtagttgaagaaagcacagctctatgaggtcaggatcctcatcccctaccattgttgctgggttgtggagtcaggctgggcccacatcccaggaccattcctgccaggttccagaagcgagaattggaaagggtgactatcactggtcttgaaggtttttatctgacactttctgccctccacttatctttggcagcctttctggtgccacgtctgcattcttggataatgctccatcttatttcacttaagagcaggatgctatggttctggcttcataaggaattcgacggagacaaataaatgctcatctcatctcgacactctgccacacaggggttttgtttcttccccttcattctctcttttttaagctagctcacagtcttcttccattatggcagctttaagggttgctcagccttttaccaatttgaattaaaatgctgaaactttttctcccatgtttgaggggtaaagctaaaaaatttatagaaaatatgggaataaaagagtaagttatctcatacaaggtccatacaagacattagacatcttttaccattttccatttttttaaataaatgagagaacttctcttgtgtgatacccttttctaaacttttactgcacaacgaaacactgtcttcagaactaacttggaatattttgaatttctaatttaaggtacctatgattttatattgatgactcgtctgcttattttttgataaaatataaaatagcctgccgcctttagattctctgggagctaagaatctgttcatttaacttgcttcttcgagattaagttttacatgttagactggcaattttataaaaaacttttatttgaggcttcaataaaagttctcaacttgtggttcttggaagtttctaggctctgaacaatacaaaatggaggtgataccaagatgtcccttatttagaaaagtattttctatcagctatctaattctacaaagtacacaaaaataaacctctaaaacataagaccataaaatccttgggtgaaaatgtaagcgttatgcaaatataaggtattcttatcactgaagcaaaaattcatacttttgtagaactttttaaattgagtatggcataataattaagaacaagaactatggagatagactgtcttgatttgaattgtgcttttattgttagttatgtcacttcaggcaagtcataacctttccataactaagtttcttcatttaataattagggttaagagtgttacccactccatactgttgtgaactttaaagggtttgctgattttgaagtgcttagaacagtgcttggtacacagtgtgtactcaataaataccatccttaaacaatattattattgttattgtaagtaaactgaagtagtccatgggcttataagttgaagactgagaaagttgaaggccacagaacctaaatagcatcagcagaaggaagttttatacttgatgttactatctgaatgatcttgattgattctacctgcacttcttcatttctgaatacttgtttccccagcaggaggcttgaaatgacactctttgctctctgcctcacaggacattgaaaaggtaaggagtgacaactctttggctgaactctttggaataggtgccttacaaaaaggactaatcatcattaaatgataactgtcttaaaactccaacatgcacaaataagccttagggggaacttcatgacctctttttttgttttattttgctttacagatgaggtctcattatgttgcccaggttggtcttgaactgctgggctcaagggatcttcccacctcagcctccaagtaactgtgactacaggtgcatgccaccacacctggctcatgacatgttctttagtaatgagtccaaactgggtggagtcaagaccatttccccccaattctactctgtagtcattatcttcctttaagccactaatatgggataaacagaaaaggagtgatgtttttccatatagttacttagaacatagcaagagatcatattttattaattttaaaaggtgatctgaagaactaaaactttaagcatgaataagttggcagtgccaagtgttctttccttcggtaccgggcccttgtgtctaatactctcagcccaatttcactctgactcccaggtacactgccatgcgttcattacaagaacgctcacattttcacgtcatgaaccaactattgctgactttaatgttatggtgctgtaatgttatggagagaatcaaggaaaagaggcctcctatcaaactacaatttcacctgcacacattcccttcaggatcataagaaaactattaagattccatatagtcctccatagtttctgctaagaaataaaattctctatctagacagattctgatcgtggaacagaagtggtagaaaactgctgtctgcagtcaaacccctttatggtgtatctttgtctttaaattgcaacatctcttaagtagccttagggctttccagctcacatgtttcagaaagtagctgttttaagttacttgaaaaggccaaatcataatctaaaatacttttgggggtatgaaatcccattaaaattctggaaagagtttctacttctccaaaagggtaattattcaatacaactacagtcttctatccttaggctaaccaaggcacatgtaaattaggactcccaggcagaccaggagatatgaccactgcacctattttgtgatgccataattctgtaatgtcaagaaattcttcctgctcatggtctcttttattcttcaaagaaaacgagaaataggtttttctaggaatgtttagagacagcactacccaccacagttggctcctgaaacctctgtcgtgctttctgctattctcctacagcaaagaaagcaaggagggtttttaaggtaaagtagcctatgtgacatttccggggaaagtataacactgtttctttagtctcacttcttcgagaggagaaaaattcgagtttcttcttccttcctttagttaaagactcattctacgagccttgctttgacttggaatttagtaaataatcaatagactgattctcccataaggaaaaaaaagatacaagctttctctactttttttataaatatcttaagaataaaaccaaatagtttctgttggcctttgataattttattggatcagtaacaactttttgtgtttcaactaagatagctaaaattctaacacttatatgtaaaaattacactccattttagcacaaatgttaacagaaattaacagcacagtgccatgaagaaatgaaaaatacacagctttggtagggaaatggtcctggaaataatgtaatgccaagtttctgatcatttaacatatcactcacctccttcttcatctgatgttatgaaccactttatttatttatttaagacagagtttcactcttgttgcccaggctggagtgcaatggcatgatctcggctcactgcaacctccacctcccaggttcaagcgtgaagttatgaatcactttaattcttcttaacaacccacaaaagtttaagtgaaaactagtaagacttcatggacacagatagaaactcataatttataaaacatgctggtataaatgcatgcctacaaaggttatagattgagaaagaggtcaatatcttggagctatgactttgattattgtaaaaagaagcactacatattcatgttatatactaaaagtaaacctacaaggaagccaatatggtttatgtacttaaaacccctattctccatattattttaaatacaacattttctgatgttgctgaactttctattttacccttccagttttagtaagaggaaaacagtatgataaagatttttacttctggaatttgactttaaacaaaaaaaagggagagtaacacaaaaataatcagtatatcactttataagtttaattattcttatttgaaaacgggtagaattagtattgtcaggaccacagttttgtgttcccttccatttcccattctttgttggagacaaattacaaagctattttttatttagaaaattgatcttggcccaggtgagaacagggagaagttgaagacttaccttctgttaatacttagattacttaaaagcaacaggcttgttatttgatcataataaaatgttttaacaaagctactggtgcaaagggtgagaaggtggcttaaatccacattctaaaacacattataactgaaataactgaaatatacactatataaaaaacattataactgaaatatacagaaatcactcgaatatattatcctactgactcattccttctgtttattactgtattgccacattggagttccatatttccagctattctttctacggtacaaatggttccacactaccaaagagaaaagaaaagctcactgagctttaaccctgagagaactcagagaaaatactctgtgctggtatctcacaggatatacctggaaaagaaaactaatttcatttgttctatctctagtacaatttctacaaggtaaaatggaaaactcacttcaagtgtgtgggttactaatatttcttcctaacttcacaggaagtttgtcacctttccttgcaggatactgactgtaaacctgcagaatactacatgataccctacttgaaaaggccacttgagcttttcagggatgccaaatgtcaagattttgtgactgttttctataaaaagaccatgaaacgagaaaacaagtttatcctatcaatgggaactagagttttctaatactacctcaagaaaagcaaaggtattattgttctctctaaggcttacagtccaaaggaaagtgactttaggtagctcagtcaacctttatttctcaatgaaaaggacaattttcagtataatgtgatctgctactcctttccacaatcagaagactccagattcaactggaagatcaacatagagagaactgaaatcagtcttcttgaacagtttttgaagctatgaaccaaacatctcatgacccagacactgaattaggaggatgaatgagcataaaagtgataggtttttttatgtacatcggccacagagtttacttatgcataaactgtgtaaatagaatatactaaagaaccctcaaggaaactaattcttatgatgaggaactcatatcctctacaggttaagattttctggatccttaatagatctcttgctatatataatgtaatagaaacatcttttaaaaatataaataaggaaaaatgtatttcctctaagaagcaaaggtcctgaaaaaattactgctgtccacaactgaatgaagagaagagggtgtggagaaggttgggtgacagataagagtacacactatcaaaggaaaaggctgacctactaacttagtccaataatgtcttttcaaaaaagttataacttggctatctaaaaagagaacatcagatgaatgttgatttatactaggtactaataatcatcaaattttcaatactataaactttcaatagaaaagagtttagggacaatatctatctaaggacatttatttcactcattaaataagtcctcttggaggttcttttcaactctatacttctaaaacctacagacttcatctaccctgaactcttagaaccattactctgcattatttgctattattcaaaagggaagcatgagaaaaacaaaatctatcatatggatttttttctcaatttaagttctatgcttccaattaagcatggcctaagtaaaaatttacttcattatttttatttgaagactatttttactcaagcacaggttctataagcacacgatgctttatttaaaattactgtcattgaaaaatgactgtcaaaggtaaaataatccagtatgagaaagagtctgtgctcctgtagagaaaatggaatattatatcatgctaaatattattaaatgatgtgtccaaccacagcatgatctctgtgtggattataaaatttatcagactcatgctctctaatcagatgccaaattatcacacaaagttgttagaccagcaagctctctccagataacactgtttgcaagcctcattccagctatctagacccgaaaaagttagtaccatattctagtcacatttatgacattaagatcagacttttaatttatcctgctatcaatttactcttgctggaggttgacagaagtaggagtgattattaacataaactgtaatcactatgagccattagaaatgaagaatcacccagagctgaatcttactagcgattcagaaggcttccttggttggtctattagtaaaattaaggaaagatgttccctaaatgccttgttgtaatgacacgacaaactagtctttgatgggttgacatttctacggctccattaccttcctctttacttatggaaagttacaaaaaattttgtgcaagaaagggtctcttaaaattgggagactaagaaaagtggatggatcggcctacacttcctatctccttccttaaatgactcctttttcctcaaaagccattgaaactgaaatggcagatccattaagagtaaggcttatggctattaatcttttgcaaatgacttaatcagaagattccagagtgcttccccagtagagcattttctccctgtccactctagtttgactgatgctctatctgttatagacacagctaaagttacagaaacagatgaaatttagaatgtaatacaagccatgtcaacatgtgaaagaaataaagtgtcatgtaaaaaaaaaatggaaggaaaaaaaatcattgtgccccacttagtttagaaagggtattcagtcacatttactgtgctagaaagcctcaatccctgttcccaaattccatatttaaagtaactgaaacctcagcttctaacctaggaaacttccaaccagaggaaatgaaaacaaattcatgatgttgatctcacaaagctgcaaagcaatcttggttacttttcacacttgacattcaagacatcagaaatacaatctccagtgcccctctccttatacctgtcacgctgccacaagaaagcactgaggcaatgattaaaactataaacatacatctgtaacatttctttctaaactattctagcacttcaaagcctgaagcctattactgttatatggagaaatgtatacatactaaatagtgaaaaacataggaccctatctagtgccacaaatgaaagaagcaataccctcttctggctataatgagttatttggtgaaacactgaatgtaaagagggatactacatttgaaattatctttgtaaacagagaattctgactctggaagaccattctagaagtcatgttctgactaaatagcatgagcttggtttaaagaaacctaaaggaatcaataaagaacaaattttaagtagaatttaatctgtacctaatctaatttcacttgtgtacaacagtcaactctgagacagtattggagataaaagttgactatgatcactttcatagttcttgcctctgttctttaacttggccttcccaatacttgcagtctactattacaagactactctcctggttttgattaccttctgataaggattatatcacttttgcaaagtcattcttatagactctcaatctctttcccgctctctcatcttaaaacttgcatgcttttgatttaaaaaatgctctcactcaaagaggagttgactgaatggcaaaaataatacacacacatgcatttatgatatgatatggaacatatgaaatggattgtgaaagttggggaagaataaactttattggcccacagaagggatgagggaacgagaaggggctagggataagaatgaataaaagtggaaaaactaaaacagaatgatttaaaatgtgcaaatacactttgcaacctccaccattcaatttagggattgatatgtatgtacagtgagatccatgtaggctaaagtgagtttcactttgtagttgatgctacttgtaccagttctatcattagtaagtcaccgtttaattctgccaaaatcagacaaggatctttctggttagtgcaaacaaggttttccatcctgggctgcagtctgacccgccagtgctcagtaggcatgcttgtgatgaattcgcacactttccagttccccacctccaatggcggccagggtctccagcctgtttaagcgctccaagcttcttccaagaacttcttctagccgactgcgtaacacctgagccccttccagttccacctgcagagttcggtctctctcagagctgattaaacatgccacatggaaggaaagtggattagccatcaactgtagtgagtccacatttgtttccaaagaaccatcaataccactttgagccacacgactttgtaaagtaattgttctccaggacacaataaatgaatgtagtctttgtgtggcatttgtgttcactgctgatagattagtaaggactgttgctttttttaaaagcttgccccttatgctagattctgggccaatttcacataaaattatagctcctaagacttatctcacacccctatagcccaaacaagagaaatttcattatttggctaaaagcttttgtttctgaaaaactaaaacccaggacaaactaaatataaactggagcaagactgagccaagtagaaccactactgaagatatttgttttctcatttgttaccaaacttgacggtgggatggtgtgctgaaaaggaatctggttcataaaaactaaagctccagaggttctttaaaaagtaacacaatcaactggtcctatcatacctttcctctgccttcattttcctggtagaaagaaaacatttttaaagcccaacaataaattacaagaaactgaatagcaaaaataataataataataaaaattgaaaaagaataaaaggggctagtagggaaggcaaaatgagaaaacaaaaatgaagagaatataaaatgatccagagaggtatcatatatgtgaccaaaaatcaagaggtagaagaaaaatatattcatcatgatagctattggtggtcccaggatgatattagccatcccaattaatatattttctttgatgatattaaatgaatatcagtgcccattatagccttactctttttctttttttttgagacggagtctcgctctgttgcccaggatggagtgcagtggtgtgaacccagctcactgcaacctctgcctcccaggttcaagtgtgtctcctgcctcagcttcccgagtagctgggactacaggcgcgcgctacctcacccagctaatttttgtatttttagtagagacagggcatagccttacgtttataatagaacagcctttaacaggacatggatcacagaaaagaaatgaacatacattgagtgcttactacatgcaaggcattgttttagacacaaaagctgtcttcttatttaatctctgcaatagctgtgtgaaacaggcactaatcccaacttaagattttgacactgaggctcagagcaatccataaaacaaatgacaaagtgggtagccccggtaattgtccctcttttttctcccctcttcagtatcataagcatctgcacttaatgaagaataaaaggcataaatacaatagtaaaagaaataaaaatttcaataaagaataaaagaaaaaacagcctctctcttacctctctggatgggcatggaacttcaccagactgctatagagctgtctctctgcttgtaaggcctcattgagccgactccgttcatctactagtccttctagcatcagcagcaactgagtaaagaagagagaggaagcaatacgcaaatggcacagtgagacatgaataagaaacaagaaaatgcattagcatgtactatgacttaaaaagcccactatcttagtacttaagcttttgatactattttatagttttcaaatcaatgtcatattatcttttttttatctttaaaacctgtaaggtggaattcaaacatgggagcaaaaagaagaaaaagcagagagaagctggaagcacaggaaagcagctaagaaaaaggagtaagagggaaacaggatggacaagagggaaatgtatataataggacttactagtattcttcattcattcaattaatatttactgagcacgttctacgggacagactctgttctaggttctaggggaaagcttactatctagtggaggaaaaagacattcattaatcatagatgtgtgtcattgtgagtgtaataagtgctataaagataatgagctatgacaatgtataatcaacagagttgtttaaggtacagttaaaagccagaatgcagtggggtgagtagttagtgagacagatgataatggagacagggagtacaggcaagtaagtcttttggaaaagtctggcattgaagaaaggttaaatggggctgtagctacagagaaatttggggcaaatgtaggggtttctttctcttttttttttttttttaactgggagagatctgaacatggttaaatgcagataaaagagaaagattcagttgagggaggtgacttaggtatgagtgtgagggataactattggtatgtgtccaaaagaactgctgctcttttcagaactacaaatgtcagaaaggggcatctatagctgctaccgaccaaagtaggaaattttagagcacagtttctctaggaaataccatcaactaaccctccacaaatagctgagattgacagctttaccatggtttatttcacagtagaaaaataaggtttgagccgggcgtggtggtgtgcacctgcagctccagctactcaggaggctgaggcaggaagattccttgagccccagagtttgaggctgcagtgagctgtgatcataccactgcactcctgcctgggtgacacagtgagaccttgtctcaatgtggtgactcatgcttgtatgtaattccagcactttgaggggccgaggaggatggatcacttgcagtcaggagttcaagactagcctgaccaacatggtgaaactccatctctactaaaaaaaaaaaaaagaatacaaaaaaatgtaaataaataaataaggtttatattccagtaacttacctgttgtcttcggtttcctgaaatttcttgaccctgggattctactgaagcaactttttcccgaagaagtaagacttcctgggtcaggcgttccatagctggtatgtcttcaggatcaaccagttgcatttgcaggtcctagaagtcaaaaaataagtatggatgtgaaaatagtaataaaaggattattcagcagagtagcacgggaacaaatgtcttgaaatattctgcctatactttcaagtgggatatggataatcactggccaagggattcgatgtgtgcaaatattgtctgaagaggccctacaggtattctgagctgtgaacatttccagtggtctttaaaaagttttgaaagacctttatgagatcttctttaatctgtatgttcctggtcagagactccatatcagcagcctgcacctgcagctcttcttcctgcacagccatcatggactgtagagcagaaagttccatctgtgaaaagaggaaacaatgtctgccatgtttacattttaacactgaggcaaatgcttttgcatatcctattactatcagccagtaatggaaaagaaaatgagaacatgaatagggctctacagcatcaaaccaataatccatgcagtatagtaacaaaggaagttttatgggaagatgtcatagttgttcttaatgatgtcttctactttagctggcactataaaacacatcaaatttgtttaacaagcttattatgatactgaaaaagaatggttaccattagcagaagcaagaagagatgaagtttttatgtaagtaaaacttcacctaacagatgaaaaaatgatagcattaggatatctccattttgcaacccttaatgaattaagggataaggcatcaaacagcaacagctgctaacatcacgagagatcaccaaacattacatgactcctgatggaagaacacgccaccacctgtgaagaaatactgccaaaagttggcactacatgccctaaactttcagtgttctcatcagaaaatgacaagtacttggttatgacaaacttcattaaaaatcataataggccaggcgtggtagctcacacctgtaatcccagcactttgggaggctgaggtgggcggatcatgaggtcaggagttcgagaccagcctgaccaacatggtgaaacccatctctactaaaaatacaaaaactagccgagcgtggtggtgtgtgtctgtaatcctagctactcaggaggctgaggcaagagaatcgcttgaacccaggaggcagaggttgcaatgagccaagatcgtgccactgcactccagcctggcaacagagcgagactccatctcaaaaaaaaaatcatgataacaaccatagctgctaacacttactatgccctgggctctctaataaatgctttgtatagatttaatccttttaacaaacctagtgatctggctcctgcctacttttcctactttaatatctgccattttactgctcactcatgactctgtaggcacattagactttttctgttccaggaacaccagactttctcttgactcggcctttacaactactccctttgcctgaaatatctttctcagggctgcctccttttcatccttaggtcccagcttacgtgtcatctgctcagagaagccttctttggccaccctatttaagatggtctccatccatgttgctttctatcatttccctcatatcacttactatactctataactataatgtttatttatttattgtctgtatctccccaatagaaattaactacacagagccacagaccttactgatttcattcactacctacctcatccccagcactagcccaagcttagagaaggtccccatatagctaatgaatgaatgagtgaatcctcacaacaatcctatgagataactactcttttatttatacataaggtgacttcttctactcttcaacttacagacaaggtgatttgagtctgagagaaattaagaaacttgttcaaaaatcacagggctggctagtaagtggtaaatccagaacgtgaactcagggaagctgactcagagccactaggctataatatctttcctgtagataccacatatccatacaatctttatggtaagacaagttattttaaataaaacctttaaaggaatttagcaatagctaaatatcacccaaaatacccattcataggcattacaatttcatgatcctgaaaacaggacagaaccaaaaagtaacattactctggatttgataaatgtgagaaaaacaggaagaggatgtggaaactaaaatatctgacatgaataatcagataacggctaaggtagaaccacaaaaaggaagggggactaggggatttttaaaactggtatttcttaaatgccacacattctcatatcctgaaaactaattgagtcataaaacatgagtctgtttgtaagcagaaatatgacaatgaaatcaaaagataaaatatgataattctgtcacaaatacaaacacaggttttatattatagatctagctatggcaaaaggtagaaaaaaactaagagctatttggactagctagctaaactgaatttaggaagccatgacattgagtgatcttctaaaagagatgccagcatagtaacaaacaagcttttagtttcagtctgtaactctgagctgtggtcctagtatttcttcaacatcatagttgaatatgcaactagctgtggaggaaaggcagggggaagggaatctctaaggctgaaaggcctcttccaaaaaaaattgaagagaactctatgctagagcgagttaaagcataaggtgggaaaaatgtgctctaggaaatgaatcttcttaggaagtatgtgaagtcacaaaaggcttgagtttgaatcatagctctggcatttattagttacatgactattctccactcccattttaaaagagaaatcagtgtttcagcttcttcgtctataataattgggccgacaccacttactttgtgtagagttgtgagcattagtgctaatttaaatacctagcacagtacattgcacatgaatacttgataaacactgattatactcaaatttctcgtttcatgtttctaaatctaatttcacggatctaatgtcataactctaagcagcaatcacacagcgcttccttttttcaccagtgctttacaattattattattattattattatcttggaggcggagttttgctcttgttgcccaggctggagtgtgatggcacgatctcagctcactgcaacctctgcctcccgggttcaagtgattctcctgcctgaggctcccgagtagctgggattacaggcgcccgccactacacctggctaatttttgtatttttagtaaagacagggtttcgtcatattggccaggctggtctcgaactcctgttcgagcggatcaagtgatccgcccacctcggcctcccaaagtgctgtgattacaggcatgagccactgcacccggcctttacaattattttattccagttagcaatggggagagagggttacgtttttccagcatttaataagttttaatggtcccaatctaaaaacaggagcatctttttgagataatgtatatataaaataacttatatttttctccaaaaagaaaaaagtcatacctggcatttggactcagatattatacatggagaattatatgcttttaaatataaactattttgaaagaaaaaaataatagggattttggaattaagacttaactaaaaaactcacctgactttctctttcttttttagccatgagttcaagttcctctttggcattactcagttctttttccagccctgcaactgtgtccaagtctcctaaaatgaaaatatagcactagttttaattgctattaacataatgtggtatctgctgcctcctttgagtaatttacagaggacacattccaataataagaaaaaagaaaacatacacacaagttgttctttatagcattatttataatagcaaaatactgcaatcatcctagatgctataaagaaaagattgaataaactatagtatattcacagatggcactatatactgatgtaaaaaaagaataaggatgatctttatgaatttatatggagtgattttgagattttaagaatatgttaagtaaaaacaagctatgtgcttaagaatacatctaaagtagtaggttttctattaggaaaaaggggaaataagaatgtacatatatacattacatatacgcagatgattcatttgcttatttttgcaaaaagatatacaggaagaataacccagaaatgaaactgattacctgcaggagatgagtggaaacaggagagaaggaacaggaaaatattggacatctgagtatatcattttatatactagagttttgaactgtgtaaatgtttaatttttaatgtgtaagtcagtttgacaatgaatgagagagaaaaggtctaaaattgaatactaatataaataaataaatctatatagcaaatagataacaaaaccatccagaagataataaaaaaattaatccaaataatttttgaactcactactactctaactgaacactgtcagtgcaaaatatcctaaggataaaaagaattacaaaaaaatcttaaacattacttaatacatttattgttgatggtgatatttatgtaacaattccaaaaatacttttgcatattatagtattctgcaactgtgtaaatattttgaaatatattgatgctataagtaaccagggctctcaaggagatacaaatatgaaatgagggaaaaaagaacctatattgttaaattggaattaaggaaatcagtatcaaatcttcacatatatacaaatacacacatacatacttaaaaatattcattgctagttctgttctcttaaaagggcctagaagcggctgggcgcagtggctcacatctgtaatctcagtactttgggaggccgaggagggcggatcacgaggtcaggagattgagaccatcctggctaacacggtgaaaccccgtctctactaaaaatacaaaaaaattagctgggtgtggtggctggcgcctgtagtcccagctactcgagaggtgagcagagagatcgtgccactgcactcccacctgggtgacagagcgagactccgtctcaaaaaaaaaaaaggtcctagaagcaaaaggcattcatgtagcaatgaacacatcttgtgtccagatcatagtttctgaatgccattacccaccaaaaggaaccagggagctctttaggataatggctgattctgggactgaggcaggtaaagcaaaaggtaatcatagaacatcttattgtgccagaaactatcaaactatgctaacattatatatatatataacattagtaggtgatgtcaagttacagtgagtggccccagacttgaaacgatacccaggaaaaggtgtcagctcatggccctgctgtgcaggattggaacaattacctcctgcatttctgaatccctgcaaagctatctgaaaaggagagtaaggatagaatttctctgggccgaattgtgaacccagagcaatcagctcaactcaacataaggtaaggacagttcttcagcctttcagaggaattccaaacttatttgttctattaaggtaggaagagaaaagagtcttggccaaacctataatacagagattactagaagaaaaaacaagagaaaaacaaagtcccttaatgaaatgaaatttgatacttacctaatgtggatctgggtatgctgacatcctctttggcagtcaatgaagtgctatcatctctggaaggtatctgcattgaaccctaaaaaattgcaaaagtcaggggacttaggaagatgcaggaactatgatcacaatgacagtactgagaatattctcagaatttggtattaaaattatcaaacttacacctcaaatgtaaaaaggaaatggaatcagcatgaattatgtaagtctatagttcttacttgatcagtctgttttccaagacagccagtgggggtaacttcagcttgttggttagagatgggtgcttgggacatcagggagtctctccctcctaaatattggcgcagggcctgtaattctgaatttctttccattaaggcttgcaccaacttctctgcagcagcctagtaagaggaaatcacaaataacattataaagatattctagtaaaacaaattttttgttctggtattatttcttcaaagtcaaccatttgtaaaaaacaaacaacaatgacaacaacaaaaaacagtgggtccttaggaaatagtttccttgctttcagtttacagggaaaaacagagttaagtgaatggaaagaaagtctcataggcagaatattgggaaaaaaaaactgaatttaacacatctgtaacagataagagaatctgaaataggttctgctacaactatcaggctaaggtgttaagattctggtttgaattagtataacaaatgtctttattctcggatagttgcttcttaggggtggattccttttcactcaaacatttgtgtggtttgctcccttcaggtctttgccaaatgtcaccttatcaggttggtctttcctgcgtatcctatccaaaacagcaatcttgctggccaaagtataagatgaatatgttttggggatccaatgatagcatggtgactttagttaataatactgtattatttacttgaaatttgctaagagagtagatcttaagtggtttcaccatacacgcataaaatgtgtagtgacggatgtgttaatttgtggcaatcacttcaaaatgtatatgtatatcaacacatcatgctgtacaccttgagtatatacaatatttgtcaattatactttaataaagctgggaaaaaaatttttttaaaacccagcaatctcttctctatctccaacacttcttactgtgcttaattttttttcgatgcacttaccattatctaatagatctctctctctgcttcccctacatggaatgtaagtttcctaaaggcaatttggtgctgaatctcaagcacccagtacggtgtctggcacataataggcacacactacatatttactgaatgaatcaattacgcacataaacatgtttatcagaccacatgattaggataatctcaacctcaaaatcacccaactcagcttgtttcatttcaaatcccagttttctaagacagatgatgacacactaagggaaagatctagaacatttttaactattaatgcacaggaagtctgcatttaaacagaaaatctggaaataataaattgatattaaaattactgagggtctaagatgatgaatcataacaccaactgtctctgaggaaaagtactattgttttagggcagaagctgagctcttgtcacaatttctaggggaaatatgaaaaaaccttccacttttcagtaagtaaaatttgggctctttggagatttgaatttaactattttagacgtatcagaatattattaaagtaccttaataaaaatatctgtgaaaactgtggggaaaaaacataataaataatatacaagatatatactgtgctctatctgccttggcactccttttctcgtagtatttaagagtttttagcagtgctcctccaatgcagtccccgaacctgcagcatcactatcacctggaaacttgttagaaatgcaaattcttaagtcccacctatacctcgtaatttctttctctggagttgagctccacaatctacatctttaaaaagctattcaggtgatttcttttgcacgtaaatttagagaagcagatctagaagaatacaaccattaatcttcttgagttgaaaaatctcctgtaatttccatcatctccattattctattaccagcagtgcataattttttttctgaggtataataaagaccaattgtcccaaatcacaaagaagttaaaaagaaaactcaaagatcctagcctcttgccaaagatttaaataatttagaataattttgttaggtctattttagaaacaatttctgaagcacacagcaggacctttctagaaagatgtgtatttacttcagtgggcctaacaattagaatagtggagtataatcctttcacaacataagaaaacataagaaaatattatggggtcaaataacataggcaaaaaagagtctatcttcctctaaaaactgactacggggattctgagctactggtatctgaaatgcagcacaagtcaactaagagtttttagccttgaggagaaaacacatagaaatgaggaaaaattaacactttactatgggcagggcatggtggctcacgcctgtaatcccagcactttgggaggctgagatgggtggatcacttgaggccaggaatcgtaagccagcctggccaacatggtgaaaccccatctctactaaaaatacaaaacttagcgggcatggtggtgcatgcctgtaatcccagctacttgggaggctgaagcagaagaattgcttgaacccaggaggcagaggttgcagtgagccaagattgcgccatcgcactccagctgggtgacagagggagatgccatctcaaaaaaaaaaaaaaaaaagaatttacttcttaaatattgtgaaattaatataccctgtactattatgagattgtttattctcaccatgacctctgaaaaatgcgatcttttttccctcttaactcagattttacaaaaactaagagtaaacatgttgagtgtaagttttcccataccttgactggaaatgcaaaatatcactcaagtcttaacaatttagaatcaaaatcgaaacactcacaacccctactcctttctctcaaaattatcagattattaaggaaaagaaaatgtatgtaatgaagttaatggatacatgtattgtttaggcacccttccaaatgcaaggttttcaagaaatgtgtcatactttgatgattaatgtaaaactgtggtctaaggccaggcgcagcagctcacacgtatagtcccagcactttgggaagccaaggcaggatgattgcttgagcccaggagtttgagaccagcctgtgcaacacagcgaaacccccatctctaaataagtaagtaaataaataaaactgtggtttaggtaataaatagaaggaaagaaactaacagagttgacggtaaaatatataaatatacacacatctatagtctgcaaatgcttcctatttgcagactataaatgcactacatgacacttgtctgatctgtgcattaatccttacttggctttcctgctccctggtgctcacagactgaagcaggccttgaatctccatttcatgttccagcacttgtttatttcgatcacttagaaggtcctgcagcatcctttcctttcgctgtagacgctggcacagctcctctgctatctcactctgccctggtccaagtttgcagagcagtgttgcactaagatcctaatgcagaaaggacactgtaagcttctggaggaaagaaatgcctctgctaaatatcaaagggcttataagaatctatcatagaagaaggaggtgtgagattcttgagaataagtatcatgttttactcatttttgttttaccagatctagcacaggcctgctacacagaagtctctaaatacatgtcccaggaatgaatacaaaccatacagaaaactatctctggtggccacttacatacatattgttttctgaaataagtctttttcctatttgttcagggcatgtaacaattaatgttagatgaggataaatggacactcagttcatttatttgttttctccccagtgtaacttaacagggggaagcataaaacgataagctgaaaggaatactaaacactatatttgctatcatagcgatggtttctatttctgtactaactgatggcacatggtggaggaatggagccatactgcctaggttgatactggatctgctacttattagctatgttagcttggacaagttacttagcttcagaagtctgtttcctcctctataaaaaggaataatagaaagtacctcatggacttgtgaggatccaatgagttaatatccattaggatcttaaaacagtacctgacccagcatgaagactataactaataaaggttagctatcatgttaaagatgcaatttttgggtctcattaattctcacataagttctttgagaaagttaattgccaacttaagtttctagacgtggggaaaaaaaaaatcccagtgaaagtcaatgacttgcccaggcacagaatgaaattaaagacttgggtcacagtcctcccaatctgaagagtcctaatccaaggctgagattacataatcactgaaccaactgccttaaagttaactgaagtcttgcctccacttctttgttcctatcatgaagagacgtctgtaactgctgaatgatactctcttgttccttctgccaacggctaaatttggtttccatttcttctttcagccactggaggttttgacaggtagtagataactgttccacttccaggcctttggccctcaggagactctccatactctacagccataaagagagcaataatcagtcaaaatgattaccccatactcctcaggataaacaagaaattagatccacttttaaataatctcccatcaatttttttttatttgcaagatgagaacattgatctaacaatgccatactaatctatttttttggtttttagaaacttttatctagtttgtggagagattaaatatagaatatatgataaaaggaagtattttggaggaagtgcactaagctataaaggatttctcgaaaaagtggcagatagatacataagctctaaaataaatatgcaaaaaagtccacagtaaatatagataaacaagtgttctaattatggcaattcatggacatgtagataatattaatgtagaagacacaatttaataattgcaccctggtaatgcttcagtaaaagtaagagagagagagaagagcgtgtgtgtatgtatacttatgtatgaacaagaattggaaataaatcagaactatgtaaacagaaatcaatatttactggctctcctcacaaagttcatattacaaaagaaaagtagaagcgctaaaatctctcacttgctaattgacaatgatggaactagtaactgctctttttggttttcttcccccttataaagcaaaatccctggttttcagaaaatgatggaagggggtcatgcttcaggctcaggatacaagtgggagaggaacaccaagtcagagataggttttgctcttacttgcatagtagcttcattggaggagaggacatcgcgcagtctctctaagtcatgatctcgctctctcacagcaagacgaagctggcgcagttctttttctttctcttctagagcagagaatttttcatctatagcccgctgcaaggaaaggaagactcctaaagctctgtaagatttactatcctgatcactcttattcaacaagatggcagaatagaaaaccaaatcccaaagcagcaaatttaagcaaacacaaatttctataatacctatgtagatagaataatccatagcatagtgggcgaaatgatgatacatacctccagagcaacagctttatcatgtattcgctggcgaagtttctcaagcaacatttcatttgcttcaagggttttgtctgagttatctcgatactgtaggagctcccgaaattcctgagaccaaaaatagtttcttttattcttttatccaatattaactaaattaccaagtaatttgctagttattcaggataaaaaaaaaacaagatgtgatcactctcctcaaaagtaacaagtttagcagagataacagacatataaactgtaaactattctgcaacatacaacagacacaacacatagaattaactgttctgcaacatacgctagccaccaggggaacacaggatgcactgcctaactctgcctgaaggtgtcagtaaagacctcacagaggaggtaatatttgcagtgagtcttaattaaaggactaggatttcctaagtgaagaagggagaggaggatacgttagagaaaaaaaaatatgcacactatgcatacaatgaaaaaattgtacattcagtgaaatgtagtggattcaatgtgactgaagcttagagtaggtggcagaacagatcagtctcttcttaatgctccatcttcccctcaaacttttattctatcatcaaaattactctgtggaagtttctgtacagtttgtcttcatctattaaactgagatcagtagccaaatcttttgtcttcccaacacccagaaaagtgtttgattcacagaggtgcttaataactattttctgaatattaagtctttataaaagacttcataaaagactgcttaagtcagggctatatgtactgtttcttatacttgttagtaagcatcttaattcacaaattatattttctatttattttaaatcctcctgattcccacctctctcaatgttttccatatggcagggactcagcacaggtggattaatatcttaaaattatataaacaaatttcagagttctatgagcccagttttcattgaaatcatgtaaactcacctgaagcaactgctccttgtgactcagactatggtttaggtgctggatgttttgttcctgggttcgaatctcattgtatttttcagcctcccaggcacgaagctgttggctcttattctgcaattcttcttgtagctgctgcaaggcttttcgcaattcctgaattaaacatattacctttttaaagagatctaaaattgtcacatggttattagatacagaggccttaaaattttcaaggtatataaactgaaagaggagcagagggtgccattattaaaattgctatagaagtattatacatgaattgaataggatatggaaaattgtaaaagttgtgaatggggtaggaagtaagcttgatattatagttcaatacttattttttggcttaaaaagaatacatctatagaaccattaagtgagaatctgtcctacggtaaacctggattatttacaataagctcaaggataaactattcctatcatccttttttctaaagatctcatagagaccatcactcttctttcttagtttgccatatttatttttctaataataaagtcagtaatctttaaatcatctgttactttagaaagctaccaaatacatattctcaactaaacaaatcttggggaaatgtttcctttagctaaataacaaaaagttaagaattatttctacctccatccctccaccactccccgaccctgcccagacatctgaaattttaatatttcttttttttgagatggagtctcactctgttgcccatgctgaagtgcagtggtacaatctcggctcactgcaacctccgccttccgggttcaagcatttctgtgcctcagcctcccaagtagctgggattaaaggctcctgccaccacgctgggctaatttttgtatttttagtagagacggggtttcaccatcttggccaggctggtcttgaactactgaccacatgatccacccacctcggcctcccaaagtgctgggattacaggcgtgagccactgtgcccagccaaaattttaatatttcaaaaggaaattcagggctaatatttgatctccaaaccactaaaccagggagatccttcaaaaattacttttaaacctgagtgttaaagagcttaagaagagaccacacacaaaaaaatcttttaaatcttaaacaaacacatacactctgacctaacaagataaaggaaccatttaagagttgtgtattttggcccagcgtggtggctcacgcctgtaatctcaccactttggaaggccaaggtgggcagatcaccagaggtcgggagtttgagaccaacctgaccaacatggagaaaccctgtctctactaaaaatacaaaattagccaggcgtggtggcgcatgcctgtaatcccagctaccaggaggctgaagcaggagaatcgcttgaacccgggaggtggaggttgcagtgagccgagattgtgtcgttgcactccagcctgggcaacaagagcaaaactctgtctcaaaaaaaaaaaaaatgaaagaaagaaagaaaagaaaagaaagagagagagagaaagaaggaaagaaagaggccgggcgcagtggctcacgcctgtaatctcagcactttgggaggctgaggcgggcggatcacgaggtcaggacatcgagaccatcctggctaacacgatgaaaccctgtctctactaaaaatgcaaaaaaaattagccgggcatggtggcggccagtgcctgtagtcccagctacttgggaggctgaggcaggagaatggcgtgaacccgagaggcggagcttgcagcgagccgagatcgcgccactgcactccagcctgggcgacagagcgagactctgtctcaaaaaaaaaaaaaaaaaaaaaaagaaggaaagaaagagagaggaaagaaagaaaagaaaagaaaagaaaagaatcgtatatttattattcaaaaataaaaaataaaaaacagggctgattattatgcatgtcattcctctgaccttagtggttcttccccacttttctgcctggttttacccatccttcaagaataacctcagatgtctcctccttcatgaagttttccttgattccttttccttgactcctttcctagatattcctgtaggaccccatatatacatccccttcagaatttaccacactgaaactcagcttatgtgactgtctctcttactgaactataagtaacttaaaagaaaggagcctgtgctattcatccttgtatttccagggtacaactcaatacggcagtcgccccttacccacaggggatacattctaagacgcccagtggatgcctgaaaccagatagcactgaagcctgtgtatactgttttttcctgtgcatagataactatgataaaggtttacatacaaattacacatactgacagattaacaataacaataaaatagaagaattataacaacatgctgtaacaaaagttacgtgagggaggccaaggtgggcagatcacgaggtcaggagatcgagaccatcctaacacgatgaaaacctgtctctaccaaaaatacaaaaacaacattagccaggcatggtggcgggcgcctgtagtcccagctactctggaggctgaagtgggagaatggcatgaatacaggaggcggaggttgcagtgagcggagatcgcgccactgcactccaaccttggcgacagagcgagactctgtctcaaaaaagaaaagttacgtgaatgtggtctctcttaaaatatcttaatgttttttgtctgtggttgaccccagataactgaaaccatggaaagtgaaactgtggataaagagggactactgtaactagcatatggtacaagggcagcaagtgttgaactgaaatacttagattatgcaactgactcaagggttcaacacaaactgtcctgctaaaaagttatgatcagggcaaagtcagcatttagggcaataaaatagttaatgatttacctggttatgtttccaagaagcctctttctgctgttcactctcgtgtgctgcagcctctacaaattgcacacattgtttggcatcagccagttggcgctctttctgtcgtaccaccctctggagcttctgtatttcaagttggctgcagaataaagcactctgaagatcaagcagagctacctgttgctgagctggagaagtaccctctgagctctgaaaagagagtagaaatcacaatcacaaggagggcaagcactgagctcccacaaagactaaaaataaaatcaagactgcaaccaaaatggcacatccccaactgaagtctctcctgtcctacgtgaccctcacatacgtgaagttgtccaagctggctttggtgcagcatttctcgaagctttgccattgtgtcattttgaccttcaattacctggtacaactcctcagtctgaaaatgagagagggaatatcaaatatgttagtaaactaattataaattccattatatcacctgtacacattttagtaacaggactattccaaaatatcaattgagattaagctacaacttctccaggctaagacatgctagtctgacaatatccattttgacaaaatataaaatacttgtctactttgaagggaccaattgtttccacacaggtccttgattggtaaatatgttacctcacgttccctgcttttcagagtttccttgaggttctgaattgtaccatcttgcttttgagacgactcctgagcacactttagttcatagctcatttcattaagtttctcttgaagaatctgaattcagcaaagaaaaacagttttttaggtcaatgatgtcttttagcctcaaatgaataaagcctttcctcaaatctaggatttaaagaatttcttaggggatattaccttgttatttttcctacatagagtaaccattaaagtggtaagtcaatcagcaacaaaaagtagcaggagaaatgaaatacttccttcaatactaaattgtctcaattttcacgcactgtgatctctctatgatggcagccatactaggaacttgtccacatggaccaagtaggcaagtggtttctaatatggatcccttatacaaggaccaaagagcttctgctatctagcataggagagggcactataagggcacccaggccacaagttcagcatcccaaattgtagcaattttcttctaagccagacattaaaattcatgggctagaaagtagtaacaagttaagctaaaataaaaaacacagacctcctatctcagtgccttttacagtggaagactgcatgcaagtgtttttttgagacagagtctctctctgttgcccaggcctgagtgcagtggcatggtcctggctcactgcaacatccacctcctgcgttcaagcgattgtcttgcctcagcctcccgagtaggtgggattacaggtgtctgccacaacgcctggctaatttttttttattttttagtagagacagggtttcaccatgttggccaggctggtctcgaactcctgacctcgtgatccgcctgccttggcctcccaaagcactggcattacaggcatgagccactgcgccggcctgcatgcaagttttaattacacacctgaaaagcaccagaaattatgatctgtacagaacaagctaaaatcttcataagaataaagagaagaactacacttttacatgaaatattccctagagcacaaggagtacacagtattcatctcccaagtcctacaaaggttgacagactcaggctagagccagtcacatcctcaggaaaaccttgtcatctcctagggcatagtactaatcataccttgttggtggcctctgtttgctggattttttcctggagttctgccaagtgggaatcagatacagactgctgagttatagtggtctcatgtgaattcagcttttgttgtttcagcaactcttcagtcatgggctaggaagaaacggcaaggaagaaacggcaaaacgagtaaggtgagttaaacatggccaacaaaattttttttttgtcttcaaaaatgtctgttgcatcttttgccagagatttagagaatcagatttgttgcataaattatcagtatgaattcctaaagacaggtctgttccttattaagaacactgattcacctccatttgtactatgctccccagcttccctctccacttttctgtaccaattcacacaaacactacatgtttattcagcgaaagcaagtaattcagagttcaatgagaaggggaggatttaataaaggaaatgcttacaatgaccaaatatttgctttattctatttttaatcaaggagttgaaaaggcatactcatcaaacttacacttcctgagagaagttacattccggctacctttcttacaacatgcttgtttcacattattggaaaaaattggcagattttgatatggactatatattaggtaacagtattttatcaatgtctaattttctaaatttgataattgtactgtaattatataagagatgtccttgtccttaagaaataatgcttaagtatttagggtaaaggagtatactatctacaactaattctcaaatggttcaagaatttttaaaaaatactgtgcaaatacagacagtgggagagtttataaagcaaatgtgacaaaatatttgcaactggtaaatctgggtaaagggtatatgggagttcttggtatttctcttataacatctctgtacgtttgaaattatttcaaaataaaaagagaaaaattaaaataaatttaaaatagatgtgcctaaaggcagatttatagcataagcacagataaataatccatagtgaaatgggaaagagatatattttataggaatatcaattcacttaaaagattcaggagaaaaaagtatgattttatatatgggacaatttatatatggaacaatgatttatatatgggacaataagataaacttattgaactattcttagtaatcattacaagctaaggatgttaaaataaaactacaaatttactgcggcaattaaatttgatcttcccgcctccatacctgcttccattccaattaggaatataaactcattaagagagaaaaggcaactgctattcattttttgtttccctcacactttcagacttgattaccactttcaaggcagtggagttacagcttaccttaaatcccttcctgccagcaactgactggaagcataaaaattgcagaagaaaaatctcttctattcctccagtgctatttatcaacttttctaacacctactaaatgctataataagcaaagcaccatgtgaggcactgtgaggaatacaatgctgacataacatatatctgttgcacactaactatgtgctaggcactgtcttgaagatagagtatcatgcaagacaaagtccctgtgctcttgaaacttatattttgcaggggttggagtggggagtacatgataaacaaacaaggaaatgcaaaaaatattatggacaagccctgtgcggcaaaacaggaaagcataatacagagtgggtggttaaattaccctaaattgtttgatcagagaaaggtctttatgaggcagcatttaaatagatatctgaaggaaaaagaatcagtcctgcaaagatcagcagaacaatccaggcagaaagaacagctaatggaatatgagcctggaaaagagaaaggcctctgtggctagaatagcactctccagtagaaatataatgtgagccatgtatgtaatttttaattttctagtagcttcaatgaacaaagtacaaaataaataggtaaacttaattttaacaaaatattttatttaacccaatatatccaaaatgttatcataaacatgtaaataatataaaaattattaatgagataacattattatctgagataatattacatgatttttcataagtctgaaattcaaggtatattttatactcacagcacatctcaatttggactagccacatttcaagggttcaacagctcctaagactagtggctagcttactggatagcacagggctagagcatagtgggcaaaggggacagggaaactcaatgaggtggagaggcaggcaggcaccaggtcacatccagcttcagacaacaaagttaatgaactggatttcattttaattgaaatgagaatagactgcagttttttaacaggtaatcatacagaagttttgaaaagatcatgctgtggtgaatgaattattggggagcaccaagagaagcagagagaccaggtaggaggctgctgcggtagtgcaggtgaaagacaatagtagcttggatcctggtggttagtaaagggagggggaaataaatggatagatatggatatgttttgaaagtatagctaacaggacttgctggtggactggatagagggagagggaaaaaagcagcaaggataatgacttctggaaaaattatttgagatatttgttgttgtgggtataacaggaagccttcacctgaggcaatatgaactatgtcacaccatgggcaaagtaaccacattaatagatgtttacaatgattctaactaataaataaattcatcatttacttaatgataaaaccatctctataaaatttggcttcttacttcttcagcgtaaaacaacagtaacacctacagtaagatactttgaaattcaaactacaacaggcagaattaaagaaaatagcttcaagtttaaaatggcaaggaaggtggtcatatttatttactttaaaccaaacaatcttacagtggtgaaggaaactttataaactaaccatctgatccaatcctattttacatacaaggaaatggaaacttagagaagtaattagtccaaggtttcatgggaaatcaggaaaaagatccaattaaactgaactggatttccactcaggttgggaatgtatctctcatttctataaacccattgcctaccataatgccgggaatactgcagagatcaaaagtttttgtttaatgaacaaataagaacaataaaaacaaacaaaaacgagcctttagtggctctcttagaaataagactgtatataacatatattcgaacagcaactttaaagccaaagaatgccacaggaaaatacataatgtatttgaatctcatatgaatcaatcttgacatgaataataataagaaacctctttttctataaataatgtactgacctaaaagttggaagatatttgtttcttctttatttgtaataatttactattttgcatctcagaaaaatgtccttgcaggtaacagtctgctgaaagagcacttagcaagtcccactaagccaacaacataatgaattcttgtgaagtatcaagtacataaaacagtcactcctacaatgatagtgtagcccatgaaataagtaatacctgatttggtagaatcagtgttactctctagacactcaggtactaaaatcatgtggaaatgataatataattttaaattaagtcacttttgactcagaattaggacaaaggctttccagtatcagaaaagagaaccgcttccaggcctagtgttgcacaatatgagacttttttttaggctaaggccagtttttagactttttgtgttaacagcagttttcttggcactttctagtcctcacagtagtgagttatagatctcaaactgctataattgtcaaccctattgttaataataggagacagacaagaaccattgactaccataaaattaaaggcctaatcttttaccagcatctaatgccaacatcttccaaagggcctgatccacttcacataactaaaataagagtgggataaatttaccatagtcacaaaggagcagaccttggcattgcaaggtttaaggcaaagatcttctgttctttgaatttagatagaaagggaaattgcacatgggccagagctcattgctgtttactaagggaccacatccctcccatcatagcttttctagttcagggccagacaataaagaagggaattaccagctagaagaaggcttcaaacctttctttagatatctgaacagccttaggtcctcatacataaattctgtagaagggaaataaattactttgtataatatcagaatatcagtaagcagaactacactgttgctatttttctttaataaataagaaaggaacaaagaaaaagacggaaagaaggaaagaaaaaaaagaggaaaagcaatcaggaggaatcctgatgtcaatatttaatagtgcataaaatatggtaagtggaggattaaacaaaggaatcaaaataaccttacagaacaatcttgctctttaagataaaaggttttctccatatttgtggcagaactgaactaaaggaaacatttttttctttcatggtttcgtgtttctacaaactaaaaaagagaactaccaaaaaaaattatattatttctattctttccatatttgttcagagaaatagacaaaaaccagtctgccattgtcccatctagcactggttttgtcataaggctcttaaggagcttaaaagtaaccagatttaaacaatagatacaccgcccattttatttacaaacatgttgggcccaattcatctattttccctgacatcctaaattattagagaaaatggcataataattaaatgccacatttcttgaagctgaatgacattttctcccacctcctaatttttgtttttctagaaacagtaaacaatgtaagtcaagtcacagcagaaaggtcatacactaccatcttaaagctctaatgtccaaatttagtgaagtaaagggacttgacctgaagatacagttaccatagtttatatgtgttcattcagatgacaatttttttcacataatctctaaagaatcctccgagcatccttaggttagagaaagagggctcctggtttaaaataagtacttacttaaattaatatacttcagacaatggggtttaatgtatagaattaaagtgtcttgcctgagaatggtcagaaatctttgtctctgcatgggctacgttagttaaacaaggaactttccatatctccaaattgagagactgcctgaagatgatctttaaaatccttctccactccaaaatccagtcaccaaaatatagtattttatttaaatacggagaaaaaaagatcttgttttggctgttattttctcagtctttatgtaacgttctacaatattggtcatatttggtggcgggctggggggacgagtttatttcccatccatcctggcccaactaattttagaccctaatatgaaaacaccatgtttaatttgtaacacctatgtctagtcacagaaatactgtaaagcccaaatttagctgcgaggctccactgaaagaaaaagcaaaagaaaagaagtacacagtgttaagcatacagtgcttaacattttatacaaaatgaaaatgcactgactttttacctttcatgacactttcatctatgctgtttctcatctatgctgcttctcataattttgtgtaaatttaaaaacttttctcctgttttctgcttaggttcttattgtgatagacagtatacataccatagaactactttccaaaaatttcaagtggccatcaacaatgtcacttatcaagctctaaatttctggaatgacgttgaccagtagcaggctttctaaaaaatgccttctagatcacatctacctttgtgacagtattgttaaataagttgtatcaagtggaacatgccagaatgtttcacaaagtttattgaagctagcatttactgttgctatagaaacaaactaccatagttgaatttaaaaggttggtacagaatcaattgggcagacacgaatagctcaaattaagcaattaagaattcaagactataatgaatgaaactctcctctgatccaataatgggttaatcctttcttaatatcaaatatcttccagtagaactcagtagagttctggctgtgaacagtttatgccttaatcttttgactgacaatactgtacttgaatacttgaattcctgtctcttttatgaatgagtcatcactaatcctcaaatgaactattaattctaattaatatggtccagatgttataatactttactggtggattaataggctttccccaaaccttttaccttatgctctaatcatttacaggcattttgcggatgaaggctttaatgctccaggaagaactaactagagaactaactgccttacagaaaaccattgggaggaaacgtctataaatctgaaaacaagaacaaattttaaaagttggaaaaaaaaaagaggtaagaggaaaagttctagtgccagaaatgagattaaatgtcttctttttataggaaaaaagtgaagtaggaatctttacctttttgttttaaaaggtatacaattttgataatgggaaagtcaacagattttacaaaaaggattgtgaaaatcaaattatctgagtgcaaatcacgtttactaaatgagacagagcaaaaggtgcagcaaaaatggggtcatgactaattttctcaagtccagaatatttctaacctccacctagaccgaaatcacgtgaagccagaggccagctagctataatcagaaaggcactatgtagccgttttgtatacctggacccggagcggcaaataatcttcacagagatcatcccacagctcctgcaggtctgaaagctccaagggataactcacaggtgtcttgtaaaggggtttcaaagacctgttaaggaaaccggaactaactccatctgtcatgctagggccaggcttggctccaggtaggctggatttcactggaatcggaagcctgctccctcgggggctctggatgggcttataatcaagacctttaatcatgctaagagctaattccagcttgtgattacacccatgctgcggagcctgatcatctgaacaacagtcacactttccaagttcctttgcacttctctcagtctcctcatctttctgttgtggagggctagcctggacgcttgcatccaaagattccacagaggaaccaggcgtctcttcctccatgctttctccatctgggggtacctttgtgcttgctaagtcgggtggcccaacctcagacaacgctggttcttcagtgcaaatgctggtcgaccacctgctagaagggccgcaggagatacttctggccacctttcgaggtaccttacaaatggcttcatagtcagaatcagcaacccgcaaagcggcacaaccacggcatctcctgggtcggtttccagggccttctgaaccatggcagctgtgtggctcctggatctgatcctcattctccacccagcactcaaaccctgaataggcgaagtcctcctggagcagtgcagagtatctcgcatcgggtaagacggacatgtcaaccgtcccattccccgccttgatctccgcgccagagtcatcgttattcttccgatacatactggcaatgcagaacttgaggcgatccttctccagtagcagcttttgcaagcgctcaatagaaagcgcttcaatccgggcaataactgtgtcgaatcgatagattcgatcaagcatgaaagcacacttgctgcaagcgaactcggctttgccatcgcgggggacatccttgcccaagacgtgcgaaagcagaacctggagattgagcttggacgccgtgtggaagatccagcgccgctggtttccacacagctctcgggcacagatcctgcaaatctccttcatcttccctcctagcgggtggcaagcttcccgaggcggcggcggcggcggctactgggtgaccactcaatggctcttcgccgcgctctgtctcccgcctcggtggtctccggtcagcatggcacagcccagtggggtccccactctgcaggggcgcgcccctgccccgcgcgccgactccgggtaccagagccgtcagccccgcccctcgggcagggggcgggcgtggaaacgcctaagaggatgctgagtgacagaggcgcaggccgcgctccgaccctgccatgtctctccccagctgtctctcccgccagccgccgcgtcctcaacgtcctccccttttagcagactgggctcccggagcagcagcggccggccgcgcagacgcaaagcctcggggatggaggatcagatttcaagatggcgccagcggcttcgcgtctgcggcctccacaaggctcttctgggagctgtagtccggtcagcgggcttccggctctgcgcatgcgaggtagccagcgcgaccctcgccccaaatccggttgcacacctggctcacggcgagtgcggagcagaaagcactactggcgcgggccacagccagccgctttcatctgctaagacctcacctgaaagtcgcaccagtgccctcaaggatcctcccgcctctgcaggatgtcgaggctcctcctcgcggggaggagaaagacgaatcccctccctgcattctcggacagtgccacgtcctccggctgccagcggggcagcgccgctaggtaccgctgcgcgccgcccccgcttcccgccagcagcctcacctttcccggccccgccccgcctgggttctaagggcctgaggctgcgaggcaggcgagggaaggcttggtaacggaggggcggggccgtgcaacccttacctcgactctgaacaggaatgtccagaaaagagtagaggagtgtttctcccttgatgtgggtgggggagggttagtacccgtgggtgacttgcccttctttagataaaaaagcacagagcagtcacctgagaaagagtccggcacatacaatgtgaatctggttaaccaagatcttgaagatagtagaagagaaatgggcttttttaaggatgcagccagccgcgagtagattaccaccattgaagtccctttccctcaggtagagggcagtcattattttaggacaggggacggtagacaaacactagcgcaaaagacagtgcttctttccgtaagagctggagtgtctgggaatgcagctcgcgccagaaaggactgggaacttcactgacttcggtgaaaaccatgtcttactcagcattgtacagtgataggtcctccacccttgggtccaaaacttagattgcacacaaagaggagggaagctggagccctgactaggtagaatgctggtacctccggccatttttaataaggaattatcttcctggcttgagaggcattcagacacgtaacaagaggaacaacctcagcaatcacttgcagtcccctagagcaggacatttcccagttctaatcatgctaaatttttactaacttgaccttgtaagctaaggccagcaacatctaagtttttctgaacctcatccccaggacagagtccatactcctaagcctgaagacatccaaatgccatctctgagagttcataataagcccccaaacttcttattgaagactaaatgagatgattttgaggaaatgctttaaccgtgtttcgctcattaaataatagctaatattattattttactatgaattggaatattttcagtaactttaaaacattatggggccctgcctacataagattgtattgttctcttaatcaccaaagcaaaatcttgtagctccattgtaagagaaaaggacagttcttagagctttgggcttagtaggtgatatgatttgaatatatggccccaccaaatctcatgttgaattgtaatccccagtgttggaggtggggcctggtgggaggtgtttggggcggtggggggggcagatccctcatgggtttgtgctacctttgcaatagagagtgagtttttctgagatctggtcatttaaaagtgtgtggtgcctccaccgctccatcttgctcctgctctggccatgtgacttgtttgctcccccttcaccttcctgaagcctccccagaagccaagcagataccagcaccatgcttcctataaagcctgcagaactgtgagccaattaaacctcttttctttatacattacctggtctcaagtatgtatagcaatgcaagaatggcctaatatcataggctatagaattttgcatatgtaatttcatctactatgtatattctgactcaaaaaccaagaatagaaaagcagttcaagtaaaaccacagctgcatttttgcctgcctctaggtatgtgagcttcaaagttggaagaaattaagcaacatgctttggaatctatggtgatctatagaaaggcaaagtttctggactcaccctgactgatggaaagacagactgcctgccaggacactaccctgctgtacccagtcttaagtataataaagatctcattttttactgtcaatgcaagccacattttcctattaggaaaatgtgaatgaaacaaagtgctcttcaagagcaaaccctgaattatattttgggttattctctgttcctcaaaaggattttgcatctaactgatagtctccaaattgtaatgacagtatatagatagcttggtgtagacatacaggtcaatacaaatggagaaaaggcaatttgccattgaagaatatgtttgctttaagtaaagatcaatatactaagaaagctatacatatctagacttccaaaaacagatgggaataaactactcagcaatcagaatattcgaagatggcactctgttcacttccagagaaaatagttcaaaactgtatctcaaagtggatataagctattgtactagaattagtccctgtgtgagcatttggcattataaaataagatgttcccaattaaaagatcactggtatgtagataataaaacgtgaaaataaaaatttaaaaataaaacaaaaattatgtgataatcaattttgcactccttggtccttaccattattatcttgtggtcaagagtttgcagttgaactggttacctatggtggggctacacaaggacatttactttttattctacatactgtgtatcatttgaattttggacaatgaatgtttattcaggtattaattttagattttatttaatttagaaaacattttatagttaaaataagggctgccaatttaacacactaatgtcagggtctaagtggtaaaacttgaacctaaaataagaatttttatactacctatgataaatatataatataagaagataacttatataaacaaaagttcaaaggggatccacaagttattagtaatggttatgtctagagagtggaattatggacatttattttcttttttccttattttctataattttttacattatgtattacatactttaaataactttaagtacttactgcttttgtacttaaatatataaaaagaaaaaaatataattgttactaagaaaaaggtagatgaaacacattttggtgtattcatacaatacaatacagtactagccagcgatcaaaaagaatgaactcagatacatgcaacgtggatacatcttgaaaacattttaagtgaaacaagccatatgcaaatgagtacatcctgtgtgattccatttatttgaagtctgacaacaggtctacagccgtactaccctgaatgcacctgatattgtctgaagtctaataacagactataggaaaaacagatctattgtgatataagtcaggaagtggttgaacggtgagagacagggtgagaagtgattgcaaaggggcacaaagaaattttctgaggtgatgaagctgttctgtatcttgttttggatgaagataacataggtgtatagaattgttgaagctcattgaactgggcacttagatctgtagattgtatacatagtatatttcaattaaaaagattaaaaggagtaaataaaactatgtgtttccctcaaaattttaatttgagggatttctttggtagaaagtcacccgcactttaagaacagttttgaaaattagggaaatgctataaaatatagcccagaagaaattctgtaaaagacccaattgcaaattaaaaacttaagcctatccatatgagtttttttttttttttgagacggagactcactgtgtcacccaggctggagtgcagtggcacaatctcggctcactgcaacctctgcctcccgggttccactgcgccccaccttaggataatattttatatgcatatgtacaccaaacacttatgattggaggaaggcatgttgttaaggtgagacttagggcttttgtaatgatgtagtataaaattattacttctaaaacgtagtgaaggcacataacgaaaagtttgagaataagcttcatattatgattaaacaaattattaattttatatatcaacagttcaccctgaacattgattaataaatacatttacaagcatttacttgctttatggcctaggttaagtcacttatatctggcttttaatttcctaatctacaatgaaatatgttgaatttaaacagcagttttcaaacttaagcatgcatcagaatcacctggagggcttgttaacataaattgttgggacctacccccttgagtttctgacacaataaggtctggggtggggctcaagaatttgcattcctgacaagttcccagatcatgttgatgctgctatctgggaatcacactttgaaaaccactgaatgagaactatcctaagctgtatcagacaacagatcagaacttctgcagatagacagaaaagcacaccaatgaagaactacttacaaaatctatgttgaatttagagaactgtatccgcatgtggaacaagatttctaaatattactgtggtatggggtgttttgcactatctctgttttgacctctaaattttgcagtcaccatagtcacttttgcaccccctgtgtggcaactgggttgtagtgtttctaagacctacttctgggctgagagggagtttccaaaagaattggagaggtggaaaatccccatgtcccaaaccagttgtattaggtttcactgccctagttatgacattggaaatagctattctaattactaaaaactatgcaccaaaagaaaaatgtgattctggcagagaaactaaggcagatgagaaaatgcaagaatgtcaaagtaaagccagttaggctttgtggtaacacacaggcagttgcgtgatttccctgtgctctttggaaacctttaagaagtcagaaacaatcatgctttccattaattaacaacacagcatcttgaaatgcttgttttaaagccaggagatttccggttcatctgcagattatagtagtatgcttctcagcaaaatccatctaatagtaaacattagagtctttcaagttattaaatacgcataggttgttaagtaaattttaaagtatttgttaaatcaatcaatgagcaagaatgcaaacatacctttttttctctcttcaatgagctttcagtttagttaaaagggagaaaaggtgcacgctacagttagaacaattgactggtaaactaaatggtactgaattaaatttagtgtgaatacagaaaaagtagaggttagtatgggctggtatagttgaagggacaagagtggcacttgagatgggtgttaggatgaagaaggccaaggaagggactcagcaaaataaaatagcttcattaaaagccacggaacttgggttaaacacagtgctagcctgtaggtaaagagagatgttggggatttttgaatgaccaggttcatccatccatacatctaatcctctatagttgttcattcaaagaacatgtatcaagagccaactgtaagccagacactatgctatggagtgccttgccaattagaatttggttaatgttttgacaaaggcaaaagaatttggacttaatgttatggatttaagcagacaatgacatgatgaaaacctttttttaggaagattacccaggcaacaggatggatggtacttcctttttttttttttttttgagacgaagtcttgctcttgtcccccaggctggagtgcaatggcacaatctcgactcactgcaacctctgcctcccaggttcaagagattctcctgcctcagcttcctgagtagctgggattataggcatgcgccaccacacccagctaattttgttatttatttatttatttttttcaatagagatgaggtttcaccgtgttggccaggctggccttgaactcctggcctcccaaagtgctgggattatatgcgtgagccaccgcgcctggccctctgcttccctcttttctaatctgatggttaagcccttagcattcccttgactctggaacttttgcagagcaaagagcagaggctgtttgaagccagctgcatttctagacttttatgaaattctaagcccactgcaaagattgagccagatgtcccattggggaagagaggagagagaaaagtttttgaagtcagcgaagaggagagagtgacatttcacacagatggaaagagactggaggtcaaagagtaacaagtacccacctccattccatatcagtgccctggagaagcagcaggacctcagagagggaagtaatggggtgacttggagaggctgcactttagcaggggattctggctccataaaaggttaaatatagcaagcttctagggttggcaaaaccatgcttactgaggcaggggtggtttagtggcagatcaacgatcagagtagtctccttggtgctttggtaccaggtaaaacctagggacctttaaatagctgagaaagtagggagaggaggaaatatcaaacgtatgaaattgaatttctcaccatcctgattcagacaggggctttaaattgatgactaccttagatttatgaactaagagtcatacactatgaacttttgttcattggtgctcagtcctagacccttttcacctctctattctcttctggtgtcatctcatcctttcccatctttataccagtggcttccaatttatgtttttattgtagaattctcatctgagtgccactctcaaatacctggttacctatttgatatctgcatgtggatgtgtcatagacatctcaaaattaccgtaggaaagactgatctcctgactgttgtcttccccttgtttaaagtgcctccctttcctcctaatactttatatgaggagtcagaaaactatggactgtggaccaaatccagcccccacctgtttgtgcaaatacagttttgttggaacacagccatgttcattcttatgtgttgtgtgtggctgtttttatgcaacaatggcagaaactttacagcctgcaaagcttatttactatctggccctatacagaaaaagtctaccaattcctgctctttgctttcttcaatgtatttatcacaatttgaagttatatatttgtttcattatctgcttatttatctgcctccttccatagaaggtaattctctagtgcctaccatgacagcaccattgcctagtcatggtaggcactcaattgttattgaatagaatgtatgaatgagaaaatgaactattatatattaaaattttattttggtcttttgccttagcacaaaactttcatccttccttaccctccaatgacttcatatctttgttttgttttgtttttttctgagacggagacttgctgtgttgcccaggatggagtgcagtggcactatcttggctcactacaacctccacctcccgggttcaagcaattctcctgcctcagcctccccagtagctgggattacaggcacgcgtcaccacacctggctaatttttgtattcttagtagagacagggtttcaccgtgttggccaggctggtctcaaactcttgacctcatgatcctcccacctcggcctcccaaagtgctgggattacaggtgtgagccaccatgcctggccctaatgacttcatatcttaagtaacaagagtgctaaaataatgagtcccctcaatttctttgccctctactctatcctcctttcagattaatctttctaaaacagagctcagatatcactctccctcaaagaaacctggagacccaatgacttgtccattaatcctaaacttctttacctgcttcttaaagttctctgaatctggctccactctatttttctgtccccctatattctattcctgctactacttctctaccctgaacttccccacctctatacttcatacacttggaatattcttttctatcactaccacctccacctatcaaaatcctatccacccttcaagtatttcctccaagctgcctttctgagtaccaccaaaagacatctttctcttcttccatcttccaaaatacttttttgtacctatagtaacttgtatgtcatttctccatactgcgttctccccattagctggtaagctacttaagaaaaggaaccacagctttctcatcttggtatctgctatggtttgaaagtttgtattcccctccaaattcatatgttgaaatcctaacccccaacataatggtattaggaggtgggggctttgggagagattagtgtccttataaaaagagacctcagagagttagctaatcccttctaccatgtgaagacacagcaggaaatccataaaccagaaagtgggccctcaccagacactgaaaatgccagtgccttgatcttggacttcccagcctccagaactgtgagaaatgaatttctattgtttataagccactcagtctatggtattctgttatagcagcctgagtggactaagactgcttctgaagtatttggaacagtatctttctagatctcaataatcattgaatgaatgaataaagaaatgcctttccttttcatatctacttggtaaaatcctactcattcctcagagaccaaaatctttgcttctgaccccagtccatgatgatttttcctttctgtactgccttgtatttttttcatcagtgactttctcctattgtaatctctagaaggtagagactaaatcctgcacatctttgtgttcttcttccttcacctaacagtaccttgtgcattacaagtgctcagtaaatatttttgattaagttgtaaagcagctgcctatttttccacttcctttgctgctcaaaaggattagagcaatgattgctttagctgctaaggcctgcttcagagacacattattaatgaaggttgtctgggagacagtaatgttgaacggggatttgtaaatgagtctccagcttcaacattcatcagcaaaagaaggggatactgaaaagctactctaaaaaaaaatctcatatgaagttgtccggagctgcctgagctactaatcactgcaaggttttcagtctctgccttgagcatttagagcacattcttgccttaacctccaagtcagatctctccatggtaacgcaggaatgtttgctattttaggaaatatgcctcactgcatgcagtactatttacattaagttccaaacaaggcataaatgcaacagcttgactgtgctaatttgtgtgagtgggaaggtctcacttacttaatgtgggcctctccctaattgtgttatcctgtctcattttataagccaaccacagtgagattacatgttaataaattttgctcatcttatactgaaggagaaatgcagagagagaaaaaaggcgacaaacaaaacaagaattcctccagacctccctttgcaagggcatcattttttctgccttcacaccctccaggtctggtttcatttaaaaccttcattgagatgaagcttctaacattctgtagaaggaaataatatcaataactgaaacaattgctagcttttccctgcaactttgtagatacctttactgaggaagagaaaaatgctttgtaaactttattagattttctgactccctagtgaaaaagatgtggacaagatgtcacagcctcacatcaaaaagctcctcaacactctgatcacacatactattgatctgaatggacatcaagaaggattggaaggagatatggaatgatgtcagtcaatggcatatctagttggtggtactttttttgctttacaagaagttaattatagacgttcataaatactgtgcaagtgcactcccactaaaatgaatgttgtagaatgttttggtagaatggaaaaggaaaacagctagaaagactgtaagatcaattaaataaaataatctttatcaaaagtgtctgtcttatttgagagaatgaagactctgaagtgaacttcctgtactcagatattacagtgagtatattatactcatactccagactttcatactgggatcacttgagagatagttatctgtgggatgtggagtaaattagcgttcttcacttggacaattcagacctagaagtgcaagatctgtgagctcttctttcttctagggcccaactgtttgtggtattctcagttgtgaagtataggtggaattaaaggaagtgaataggtctttagaacttaagctcctccatactccagctgaatcagtgagggattccagggatggcttcactggagatgaggagattctttagcctctgaagaacaggcccagagcttagaaattgaacttttaccttccacattgtaagggtctttcttctgtggtgacagttggcatggcagacaaggtttgagtagaatacagtggaactataactgttacagtgaaagtatactgttagcagagaaggataacacccacaacataggctccaagtgtcacaaatagcaaggttcaccatacattacctatgcagaggggagagacaaagtgctttgtaattggttttataatattcttttccccaaccaattcaaagaacagacttgacaaagcagttcatagctgtgtcagattatgatttgctctctgaggaggtgacatcaattatctcagatgctcttcaagcaatcctcagtttccacgacaactaggattacctttctaaatgcaaatcatatgcttttattccccttgctttttttttttctggtgcctacaacatgaagcccttagctcaacatttatggtactttccagctatatattttatcattctccaatacttatttttggtaacatcgattactcccaattccttagctgtgttccacatcactgtatatattgctccgtttcctattttctgcctggtgtatccagtctttaaggcccaacagaagggtgacctccaggtgagttcctccttggagttaattcctttcagctgtgggttcctttagcaccatgcgtgtatttctgtctcctcatttatcacactgtattttagttctttgtttacataccagtctttcactggactataaacctttggaaggctaggactccctatactagtggtactcactgagcaactgtctcatctcctagagagcattttgaaattttgtgggggtgtttcttgtttttgatgttgtcacgatgataagtgaggcaagggatgttacaggacaaagtattgtaccaaattccaaatgacttttggaatttgaatgttccattgggtgatgataaaactgtttacaatcatctgaacctagaactttatataggagcatgatgttaatttacactaaatttttccatgaattaaactactatgtaaattgagggaagacactaccagtccttgggcccaattttttttcccataagacgtagacccaaagggagaaacaaggaaatatgctatgggaggctttctattctccacacttgagaggaccaactatcagcggcctcctgtggcagagctttccaacttgggtattccagcacagtgtacctcagcatggtccaccactgtgcaaagatgctgatcccctcagctctcagggtggtgcatgggtcctgaggtggccataagcaattgcctcaaaccatgagcagccatgggcacttatttcagaataccatagatgtacactcatttcctatgaaaatgaattttctatgaaaaagggtaggaaacattgtcttatagaacaaacagcgcaatgtatcaggttttgaaatgtacaacgtattgggtaataacaacaataaatttttattaggcaatgtttaaaaagcatatcaatttagtacagtttatatgatttgatgcatttcttctgcccaatggtcatgcaatattatcccctggatgctgtacttattcttgttctaagcatccttttagagtagaatataaataatttagtctctttgaaattataatcttttggttctttaagtctgttctgaaaactggtaccaaaccaattccttaattagcattgaaaatactgaactaaatatattcatttcagtgcttaccaaagatgatgaaaataagtatatgtacaaaatattttagtatttatgtgcctgtaaatacaaaaggagcaataaaagtgatttcatttcagaaggtgaacattttgaaagaaataatattcatgtaaattctgaactaaaatagaatgaaataaaattctgaaataagataaaaatagaatgttagcattataggaaactatagagattatttgagctaatcttctcattttatgtatatggaagctgagaagtgacatatccatagtcatacagctaataaataatcaggatggaatcgcttctcggccttttggctaagatcaagtgtagtatctgttcttatcagcttaaataatcaggatggaaattcaattcttcttattctcagttgagctttttctaattaaatgtattacgaaatattttcaagagtcccttaagaaaatttccacatatttcaacatgtatcttgcaaaaagcctatgaacttcaatttgtattcatacttgtaaaattatgttcacacattatttcttgagtttgttaaccaatgctttccaaccaaaatggagctgcagtctaagaagtttgtaattgtggccaagatagtaattttttcctgccctcatagtggcctaagcacccaaattggccacctccaagtgagaagcttcatccatttacctctataccttacaaatattatcatttgccatgaaatggaaaggttgggaagcagtggtttaaactaattcttatcattgctcttttatcttgaccccaacctttccatatgtgaaccagtaaagtaaaccacccacattttgtcttatcagtagtctaagaccagtgcaagaatgtaaggataccaggtaattgcttttgttgtttgggtgcaggtatattctaaagttcttttagaaaatatctttttagtaaattaaaagttgaatgaaggagaggagttcccttcgaggtaacttcccagaaaatcaatgcaattattttttaccacagtgagttctcttttcaatattaaaactacattatggccaggtgtggtggctcacgcctgtaatcccagcactttgggaggccaaggcgggcagatcacctgaggtcaggagttcgagaccagcctggccaacatggtgaaaccccatctctactaaaaatacaaatattgctgggtgtggtggcatgcacctgtaatcccagctactcgggaggctgaggcagaggttgcagttagccgagatcatcccactgcacttcagcctgggcaacagagtgagactccaactcaaaaaaaaaaatttttttttggaggcaaatttctatcattatctgatacacttggacggaaatagtaatcaccatttcaactagtacccagcacattttcaaggacctggaaggttcatactccaatatatacaaacagagaatatgcctagctcatagatgatcaataactgtttatttgaacccatagtttgtgtacttcggcacagtattttacaacttaaccctcaaaaaaacccctaaaacattgtatgttctgtataattataaatcacttgatgtggctggcaaattctaaggtggtccctataattctcacccactggccatcacatctttgtgttatcctcaccccttgaggatgggtagaacctgtaacttctaaccaatatggcaaaggtcatgaaatgtcactgcatagttatgctatgttatatgaaaaaagtaaagaggtcatatagatgtaattagggctgctaatcagttgattttaagttaacgaaaagggatattatgctggtgggcctgccctaatgagccccttaaaagaaagtctagaagtgagaaaagtaacagactctttctgctgctggctatgaagaaggaagctgccataacttctacagctacacagcaataaatccttccaacagcctgaggagcttagaagccgatccttccctaggtatgcctccagatgagaaaagagcccagtctacatcttgatttcacacttatgagactccaaacagatctcagctaagccatatctggactcttgactcacagaaactgtgagataacaaaaataaggtgttttaaactgccaagtttgtagtaatctgttacacaacaatagataacaaatacacttagatattaaaaagcagggcttatgaaagcatgaagcaagtgcttctggatgtactgaccaaaccttacctgcacttccatgctagttggctcctccaacagatgtagcagttgttgtttctcccgagatagctgttctacaagcctctcctgggcagccaggctctgattcagttcttcaattctcctgaagcaaaggaaaagtaaggacagtaattatgatcatgatactattattaccttattttttcagcccattccaaagatagcatggtctagtatagcaggtttttatccttttggatcattgaaccttttgacacatttgtttagaaaaccatgtattttctgcccagcccccaaatatatacacaaacaactttttgcttacattttcaccacgttcatggacctcctgaagttaatccatggatctttagaccataggaatttaactcttggaataagggcctagaattttttggtggtggtggtagtggctgttccattcaataaacggttcttggataactattttgtgtactcaatgcactctaccaagtactggaaatatgaagttggaaaagaaacaatcgctgttttgcaaaaatttaaattccaccagcatgtgtttgctagtgatttggagagtaagaagacatacagctacagtcacgtaccatatactgtttctgtcaacattatgtcatcatactgcatgtatgatgatggtccaataagattatactggagctgaaaaattcctatcacctagtaaagtcctagctgcagtaacatcatagtgcaatgtatttctcacttgtttgtggtgttgctggtgtaaagcaaacctactgcactggcagttgtatacaaatataacatatgtatagtatgtaatacttgataataaatgttactggtttatgtatttactatactttcattgtcgttttagagtgtactctttctacttattaaacaaaataactgtaaagtagcctcaggcaggtccctcaggagctattccagaagaaggcattgttatcataggagatgacagctccatgtgtgttattgtccctgaagaccttccagcggacaagatgtaaaggtggaagacagtgaagctgatgatcctgacactgtgtaggcctaggcttgtgtgtatgtttgtgtcttagtttgtaacaaaaaagtttaaaaagtaaaaaaaaaaaattaaaaatttaaaaacagaataaaccttttctagaataaggatataaggaaaatatttttatatgactacaaaatgtgttttaggccttcacattcatccacttcactactcactcgctaaatcacccacagcatgttccagtgctgcaagttccatttatggtcagtgccctaaacaggtgtactgtttgttatcttttatacagtatttttactgtatcttttctatgtttagatacacaaatggttaccattgtgttacaattgcctacagtattcagtacagtaatatgtcatacaggtttgtagcccagaagccataggctataccatatagcctaggtgtgcagtagcctatcccatcaaggtttgtgtaagtatgctctgtgatggccacacaatgaagaatgaaattgcctaaagatacatttctcagaacatatccctgtagtttgtgatgcatgattgtatataagcaaataatagtaatagaatataataaatgctaccagaatagaggcaccatatagtacattgagtgctgccatagagctataggatgaaagataaagaaataattcatttgacttgaaggagtatagcgatgctcaggagaagaaattttaaagattgagtggtttcagagtaaacagacaacctacagaatgggggaaaatatttgaaaactatgcattggacaaaggtccaatatccagcatctataagaaatgtaaacaaatatacaaaagaaaagcaaccccattaaaaagtgggcaaaggacataaacagacacttcaaaagacgtacctgcagccaacaagcatatgataaaaagctcaataacactgatcactagagaaatgcaatcaaaaccacatgtgataccatctcacaccagtcagaatgactatggttaaaaagtcaaaaaataacagacgttagtgaggttgcagagaaaaggaaacacttatacactgttggtgggagtgttaaattagttcaaccactgtagaaagcagtatggtgattcctcaaagaacaaaaagcagaactaccattcgacccagcaatcccatttctgggtatactcagaggaatataaatcattctaccatgaagacatatgcatgcaaatgttcactgcacactatttacaatagcaaagacttgggtggttttccaggctcagaaggaggagattgaacaaaggaacaaaggcatgaagacccagtgtacaatttgggaagagtcactggaacaaaggcccagggaagaggcaatggctggagaagagactgaaaattcagaccctcagactagggttaagttgtaaaatactgtgctgaggtatacaaactatgggttcaaataaacttattgatcatctatgtgctaggcatattctctgtttgtatatattggaacatgaaccttccaggtccttgaaaatctgctgggtactaaatgaaatgtttccagttgtgattctttttttttttgagatggagtcttgctctgtcgccagactggagtgcagtggcgcaatcttggctcactgcaacctccacctccctggttcaagcgattctcctgcctcagcctcccgagtagctgggactacaggcatgcgccaccatgcccaaccaatttttgtatttttagttgagatggggtttcaccatgttggccaggatggtcttaatctcgtgatccgcccgcctcggcctcccaaagtgctaggattacaggtgtgagccatgattcccaggagaaataacttttaaaacttaaaaacattgggctgggtatggtggctcatgcctgtaatccctgtaatcccagcactttgggaggctgaggcaggcggatcacctgaggtcaggagtttgagatcagcctgaccaacatagtgaaaccctgtctctactaaaaatacaaaaattagctgggcgtggtggtgcacgcctgtaatcccagctactcgggaggctgaggcaggaaaatcggttgaacctgggaggcagaggttgcagtgagccgagatcttgccactgtactccaccctgggcaacagagcgagactccatctcaaaacaaaagcaaaaacagaaacaaaaaattaaaaacattatacaaatgtaaactgcaatgatgacgagaaggaggaatgtggactccatatgaaattccctcatggtatctgcactagaacatctctacttttcttaaacctcaaactttgctcatctctttgacccttagtctccacagaggatctgttctcctactctccaaaattgttcaaggtcatctgatgagtggcctcaatttattttcagatgtgcatgtgctttacttggggttttgttttggtttttagttcagtttttttttattggggttcaaatatgacactgtcttggggaacctagtagggaaaatctgaaagcaaatacagtaccatactgagaattgtacaatatgtatatatataaaagaaacaatacagaaacttcattctgctatcacaaagccttcaaagaaatgacgattgatgccttagtgaggttcactagaagggaaaaagttggcagatgtttcccacagaaggaaaagcatgagcaaaattctggagacttgccatagcttcttatgcttctggaggcagtatggcttcagggtttggatgtcagcaatccctgaaaccatgtttcacaagtctccagatgccaattttttcattaataaagtataataattcatatctcatggggctgttaaacaagaacataaagtactcagctgtatggtaagagctcaacaaagcttagccatcattattattactagcctggcatgaatgaagttaaggaatggtggtgggtgatgagtgtgggagaaatcagaggttacatcataaaaggctttgatggtcacattaggagtatggatcttatctcctaaaggtattgcaaagcttcttaaatggctctgccatggtgcgattaaatttatgtcttggaaagatcacattggtcatggtatgcacatgtggtttttgcctattcagttaaaagctccttaaagctttttataccaccacagtcttatgcacctaagaggctaaattatttgccaatttgttgttgttgaattatctatttcagaactactctgaattattaggttgagattgaatgagaggagcaggactggaagtggagaggacatttagaaagtttcctcggtaatccagacagtagatggtggtgacctcaataattgcccagttaccttcaggacaaagtccaagttccttataatggtatacaaagctggcacaatcagacccctattctcaaaacagcttacctctcacttgtcttctcacttgctccagttatgtacaattatttaaagttcttgaaatattcctttccctgtgtcttccctccatagtttctccttctgcatagaatatttcctttccctatccactttctacctatttattctacctcctattcatccttcaaagctcagctcagatttcgcttcctctaggaaaacttcaatggcattatcttagtctttttgggctgctataacaaaacaccataaactgggaggattataaacaacggaaatgtatttctcacagttttggaggctgggaagtcctagatcaagtcactgacaggttcaatgtctggtgaaggttcacactctggctcataacggtgcattcccactatatcctcacatggtagaatgggctaactagctctctggggtctcttttacaagcgtattaatcccatttatgagggctccatctccaatgtctatgatttaatcacctcctaatggctccacctcatactacttctggaggcagaagtattaaccttaagggttaagatttcaacatataaactggtgggggagggaggtggggatgggacacaaacattcagaccacagcagacaacttgctcttttaatgtggaatggatgaccctccaatatttccccagagcaccccatgctcttctatcagggaacttattaaaatcatgtaacatgtttcttggtgacaagaattaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatggataccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcaccgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaatggggttatttgtttttcattgttcaattgttaaattccttatggattctggatattagacccttttcagatgctagttgcaaatttttttagattctacaggttgtctgtttactctgttgatagtttcttttgctgtgcaaaactctttagtttaaataaatccgacttgtctctttttgtttttgttgcaattgcttttgaggacttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgacaggaatagtgttgaatctgtagattaccttcggcaatatggccattttaatgatattgattcttccaatccatgagcatggaatgtttttccatttgtttgtgtcatctatgatttctttaagcagtgtttcatagttctccttgtagagatctttcacctccttggttagatgtattccaaggtatttttttttttttttagcagatattgtaaatgggattgcattcttgatttggctctcagcttgaatgttattggtgtgtagaaatgctactgattttttttttttgagacggagtctggctctgtcgcccaggctggagtgcagtggcatgatctcggctcactgcaagctccgcctcccgggttcacgccattctcctgcctcagcctcccaagtagctgggactacaggcgactgccaccacacccgcctaatttttttttttctatttttagaagagacggggttcaccgtgttagccaggatggtttcgatctcctgacctcgtgatccacccacctcggcctcccaaagtgctgggattacaggcgtgagccaccatgcctggtgaaatgctactgatttttgtacattaatttttgtattctgaaactttattgaagtctgaaaatatttttaataattttagtaatacttgtcatttaacactaagcttttaaaaaactgtaaattataaaagtaaccattttagcaatataaatgtatataaagaaaaatatcaagtcttctccctatcacggactgtgatctcactcttcctcagtatactataaatatcactcagcaacttttcccccttactttaatcaaggaattcccactaggacaataatatagagctaactcattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctcgggattgtttgatcaaaggaaatcctccttttttattataataggtagcatcccatactaaaaatgttgtcacaatttacactcactggtagtgtatgagagtgcccattttccccaaatgttatctcagctcttgatgttattataggctgactgatactttttgataaagcttatttgcatttgtctctactaaaagtggaaacattcactgtttcaatttagttgattgctgactgataggaagtttgcagtcttaggtctggtggatttaccaacttatgacaaggtccatctgacctagtaatagagaaagagcccaagggaaacacagcatatgaaaatctattgtttcagttcctgaatcagatacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcaatgttctgaaaaacacacaggcattaatcgttattaactgccacagacactctttcctggatccaggttcctatttgagtcttgccttggtccacagcctctcacctcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcctgaaaacgaaattgctggaataatacttttaatagaattatagtaatagaacaatacttttaaatgtctggggatttaattatttaaagaaatttggttgtaaacatttttaaaaacaatgcttttatcataaaattggaattttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtctggtgcaggttaagtggcttagtgtgtggtaaggagtatagaaaatagtttgcaactagtttgtgaaaatcctgctaagacaactagataggccggccacggtggctcacacctataatcccagcactttgggaggccaaggcaggcagatcactcgaggtcaggctttagagaccagcctaaccaacatggtgaaacctcatctctgctaaaaatacaaaaattagctgggcgtggtgacatgcgcctgtaatcccagctacttgggaggctgaaacaggagaatcgcttgaacccaggaggtggaggttgcagtcagccaagatcatgctgctgcactccagcctgggtgacagagagagactctgtctcaaaataaaaaaaattaaaaaagtaaaaaactggataataatcagtagaaatcaaagacttatcagggagctttaagcaaagtattggcatgatcgggtccatgttgaagaaggaattatgaagaaggtgggtgggtcaggggcaactaaccagaatagggagggggactgtctaaggacaagaggtacagggagaaagactcaaaagacatttcagagacagaagccacaggccttgatgacttgtgagattcagattagactggagggaggaccaaagacaatgctgaaatttccagcatgtcagtgggaatgcattctattaactaaaataggggcaggtttgtaggggaacctaaggaggtttctgcaaaatgttaattgagggattactttatttcagcttaaacgttagcatgcaaagatggattagtcccttccctgatgaagtccataatacagtattaggcaagaagaatgttatttagtaaagaagtctttagatcagaggttgacagagagactgaaggtaaagtagctaaagtatgaaaagtagtattgtgggtactagaacagtagggaggattttactttactatcgccatataataaccaccaacacctagacttctagaagtccaaggcaacatacaatagcagcatattttctaccatacttgtgaaggcatttcataacccatgtttccatgcagggtggtcgaaacacaaatactaattgggaaaagtagaaacctagtttagatatttgagagttacttagaattaaagaattttagagctggaaggcagttggactcaaggcattttagatcatattactagtatgtttttagtgacatactgagaagaatgtttgttcccctcataagtaggtaccttttgaccaaggttagaacatagattcagatccagtgagatgaaaatatcctaatttcttcaaaagaaggaatgatagccctgtcttttcaggatatactttaaagttattattttatgaacactaaatagcattaccagatttagcaaataaaaatataagatatctacttcaatttaaatttcagataaacaacaaataatttgtttcattagaagtatatcctttgcaatatttgagacataacttaaacgctaaaacattgtttgttgtttatctgaaatttaaattgaattgagtaccctgtattttattctgcaatacaaataccaaaagattaacaaatggaaacacgcatatttcaattttgtatgaagaacaagtctaagatctctatatcagttccatggcctggcactgcaagaataattcatctgtaccaattgatgaatcagtaaaatagaagatttgctaaacagttgctatgtccccagctttgtggtcaatacttaaaggaattcaaatgtcttcataaaaaatagtccctaagctagaggcccttcatagaggtgaaggaatatgcattcaattatgtgggaaatgcaaagagggagcaacttcctaatctgtaataggcagataattgtattttcctcattcataaacctacctgagaggatcgtgaggcataaataaatcaatacatgtaaaggacttaggacagtgtttctaacacaggtataactataattttaattataataatattattatcaccatcatcatcaagaacaacagcattatcatttggaacagcagtttgctttccatgagaccataatgtttcaagtggattcagtgttcaggatatggtgctgagaaagaggactcctaagtttattattatttctgccaccaattgattcacttctgtgaccttgggtaaaattctgctaaggcttctccacctggaaaatgacaaagagtgggcaaaaagctatttaaatctcatatgaaagaaaatggaatctataattatgaagtgttattatcaatgatattcctatgcctggctaatttatataaatcagaaaagtctggatatgctaaaccacctcagataagccaaaactgcttgagcagattttttaaaaatctcatatctaaaaatacgtgaggtctcaaatgactggagctatatggatgtcctctgcctagttcttagtctcatgatgtgacatagggaatctctatcaggtataaactgatcaacagaaagttccctgaaaagtcccttactattaatactatttttgcatgaggaatctttgaatattcaaataaaaataaacaaacaacagggaaagtgagaggcactatgaaaccaacctaaagccagaaagaattaggttcgaatcctggctctatcactttcctgctaggtgaccttgggcaggttaactaatcactatgagcctcagttttcttataagtatagtgtggttgctttgctttttaatgaagataagtattcacgagggattctgtgaggattgaatgagacaatgtgcatgataagcatagaacaatgccttgcacacagctgtgcaacaaccttgattcactttcccttcatgtccaggctgactagtgccagtcagagaccccagccttaccaggaaaaatacttagatctaaaaggaagaaaaacagaggacataaattagtacgttctatctgttctaaatcctactgaagaaaatgaagtcaatgctttgaccaatttggccaaagattcacagatttgaagacctcagcatttctgtgttctagttctcttagtttaaagacaaggaaattgaaatccagaagggttacctccaaggtaaaagccgtaactgaaaccaacactccactcttgctttagccttttatcagagagaccagcttagcaaacactgcccagttttgtctgattttgtagaatgtggtaaattatagaattagagaatgtgctgcatttagtcttgaaagaatatatggaggcagtaagtatagtggtcaagagcataggctctgaaggcgagaagggggcttgacaagtcacctgccctctctaagagcctcattcacctcatctatcaaggagataacaatgataccaatctacaaaggatgttagggagactaaatgaaattatgcacaaaaatcacatcgcacagtgcctggcatgcagtcagtattcagaaaatgataactattattaactataaaaacaataacaatttaccctctctaactaggatagctgaaatccagaagggttttcaaggtaaaagcaataatcttacatcaaagtctaaccttcttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgttcaaaaagcatttaatatgtgatgcaggtccagctaaagaagaaaaaggaaagaaagaaaaaaccttttaacgatttttaactgtacagcgattaaattatacacaactggcctgataatagagtctattcaaaatttgacctcaatctacctctccagctttatcttccattattatctgctagcctaactggatttcccaaacatgccctatgcttcttggtgccacatcattgtgtgcccttcagcttcatggttaaatgctccgtcccctgtgaagccttactttatctctccaaattaaaagtaatttctcatgatgacattatgagctttcaaatattcttttcatactgcaacattggcatcccgtgtaaatgcttcatatttctacacctgtcttatttacccttttaaattgcaaactccctaaggacagaggaaatgatggtgtggcagaactacccaggtgcgctggttattaagatactgcctctcagcgttgtcatgctggggcaggaatttcaggataagtaaacctaggttcacatacctttctgccacttcctaactgggggaccttttttgtgtaaattacttcaacttttacaacctaatttcctcatttataaaatagggtttgcaaaaattacctcaaagtttgtagtgaggaataaatgaatttatgtaaagtacccagcacaatgtctgatacaaataaccgcagctcgggcgcggtggctcacgcctgtaatcccagaactttgggaggccgaggcgggcagatcacgaggtcgggagatcgagaccatcctgcctaacacggtgaaaccccgtctctactaaaaatacaaaaaattagccgggagcggtggcgggctcctgtagtcccagctactcggaggctgaggcaggagaatggcgtgaacccgggaggcggagcttgcagtgagccgagatcgcgccactgcactccagcctgggcgacagagtaagactccgtctcaaaaacaacaacaacaaaaacaaataaccggcagctgtgactaatctgaggtctcgcagtgtctctcacctctttgtgcagtaaaagctttgaaagagtgaaccaacaagagaacaaagaaggaatagatgacaagaggcggaagtggactaacaatgatacgtttgttgaatgagtgagaaggtaatagataatgctgtgagattatgtggaaaactttttatctgaagtctttaaaagacattctcacttttggctgggcgcgggggctcacacctgtaattccagcactttgggaggctgaggcgggcggatcacttgaggtcaggagttccagaccagcctggacaaactggtgaaacgctgtctctactaaaaatacaaaaattagccaggcgtggtggtgggtgcctgtaatcccagctactcgggaggctaaggcaggataatcgcttgaacccaggaggcagaggttgcagtgggccgagattgtgccactgtactccagccggggtgacagagcgaaactccatctcgaaaaaataaaaaatgtactccagctggggtgacagagagaaactccacctcaaaaaaataaaaaataagggccgggcacggtggctcatgcctgtaatcccagcactttgggaggccgaggcgggcggatcacgaggtcaggaaatgagaccatcctggctaacacggtgaaaccccgtctctactaaaaatacaaaaaattagccgggtgtggtggcgggcacctgtagtcccagctactccggaggctgaggcaggagaacggtgtgaacccaggagtcggagcttgcaatgcgctgagatcgcgccactgcactccagcccgggtgacagagcgagactccatctcaaataagtagataaataaagactttctcaggtttttgttttgtttttgtttttttgacagtcttgctctgtcgcccaggctggagtacagtggcgcaatctcggctcactgcaagctctgcctcctgggttcatgccattctcctgcctcagtctccgagtagctgggactacaggcgcctgccaccacgcccggataatttttttgtattttttgtagagacagggtttcaccgtgttaggcagaatggtctcgatctcctgacctcgtgatccgcccgcctcggcctcccaaagtgttgggattacaggcgtgagccaccgcgcctggctgactttttcagttttaagctaagaatattctctaataggtatattattgacccattgacaatagaagattgaatacactttaggattccagcctcctcttctactgctcatgctctccgtaagaagggctaaacatcctactcctgtgcactacattggagctcagaaatactgacttaaaatctccagatcttaacacggacttttaaagggaagattgagtatggacccagtattagatggtattatggaattatttttaagctttttgggtacaataatagtattgtggttatgtttaaaaacaaagccttctctgtgagagttatattctgatatcttcccaaataaaattatatgatgtcagagagttgctgtaaggggtggaagaggacaagatggagaacgaacagtgcagggagatcactgaaaagaacagcaaaatgttgggaaccgttaaagctgagtgatgggaacatggctccctggtaaatgggacacatacatcgggaggtactattttcgtagtctttgtttatatttgaaaattttcaaacttacataatgagaagtcaaaaggggcattttcatcccaaaaaggtaaatgtccatattcttttttattttttcattttcatttctggaattacctaaactcaggtcatagatagcaatgaaaattcggctccctgtggcagcttctttcagccaccagacttacatagactcagtggtgcagagtccgtttcccaatactgagggataaagaaaattaagcctgcctctaggcacgtctcaaacttgggagactcagaatacaacagagtatgggatacagggaggaaagaagagatgcagaaataaattaaaaacaagatttgtttaaagaggaactgcaacttctttaattgggcagattgaaccaataaaagcacagttctctcccttcacctgttatcctttagtctcttcaactttcacattgcttcactcactctcttcctctccctttcacctgctcaccttacccaacttgaactgtgccctctgatctgacacaggatgacaatgacatcagtcattacctagcagccattttttctgataactagagttctgagtgatgatagttcatggtgagataatttccaagacctcgctagccattggtggtactactctccattaaagacaagggcatttgctgattgagaaatcaatcatacaagtgtccttggaggccaccaaggctttgcctgaactgttctcagcctatgatggtttctctttctaaacctgttcttctaggttcagctcaaacatcctctcctatagaaacctttccccatcctcccagtcagaactaatgatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcgagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccatctcaaataaataaataaataaataaaaaccaaaaaaaaaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaatcagagttgtgttaaggtcagtgagtgaaggaaatgggtactgcacctttgcaagatagtaggaagcaagccagagaagagctggcattccacaaaagagtctttatttgggacaaaaatcaatatgaccaaatcccatcctaatcaattctgtaaactaaaggaatttttaaaaaataatttagcaggaggaagagtttcaaaatcttgtagggaaaccctgatgtaactcctgattattcacccaaagtgaaaagtaactattagtgaatgggttttattttaaaacctttcatttttagaatcttatctcttctaggaaaagtgtagtacatacgaattttttgtatgcagagtgaatttttctccaggcttctctgacatcaatggggcaaggtcataactctataaaacagggagaagcactgagcattttcagaaaggactctatctgtcttgaccaaaagacaaaggactggtcattgcaggatccccagaaatacattttagtagtttccaagtgaattcttttgtaaatggagtttctctccattcataagttttagagcaaaaatgaagccttagtgggtctagatatctggctaacattaactccctgtgtgaccttaaactggtcgtccccaaagctttatgcttttatacaattaacttgatttacagcctctccttcttgcccataagaatgataataccacctgcattactcatcttttacgcttatgtgagacacctagccacctatcagaaggtattcaaatgcaaagcattaagtttttacactttaatgtgaagtggaagaaagtcttgattcaaatgcacaatctctacctttctactgattccacatttgctgtcttttactagtgcagttaagtcccaaattagaaacataagtcgccccaacatgtgacaaatgtcctttgttgccagagaaaggacagtggggctgtgtcctcagccttagcaaccagaagattctgcaagaccaggacattctcctgccagagcctgctttagtgtccagtcctgttctccaaagagatggaaaaaaccaagtggaaaagtttcagtttattcaatataaggctccacattcaaatggcaaaactgctctgttcaggtcatatttcaagcccaacctatgtcagtccttagtaaaagcttcaaagcaataccagtcctttcccagcctggtttaccttgattagacaaacacagacacccatgtctgagtaagcactgagaccatggatgagtgctaaggagattaggtgtttggatagacacagctagggtgtgtgcgtgtgtgtgtgtgtgtgtgtgtgtgtgtgtgtgtagagagagagagacagaggcaaagacagagacagtgctcattgggcagaggacagagtagctgagatagtatcatttgtttattcatttgctttttcataaaatacttagtaagcacctacttggtatgtgccaacactttaataggtactagaaagagcaaaacagacagaatcacagtcttcagagaatttacagcctatggggttaattaaaccaatgattatcatagcatgtaacaaacaaaagagaaccgagaatcagctgtatggaaatgcacacaggtggcagatataaatagcagcagatacacgaatcagtgcgggtccatcatataactcctagctttagtctctaaacttaggctcccactcaactcaactcctactctaactcaagatataccataccttggtttgctctttctctaagcatcgctgttctagtcttctaaggagcaggaatataaatctacatctatgtgaaactacagcacccccaagggaaaataaagaatccagtgctattctagtaattttagggcagtagtacagtacaatgcaaagtataggcttttgaactaaattggcctgggttcaaatatgagccctctcacattctattaggttgaaccatataaaaatggagatattcaatcatttttttacagtttcacgtagttcatctctgtattctagaggtaaatcattttaacctaagtttcatttccttctgttgttagtttttttaatggtgctaatacccctacctttcagggttgtaaatgaaaagatgttaaaaaaaaatacctgacatatagtgggtgttcaataaatgttagttttcccaaagatagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgacaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatagaatcttggtcgtgtcccagaggcctctgttgatgtggcccaactgagctggccagtgagaaaacatacacataaatacccatgatctcagcgattctctcccctccccaggacattccttagcagaaccaatctctctcactcggctggagcctctctgttcacagataggcctggctgggcttaatttagcaaagggcaggccccctgcaaaagccaggggtaagtctggagcccctgtaatgccccaggacaccttgtgtggagacaggagcccagccctgccgaaggagctaaaggggatgttcagaatgtttgtttttctcagctatttaggaactggagctcacaggaaccaccctttacttccttaacttctcacataaatgttttctttgggcagcagctatagaactggaaactaagtaaaaccttactttggaatataaaaactatattaatttttctatagataaattgttgcataggaaacttgctaaatatttttaaattatctgtaacatctaacataatctgacatttatccccaaattcagctttcaattctggattgaaacatactttgatctgttctctaaaaaggacaaagccagtcactggtgttttgcaaagtctgggaccatttttcctacacagaatctcacacaataaacagacaagatattagaaactaagttctaatatctagcagtcactccttccctggaagcctggctgtgtcctgaagccaggtcctatgatcaggcaactcttctgaagctctgcttccactagagacagcacttaccctgtagactctacagatgtaccatccaggatggcaggcatgagccacatgtggctactgaacccttgagatgtgactagtccaaatcgaaatgtgctgtaaggatttcagacttagcacgcacaggagttcaaagactaactacaacaaaagaatgtgacatctcattaataattttaaaatgttgatttcatgttgaaatgataatgttttaaatgtattattaacattaatttcacatatttctttttactttttttaatgtggccatcagaaaaatttaaattacatgtatggcttatatttacgttggacagcactgttctataagatgttaggaaaaagatgtatttgctttaagtactttgcattaagacatagtctgacctgaatcacagttaatcctgtggtctcatagcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccactgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacgaggtcaggagttcgagaccagcttggtcaacatggtgaaaccccgtctctactaaagatacaaaaaaattagccaggtgtggtggtgtgtgcctgtaatcccagctacttgggaggctgaggcaggaggatcgcttgaacccaggaggcagaggttgtagtgagccgagattgcaccactgcactccagcctgggcaacagggacatactctgtctcaaacaaacaaacaaacaaacaaacaaacaaaaaaaccagaagaaagcactggcagtctcttaccgccatatcaatccatctacacatctcgggttacattctctgtctttccacttataaccatagatcaactatccatgctcctatctaaagccaaaccttccacttatgtattaattaagtcctattccccctacctctcaaaggcaacacctagaaggtctcccctgcttctctttatcaatatttcactttctaatggaaaattctgttggcatacgaacatgctattattcatttatctttctagaaatcccctatggacctcatacccttatcaggtatgccccattcctttgctctcctttgaaacaaaactcaaagtaattattcatcctcattgactccaattcttctcctcacattgtttcttaaacccactgcaagcaggcttttgtcttcaccactccaccagaattactttaatcaagatcactaatgacatccatgttgttaaatccaaaggtcaattcttttttgagacagagtcttgctctgttgcccaggctggagtgcagtggtgcaatctcggctcactgcaacctccgcctcccgggttcaagtgattctcttgcctcagcctcctgagtagctgggattacaggcatgcgccaccatgtccagctaatttttgtattttcagtagagaccgggtttcaccatgttggtcaggctggtctcaaactcctgacctcaagtgattggcccaccttggcctcccaaagtgctgggattacaggcgtgagccaccacgtctggcgggccaaaggtcaattcttaatcatcgtattactcaagctctcagcaggatttcaaaaggtggatcctgtcctcttcactacacacattcttcatttggcttccgggactccagactttttctcctacttcactggtttgtaccttctctatcttccttttctgattcttcctcttttctccaaattactaatgttggagctatacaggaccagtctctggtccttttctcttccacctggaaaggtctaactccaactcctttggtcatctcctatggtttcatggctttaaatatttaaatttaatatttaatgatctatttgctgataactcccaaatttatgtctctagccctactctatttcctgaactttagacttacgtattcaactgcttacttaatactgccacataaaatgtctagcaaatagcttacacaccaaatttccaaaactgaacccctactctccaccttcaaatctgctccatccgtagccttccctatctcagttatggcaactccatccttccagttgcttactccaaaaaccctggaattttccttgattcctttatttctctcccattctgtatccaatccattggcaaaatccttttagatttgctaccttcaccacttgttcccacatgcatcactattacctaagtctgatcactatcagcccctacatacattactgcagtgtcttcctaagagtcctcctggtgtctacttttgttctacagcctatttgcaatactgtaaccagatttatcatttcaacaagtcagacaggactggcatttgttagacccctcctctgctcaaaacccttcaataggttcccatgtcactctgagtaaaagctgaagtctttaaaatcatctacagggacttactacacaagccccataccctctggggcctcatcttccagcatgcttaatcttgattatgctgcatcagccacagtggctttcctgatgtttctctgcctggaatattcttcccccagttctctgtttggccaacttcgtcatctccttcaagttgctatttgaaaattattttctatggcatagccactttgaaaaatagttagacagtatctattcagaaaataggcagaaataccgactgggcatccctaatctaaaaattcaaaatccagcatgttccaaaatccaaaactttttgaggaccaacatgatacctcaggtggaaagctccatacctgacctcatgaaaggttgcagcaaaaatgcaggcacaacacccagtttattcagcatccccaagagaaaaacataattaccttcaggctatgtgtacaaggtgtatatgaaacataaataaatttcatgtttagacttgggtcccatccccaagatatctcattatgtatatgcaaatatttcaaaatctgaacacatctgaaaatcttctggttcaagcatttcagataagagatatttaatctatatatacttattatataacctaacagttccactactgggcatttacccaaaagaaataaaacaaagacttgttacatgaatattcatagcagcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttgaaacacgtggcaccagtaggacatatggaaacttttttggtgtgatggaagtatttttttatcttgattgtgtggtgtttgttatacagtggtatacatttgttaaaatttatctaactgcatacttaataaagtttatttaaacaaaacatgaaaggaaaaactaaaatgacatagcaagtggcaatgcaaactgccaagtgcaaagaatgagtaaagagcttggttggcatggagactaccagtctaggatgcttttattgcctcaggtcagcttggaaggccataaatgctgtgaaggtaaacctagaaacaaatcttcctgcactggtaactgtcatgtttatttgcttccctttccatcccatcctttcaaaaaaaaaaagtaaaaggtagtgtggtccacaaactaccgtgtggctccccatgatccccgcctcttggtgtttgtgcccttgtgtaactccttctctttgggtatgagcaggccctgcgacttatttctaaccaatagaatatggcaaaggtgaaggaatgtcactcctgtgattatattaaatttcaaggctctcttgcttgcagatttgctctagagcctctccttgctgacttgaagtggccatatggggaaagctcacatggcaaggaacactaggtgacttcaaggaaccctggacagcctctagccaacctctggcaagaagtcaaggccctcagtcctactgctacaaagaaatggattctgttgacagcccaagtgagctctgagtcagattcctcagtcaagcctctagaggagaatgcagcctggccaataccttggctgtagcctagggagaccctaagcagacaacccagctaagcggtgcctggattcctgacccacacacactgtgagataataaatgtgttggggggtgaaggagggatgggggtaggggtggctgtgcatttgggtatggaagggtgttttaaatcgctttctaaacacggcctctcctggccactccttaatactgcaacctgctctccactcctgtaattttttttcaacatttgttttaggttcagggggtacatgtgcaggtttgttacatgggtaacttgcatgttgcggaggtttggtgtatgaatgaacccatcacgcaggtagtaagtatagtacccaatagttagcttttcaaccctcgccccccttctaccttccactggggtaggccccagtgcttattgttcccatctttgtgtccatgtctcaaagttttgctctcacttataagtgagaacatgcagtatttggttttctgtgcctgtgttaattagcttaggataatggcctccagctgcatctcttttgctgcagaagacatgatttcattcttttaatggatgcatagtattccgtgctttatatgtaccgtatttttcctccccagtctactgttgatgtgtatctaggttgattccatgcctttgctattgtggatagtgctgcagtgaacatgtaagtgcatgtgtctttttggtagaacaatttattttcctttgggtatatatccagtaatgggattgctgggtcaaatggtagttctcttttaaattctttgagaaatcaccaaactgctttccgcagtgactgaactaatttacattctcaccaacagcgtataagcacttttctctacaaccttgccaacaccttattttttgtttttcacagtaggcattctgactggtgtgcaatggtgtctcattgtggttttgacttgcatttctctaatgatcagtgatattgagcatgagaattttttcaaatatttgttggccccatgtatgtcttccgttcatgtcctttgcccattttttagttgggacaaggtctcgatctgttgcccaggagtgcagtctgatcactggagttcagtgatgcaaacacagctcactgcagccttgacctcctaggctctagcaatccttccaccactgcctcccaaagtgctggagtttcagatttgagccaccacacctttgctcatttttgaagtggggcaagacccccacttcgtaggactattacttgattgagattaaatatgtgtaaaatgcataacatggtgcctggcttatagtaaacactaaatggatttcttcttccataggatttaaatagggagcaattttttttctatcaagagctgatcagaaataaatgggaagcatttaaatgctctccttcccctgtcccaagaggactttcactttccaacattctacatactttatttataatatttattgtttattttctgtctactcatgacagactataagttctatgaggatgggaatgcctgtatgtgcttattatatgacctaacagttccactactgggtatttacccgaaagaaataaaacaaagacttatacatgaatatattgatatatactccagtcacctccaatagaatctagaacacagtaggggcttagtacatatttttaaatgaatgaagactaatgtttagtttaaactaggattgacctattcttatcttcggcagagacagagaataactaattaccacttgtcacatattgagacttcagtacctaaaaggcattattaggtcacctgtaagtctgttttcccccaaagtaaaaatcccaattccattgcccttttcacataagcctcattttctaacctttttagtttggtttaacgaatttcctatttcctctgaattctggagttccaaaccagactcagcacaagcctaacagggcaacctatacagataaggacagcccaggcacattgcacacggcaagttgcacctgttttaagagtaaaaatgaggtcaatgccaccttgtactgcaggtacctcaatgagacaatgccaccccttcctgccacaatcttggcaaaagtcactacgaaagtaaatatcattttactagagtcctttctttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaaaatgcataacatggtgcctggcacacagtaaacacaaaacagatttcttcctctatagcatttaaatgggaagtatttagcgtttacttgccatgtgcatgagtgaatttgggaaaagtggggggaggatatggggcaaagaaggacagaaagggcctaagagtaggaagaatttaataccagaagatgggacaagacctgggtctagaaacctcttctgcagataaagtagctgcaaattatagggaaggagtcctcaggctgctttccttataaccatttattttcctgcaccttatatcaagaacgttaggcactggttaagaccctgtccccttgcagcagtagagaaaacaggaggaaggagacgggaggtagaaatttggaagctagcagttgaaggccaactcagaaagcgtcaggtggaattccattcctaattgacatcaccatcctctaactgcagcaattctctccagcccttttatgtgctccctacagaaccaagcttccacacagctgaaggaacctgtctgctctcaccccagcttcacagaagatggcagggactggttattactaacctgcctcctagtcttctgaggctccaaatggttttgtcagcaagctgagcttccccacaatcccacagactagaaggggttggaaagaacaagccttagaacaatactgctccccacctctaagggatctgctcctctgagtcccagaagttcaccgccttcatttgatttctgctacaggaagactctgggaatccagctctggacccagcacttcctgatttttgaagtagagagttgacaaccctgttgtcatcaatacaactgtgctaggtgggtgggaaaggaaaatatcttgggctcccaaaatcactaagctaaaaggaaaactcaggatcatggtggatggaagtcaggactagattgcagctccgactcggatggacagagaagcatgtggaggctcatatcatgaatttttgctccagaacgactggaggaataaattacaaaacctgagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagctcgaacacaaagtcttcaatttgacccaatccaaccaagacaaagaaaaacaaataagaaaatatgaacaaagcctccaaaaactctgggattatgttaaatgaccaaacctaagaataattggcattgctgaggaagaagagaaatctaaaagtttgaaaaacatatttgggggaataattgaggaaaatttccccaaccttgctagagacctaaacaaatacaagaagcacaaagaacacctgggaaatttattgcaaagagatcgtcacctaggcacattgtcatcaggttatctaaagttaagacaaaagaaagaatcttaagagctgtgagacaaaagaacccagtaacctatgaaggaaaacctgtcagattaacagcagatttctcagcaggaatcctacaagccagaagggattgggcccctatcttcagcatcctaaaacaaaacaattattagccgagaattttgtatccagtgaaactaagcttcatatacgaagagaagatacagtatttttcagacaaacaaatgctgagagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacagaattgcagaatggataagaattaaccgaccaactatctgctgcctttaagagactcacctaacacataagagacttatctgacacataaggactcacataaacttaaggtaaaggggtggaaaaaagacatttcatgcaaatggacaccaaaagcaaaagcaagcagaagtaactattgtttttttgttttttttggtttttttgagatggagtttcactcttgtagtccaggctggagtgcaatggcgcgatcttggcacactgcaacctccgcctcccaggttcaagcaattctcctgtgtcagcttcccaagtagctggaactacaggtgtgcaccaccatgcccagctaatttttgtatttttagtacagataggtttagtacaggcaggggtgatccgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaggccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaacacatatatacagaacattccatccaacaactgcagaatatacattctattcaacagtgcatggaactttctccaagatagaccacatggtaggccacaaaacaagccgcaataaatttaagaaaattgaaattttatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaagggaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccgggcgtggtggctcacgtctgtaatcccagcactttgggaggccaaggtgggcggatcacaaggtcaggagatcaagaccattctggctaacatggtgaagccccgtctctactaaaaatacaaaaaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttataggtgggaattgaacaatgagaacacatggacacaggaaggggaacatcacactctagggactgttgtggggtggggggaggggggagggatagcattaggagatatacctaatgctaaatgacgagataatgggtgcagcacaccagcatggcacatgtatacatatgtagctaacctgcacgttgtgcacatgtaccctaaaacttaaagtataataataataaaataaaataaataaaaaataaaaaataaaaataaaaatacaaaaaattagccggacgccatggtgggcacctgtagtcccagctactcgggaggctgaggcaggagaatggcatgaacccgggaggcggagcttgtagtgagccgagatcgcaccactgcactccagcctaggcgacagagcaagactccatctcaaaaaaaaaaaaaaaaaaaaacctagaagagatggataaattcctggaaagatacaaccctcctagcttaaatcaggaagaattagatactctgaacagaccaataacaagcaacaagattgaaatgctaatttaaacattaccaacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccatgatcaagtgggtttcataccagggatgcagggaggtttaacatacgcaagtcaataaatgtggtacaccacataaacaaaattaaaaacaaaaatcaccatgatcatctcaatagatgcagaaaaagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacacgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcacgaccaagaacccaaaagcaaatgcaataaaaacaaagacaaacagctgggacttaattaaactaaagagcttttgcacggcaaaaggaacagtcagcagagtaaacagacaacccacagagtgggagaaaatcttcacagtctgtacatctgacaaaggactaacatccagaatctacaacaaactcaaacaaatcagcaagaaaaaaacaaacaatcccatcataaagtgggctaaggatatgaatagacagttctcaaaagaagatatacaaatggccaacaaacatatgaaaaaaggctcaacatcgctaataatcagggaaatgcaaatcaaaaccacaatgtgataccaccttactcctgcaagaatggccataatcaaaaaaataaaaaaatagtagatatggatgtggatgcagtgaacagggaacacttctacactgcttgtgggaatgtaaactagtacagccactatggaaaacaatgtggagattccttaaaaaactaaaagtagaactaccatttgatccagcaatcccactacagggtatctacctagaggaaaagaagtcattatacaaaaaagatacttgaacacgcatacgtatagcagcacagttcacaactgcaaaaacgtggaaccaacccaagtgcccaccaatcaatgagtggataaagaaactgtggtgtgtatatacacacatatatatatatatatgatggatatatatatatatatatatgatagaatactactcagccaataaaaggaataaattaacgcattcacaatgatctggatgagattggagactatcattctaagtgaagtaaggcaggaaaggaaaaccaaacattgtatgttctcactcataagtgggagctaagctataaggatacaaaggcataagaatgacacagtggactttggggactcaaggggaaagggggggaagtgggtgagggataaaagatcacaaatagggtgcagtatatactgcttgggtgatgggtgcaccaaaatctcacaaatcaccactaaagaaattactcatgtaaccaaacaccatctattccccaataacctatggaaatgaaaatacaaaaaataaaaggaaaactcaagctggaaactgtttagggcaaacctgcctcccattctattcaaagttatctctctgctcactgagataaatgcatatctgattgcctcctttggaaaggctaattagaaactcaaaagaatgcaaccttttgtctctcttctgtgacctagaagccgcctcccccactgcaagttttcctgcctttgcttcaagttgtcccgcctttccagacctaaccaatgtacttcttacatacattgattgatgtctcatgtctccctagaatgtacaaaaccaagctgtgccccaaacaccttggtcacatgtcataaagacttcctgaggctatgccaggggcacgtgtcctcaaccttggcaaaataaactttctaaatttactgagacctgtctcaaattttcggagttcacagtgggcaagactagatttacttttgtgttgagcagatactgagcttgactgatgagaatctggagtgtgaggtctgacggagtaactctgagagaggaagctacctgtgtggtctcagggagaagatctgagacttaccaagaaaaagtgacctgaaagaactggctgacttcaggcccttgaccagtgcctagaccctctttctgcagctccagatcatagccatcatgctggcagcctccctgccgctcatccaggcaccttaaagaagggcttcctcttcccaagcctctgggtgggctttctaaagccctgtgtgcatgaagaggtggcttgtagccctttgcagcagcagggcttacatgaggctgggatatgaaaagctggcattacaatgcagcttgtgccttgcattcactccccacttcatcaagccaagtttctaaataacagggatagtaactgcccactgtggcccaatgtcacttctaaagttgcttggcaaaaagccacatgactattacttagctctccacagaacggcatgtaccaagtcggatcactgctgtcggtgtgtgggtggattagctgctattgaacatgatagggcgggcccctttccagtttgcaccagccccgctctgtgcctactccatgtatcatagagcctcctctctctgtgcagttgaacttgatcagatgagatggcaaaagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtgaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttaggcaaattactattctgagctttagtcatcttatctttaaaatgaagggtttattctttagaggaagctgagtgaatggcatacgggaacactctgtactatttttataactttgctataagtctaaaattatttttaaataaatggttttcttaaaaagtgaaaggattatgtagattatcttcaagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcctacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacaggacttcagaactgggagggatgtgtgcgtcaatcctggtccagcccactcatttaaacacaaagaaccagaagcccagaaaaagtgacttgccttagcctggccttcctcttgattcctttccctcaattctcccgtcctgatcaatcatcaagtcctacaaatattttacctcttaaatattttaaagatgagttgcctcccctctattcctactgccacagccctcattcgggccttcatcttctttggcttggcaagtctgttctcactcacttcctgccttgactctcttgaatccacctttcccatgcatcagagggatctagcaggttccctgcagcttaaagcccatcagtggtgccttgtcttcttcaggataaagtctacactctttaaaatggcacaaaagactgtgtccgtcatatcagtctcattcttcgcctagtacttaaatccaccaacaccaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagttgccttacactttgtacacagctctgttactgccttttactatactctagcacctgtggtttactcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatactgaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaggagattgagaccagcctggctaacgtggtgaaaacccgtctctactaaaaatatgaaaaattagcgtatgtttcacagcatctgtaatcccagctactcaggaggctggggcaggagaatcgcttgaacctgggaggtggagattgcagcaagccaagatggcgccactgcactccagcctgggccacaaagtgagactccatctcaaaaaaaaaaaaaaaagaagaaaaaagaaatgccttttcccatttcttgttatgttactaccttttaggattcaatgcaaacttcaaacacttggcaaggcctttcctggtggattttattgcactatagcaaaatctgtccatacctctatggtagcccttattataccatttttatttatttgttgatgtcttctccaccagaatctagcacagtagctggcatatagtagataatcaatagacgtttgactgaatataccaatgcatatgcgcaaatatgagcaaaaaaatgactaaaatgatattgcaaacaagggaaacatttgagacagaaatttagaatgtctatttttttcaagtgtaacatgctacttctatcagtgcataaacctgaatgtacatacactatagaaagaagtggccttgtaataagttcatgcagaagtataaattatgtagacattgttagggggataactgaaagtggattagaattaaattagggcccagaatttagtctgggatttgttttccagtggttgaaagaaaaattcctaagtattcaaagggaagaagcatttctcaacaggcaagtattatgaattctaattaaaagctctgaaaaaatgagataagttgtgttaaggaaaagcagaaaacagagttgcctttggttaagagttccactatttttataagcaactgacttttttggggaaagttgctttaagcatttttttttctgtgtgtatgtgtgagatggggtctcactctgtcacccaggctagaatgcaggagcacaatcatggctcactgcagcctcaaccttctgggctcaagcaatcctcccacctcagcctcccaagtagctggtaccacagccacacaccactatgtcagctaattaaaaaaaaaaaaatttacagagatgcagtcttgctatgtttcccaggctggtctcaaactcctgggctcaagtgatcctcccaccttggccttgcgaagtgctgggattactgacatgcgccaacatgccaggcctaaacattttgtgtgtgtgtgttaaaatatacatataataaaatttgccattttaactattttaaagtatatagttctatggcattaagtacattcacatagttgttcaaatatcactatccatctccagaactttttcccaaatgaaactgtagccactaactccccattccctcctccccacaacccctggcaaccatagttccactttctgtcttcattatttgactactctaggtacttcatttaagtgaaataataaatatttgtcctttagggactgactttacttagcatgacatctttaaggttcactcatgttacagcacatgtcagagtttcatacctttctaaggctaaataatatccagtgtctatatagcccacattttgtttatccactcatttgtcaatgaacacttgagttgcttccacctgttggctactgtaaacaatgctcctatgaacacagaaatacaaatatctatttgagttcctgttttcatttattttgtgttatacccagagtagaattgctggattatacggtaagtctatgtttaattttttgagaaactccatactggttttcacagcacctgcaccatttcacattctttctagcaatgtgcaagggttccaatttctccacatctttactagtatttgttattttctgggttgtttgatttttagtataatagccatcctaatgagtgtgaagtttgaaaaaatatttaaccaaaatcataaatattggttacaaatatttaatggatggattccctctatttctgccaactttcattccctgaaagaagaaataggtaagcatgacctcacgaacctcagaaggctgagaatggggaattggcacacacagtgtgcgtagacacagacacacatggaccatgttcatactaggcttccagagaaccatttaaaaatagtttggctaatgtaatcttgtctgtctcttatgttcctcctttcccatcatacacatttcttaaagttcgtgtaagtaaaacataggagaaaaaaacatagccactaattaaataaggcatccaagtgtaaaagaagagcaaactctgctacatataagaagacaagcattaattctggcaacagcagccacacagccactttagacaataacctgagcaggtgcatgctttctagtatgtgtctccagctatgcaggatagaaatcacaatcctttctatttatctaacgtctaatacactaaaacatgtttacccatgggggagaagagcacgacaggaattgatgactctaatttaggaaactaaggttcacagaagttaagtgacttggccaagatcatgtagctagaaaaggcaggttaagaattcaggtttccttagagttcaaaacttttatcacaacatttttgataaccccccaagatactcatccttctctaatagccttcctttggttcaagtccagcttcctaaatcctaccgcctgatggagttcctgagcttccttgtaagtctgcaggtatattgttcctcatcatgttgcccaaagcctaaagaaatcaggctaggaccaaagaaaatcagtcaatgagccaaaaagaaatttaatcaacccagcctttcttatttattttctttgaatgaacatttgtatctgagaatgccaaggtaaatttgatgcaatagggacacttggattatattatgttatttacacacaagcaaacaaaaattgagaattgagacaaataggacaaatggtcccaagtccactattgaggaaaaagaaactgatttggaataaaaaatagtccagcatgaatgtgtcagtaattaagacttatctggataagtttgccgtctctcaatttgtcacaataatggcaaatatttattgagagcttactatgtgataggcattatgctgagttcagctaattgactcatttcatcctcctctagaccctataagataggtgttattactgcccttgctttagctcagagaaattatggtatttttcccaacacaaatagtaagtagaaaaatcaagatttcaccccaggtctcgccaatttatagctcttagccgttatgcccagcaataacagaatagtaaaaacaaggacaatttggtaggcaagtaaaatcagtaggctgtttaccatagctatagaagtatgctatgcataaacctcaaagattgcgcaggaaaagtatcatccaatctcaaagatgagaaaaccaaagaagtttcaatctcagagaagtcaggcagcttaagggtcataaaacaacgcaacacaactctctcaactcatatctaagggctaagtccactttaaccttccaatatcattacatcatatttaaacattgactctatctggtcaaggacgacaacattttatttctcctgacccttttgctatcagatctggccttgtcagtttttcaatttcattcttagaatggaaacttaattcacacaagttgaacaagtagtcatcagggggcaaaacccagtggatgatggttttgtgtgctgtttggagactgggtgtttaccacacagcagtggatttcataaattccagggtcagacaagattccagtagcgacacacttgactaatatgagaaaatgcaggattaggcaatcaacaatgaggaagtcagccaagttgccacccaaaaattacttaccacagcagctgcagtccagaaatgctaacaagccagtctccctaggagtgggccatactcagctgtggaccactcacaacattttctcactttattttgcttcagagtcagtgtactgcaatgatttctcctttgcttgctttatatgtttaaaattgtcttccctaaaagctgaacttaaaattaatgtttgctaccaaaagggggtagcagtgcctagtcatgtaggcatatgtcccactctgtcggtacagagggtaagcagcctcttcctttttaaaaaatttattacgatgatttacaaaaattgaagcttacaggataaacactcaacaaaaaagtagccagtctcaagaaaccaatttttatgtatgaattaatattattttattaatccatggccaggatgattcttaagattatttcttaattctctgaacagcttaaaagagagaaactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaaagagaaagatagcacccactctccagttctcttctcccaaagttgcccgtatttcccttccctgaagccaatcaaatactttattgtttctcgctaagagtaatttttcactcttaagtacaaacagctcaacaaaaattcccggtagcataaatatgcacatcaataaaataattactactcacaatagactttccattacatatgtttcacaagcattggttttcttaaaaagaaccacgcatacagcactcaaattattgcagattctaactcagtagagtttgatttaatgtttttacaatattttttttaaagaagtgtccttccaacgctaaggaaaaaaatcagaatcaagaaaattctgtttcttagcaacagaaaaatcaaacttctgttactaagtttggtaacagaacagtactctaaattatcctctgaaccacctgatttaccatgtgatgctgggcacattgctgctaattaatcttcctaatctcgtgggatcacaatatgaataacaagaatgaacatcagacacatctgtgggaattatgagggggagattataaagagtcaaaccttgtccccatatttaaattttataataactataactactagtagaaatataactactaccctctcatatatatgtgatgttattaagtttataaagtgttttgatatgtttcttatttcatcttcatggctgctatttattcatagaaaaataattctcagtatctgtagcattattgttaatgtcaatcctatagaggctggaacaggctcagagaggctaagtaacttgcctaactaagtctcctggttgacaataggtcttaatgcagtgttttccgaatccctcgttcttacatcaaaacagaactgtggctgggtgtggtggctcatgcctgtaatcccagcaatttaggaggccaaggtgggaagatcacttgagcccaggaatttgagaccagcctgggcaacatagtgagtgagacctcaatctctgccaaaaaaaaaaaaaaaaaaatacatacacacacacacacacacacacacacacacacagacacacacatatatatataaataattagccaggtgtggtggcacacctgtggtcccagctacttgggaggctggggtgggaggatcatttgagcccaggaggtcaaggctgcagtgagtcgtgacggtgccactgcactctagcctgggtgacagagcgagaccctgtctcaaaaaataaaataaaccagaacggctctagttcctatcaatcactcatcatgacatagtgtggtaaactaatttcaactctgaatgattgataatggctttatgtgttctgtttcccaagtaataagaacattttagcacaagcctttagcgcttttcaaataatcatagccaaatgagaaaattaatatgacaggcagattgaacaaacatttggtgagaaggaagaggaggggatacagtagtttgagatccctcaaatcatatgatgcagtagctgcctgacaactctgctaacacgtaagactagatagagacagggccatatctacttcctgtatgggacccatggcaatactagagtctagcaaaagggttgtcctctctgcatgtgacaataggctgtgttccactccccccacatacaccttgtgcagctcctataatctcatttatcacacttctccaggtgagaaatggtgccttctcacaccccacccaaagttgtttcctaaagatctttcgctagggcggagcagagagtgagatcaaatgattcagacagccatctgattcagctttaaaaaaaaaaaatcctggtgggggcgcagtggctcacgcctgtaatcccagtactttgggaggctgaggcgggtggatcgcctgaggtcaggagtttgagaccagcctggccaacatggtaaaaccccgcctctattaaaaatacaaaaattagccaggtgtggtagcaggcgtctgtagtcccagctactccggagaatcgcttgaacccaggaggcggaggttgcagtgagctgagatcgtgccactgcactctagcctgggcgacagagtgagactctgtctcagaacaacaacaacaacaacaaaatcctttccctcaaattacctaagaaattgtcctttccttctttgccctgaagacagttaatggggaaagttcctccctctgcacagtgaataaatccatccactattcctaccctaaccctaaggcaaaacctcccactcatcctctgtctctcgccatctctctgttaccaaccctcacttggcaatatccttcttgacacgtggcagctccaatgaggcacactcattacatagccacgtaaaagataaaaggtgaatctggaccaacttctggaaaatttggacttaaaacatggaaatgcaggagagacaggaaatagagttaaatcccccagatttagctatacacattaattgaattaactaaataatcatttgggtctcatagacaccagctatttccctgatccaagatgttatctagcagcctgtatcgcttcccagtcatccatcctcttgacaggacagagcacacatagaaaatggtatttgtatagtcctctggggtaaacagttggagagttagaatctctgataaggtcagaggcaaccagtccccggtcacttgggccacttcaggtcctgcttgtccagacacagagagggctgaggaaaccaatattgtggtgaccagctacgaggcttaatcctcataacccatagcccaatgtcctcttatcaaggtgctgtcctatctcacccacagctcagccaatccagtaggtcttccttccccaccctgatcactgacccatcaatcaagatagccctcccatccaaggaagaggccatttcccctcccactccacccaggccaactgctatcccacaggttactctcttcttcattttaaggcaagctattccaaagactaaaaatgcctaagattctgtcttaaaagcttatctgcatagtcatcttcaaaagcaaacatgaatttctcaaggaacggaaacacccttagcccctgcccttttctccatagcatcattctctgccccaccaagccggaactaggagggcactttctctaggagaggtatgacctggagatgatctgcttcagagccacctcagggatcttgcttaaaaatgcatattttcccaggcaaagtggctcatgcctataataccaacaacagtggaggctgaggtgggaggatctaaaggccaggagtttgagaccagcctggacaacatagtgccacccctttggtacgaattttttttttttttttttttgagacagactcttgctctgtcacctaggctggagtgtagcggcgcaatcccgtctcaccgcaacctccgcctcctgggttcaagcaattctcctgcctcagcctcccaagtagcttggactacaggcatatgccaccacacccgctaatttttgtactttttaagtagagatggagtttcaccatgttggccaggctggtctcgaactcctgacctcaagccttctgtcttccttggcttcccaaagtgctgggattacaggcatgagccactgtgccctgccaatttttttttttttaattatctgggcctggtgtcctgtgcctgtggtcccagctgctcaggaggctgagccagaaggcatcacttgagcccaagagttggtggctgcagtgctatgatggtgacactgcactccagcctgagcaacagggcaagaactgtttctaaaataaataaattttaaaaatgcaaatatccaccccagccccaccctctccccccaccttcccccacattactacatcggaatccctagggtgaggcatggaatctacattttaaaccagctcccaaggtgattgttccgcacagttccacgtcagtgtttgagagaggctctgatttattccagtcctctttctttacagagaaggaaagcagaaagcaggcaccagagaggtgaaatgagcttgtccaaggtcacaggttgttaaggtgaccagagctggacgaaaccccacctctctcgctgactagcacagcgccagctaggaagagcctagaatagcgaccaactggcaggccaaaccgtcccctgcccctgcccctgcctcggagaagcgggcccctgcactcacccgcttgtagatgtcctcccggctggcctcatacttctgttgcatgcgctcctccaggaagtagatgcgcagcttgaggctgaagttctccttcttcaggtcattgaggtgctgggacagagtgcgatatccattagacatgatgggcaacccatggggaggagcgtgcccgattgccccctcaacccaggaacatggtgcagctgcaccgcagcatgaagccagccggctgggacgctgctgaggctgcggaccgagaggctggggctacggcgacatggcccctattgctggagctctctccgggactcgggactgggctcactgctctgggtgctggagcgcagcacactttccttttttacctcagggagatatttgcggaatccctgacagaggaacatgctgcgtgaactcagacacaagtggtgtaacccgactcc
